United States Patent 12,043,843 (MATERIALS AND METHODS FOR TREATMENT OF HEMOGLOBINOPATHIES) - sequence listing, part 5

SEQ ID NO: 134774 - DNA, 22 bp, Artificial Sequence
  chemically synthesized
agacagagccttgctttgtcgc

SEQ ID NO: 134775 - DNA, 22 bp, Artificial Sequence
  chemically synthesized
gctttgtcgcccaggctgtagt

SEQ ID NO: 134776 - DNA, 22 bp, Artificial Sequence
  chemically synthesized
ctttgtcgcccaggctgtagtg

SEQ ID NO: 134777 - DNA, 22 bp, Artificial Sequence
  chemically synthesized
tgtcgcccaggctgtagtgcag

SEQ ID NO: 134778 - DNA, 22 bp, Artificial Sequence
  chemically synthesized
gtcgcccaggctgtagtgcagt

SEQ ID NO: 134779 - DNA, 22 bp, Artificial Sequence
  chemically synthesized
tcgcccaggctgtagtgcagtg

SEQ ID NO: 134780 - DNA, 22 bp, Artificial Sequence
  chemically synthesized
tagtgcagtggcacaatcttgg

SEQ ID NO: 134781 - DNA, 22 bp, Artificial Sequence
  chemically synthesized
ggctcactgcgacgacctctgc

SEQ ID NO: 134782 - DNA, 22 bp, Artificial Sequence
  chemically synthesized
gctcactgcgacgacctctgct

SEQ ID NO: 134783 - DNA, 22 bp, Artificial Sequence
  chemically synthesized
actgcgacgacctctgctcccc

SEQ ID NO: 134784 - DNA, 22 bp, Artificial Sequence
  chemically synthesized
cgacgacctctgctccccagtt

SEQ ID NO: 134785 - DNA, 22 bp, Artificial Sequence
  chemically synthesized
tgctccccagtttttttaaagc

SEQ ID NO: 134786 - DNA, 22 bp, Artificial Sequence
  chemically synthesized
ctccccagtttttttaaagcaa

SEQ ID NO: 134787 - DNA, 22 bp, Artificial Sequence
  chemically synthesized
cccagtttttttaaagcaattc

SEQ ID NO: 134788 - DNA, 22 bp, Artificial Sequence
  chemically synthesized
ttttaaagcaattctcctgcct

SEQ ID NO: 134789 - DNA, 22 bp, Artificial Sequence
  chemically synthesized
tttaaagcaattctcctgcctc

SEQ ID NO: 134790 - DNA, 22 bp, Artificial Sequence
  chemically synthesized
ttaaagcaattctcctgcctca

SEQ ID NO: 134791 - DNA, 22 bp, Artificial Sequence
  chemically synthesized
taaagcaattctcctgcctcag

SEQ ID NO: 134792 - DNA, 22 bp, Artificial Sequence
  chemically synthesized
aaagcaattctcctgcctcagc

SEQ ID NO: 134793 - DNA, 22 bp, Artificial Sequence
  chemically synthesized
aagcaattctcctgcctcagcc

SEQ ID NO: 134794 - DNA, 22 bp, Artificial Sequence
  chemically synthesized
tcctgcctcagcctcccgagta

SEQ ID NO: 134795 - DNA, 22 bp, Artificial Sequence
  chemically synthesized
ctgcctcagcctcccgagtagc

SEQ ID NO: 134796 - DNA, 22 bp, Artificial Sequence
  chemically synthesized
cctcagcctcccgagtagctgg

SEQ ID NO: 134797 - DNA, 22 bp, Artificial Sequence
  chemically synthesized
agcctcccgagtagctgggatt

SEQ ID NO: 134798 - DNA, 22 bp, Artificial Sequence
  chemically synthesized
ccgagtagctgggattacaggc

SEQ ID NO: 134799 - DNA, 22 bp, Artificial Sequence
  chemically synthesized
ggattacaggcgctcaccacca

SEQ ID NO: 134800 - DNA, 22 bp, Artificial Sequence
  chemically synthesized
caggcgctcaccaccacaccca

SEQ ID NO: 134801 - DNA, 22 bp, Artificial Sequence
  chemically synthesized
accaccacacccagctaatttt

SEQ ID NO: 134802 - DNA, 22 bp, Artificial Sequence
  chemically synthesized
atttttgtatttttagtagaga

SEQ ID NO: 134803 - DNA, 22 bp, Artificial Sequence
  chemically synthesized
ttgtatttttagtagagacagg

SEQ ID NO: 134804 - DNA, 22 bp, Artificial Sequence
  chemically synthesized
tgtatttttagtagagacaggg

SEQ ID NO: 134805 - DNA, 22 bp, Artificial Sequence
  chemically synthesized
gtatttttagtagagacagggt

SEQ ID NO: 134806 - DNA, 22 bp, Artificial Sequence
  chemically synthesized
tatttttagtagagacagggtt

SEQ ID NO: 134807 - DNA, 22 bp, Artificial Sequence
  chemically synthesized
ttagtagagacagggtttcacc

SEQ ID NO: 134808 - DNA, 22 bp, Artificial Sequence
  chemically synthesized
tagtagagacagggtttcacca

SEQ ID NO: 134809 - DNA, 22 bp, Artificial Sequence
  chemically synthesized
agtagagacagggtttcaccat

SEQ ID NO: 134810 - DNA, 22 bp, Artificial Sequence
  chemically synthesized
gtagagacagggtttcaccatg

SEQ ID NO: 134811 - DNA, 22 bp, Artificial Sequence
  chemically synthesized
caccatgttggccaggctagtc

SEQ ID NO: 134812 - DNA, 22 bp, Artificial Sequence
  chemically synthesized
accatgttggccaggctagtct

SEQ ID NO: 134813 - DNA, 22 bp, Artificial Sequence
  chemically synthesized
gccaggctagtctcaaactgct

SEQ ID NO: 134814 - DNA, 22 bp, Artificial Sequence
  chemically synthesized
gtctcaaactgctgacctcgtg

SEQ ID NO: 134815 - DNA, 22 bp, Artificial Sequence
  chemically synthesized
aaactgctgacctcgtgatcca

SEQ ID NO: 134816 - DNA, 22 bp, Artificial Sequence
  chemically synthesized
ctgacctcgtgatccacctcag

SEQ ID NO: 134817 - DNA, 22 bp, Artificial Sequence
  chemically synthesized
acctcgtgatccacctcagcct

SEQ ID NO: 134818 - DNA, 22 bp, Artificial Sequence
  chemically synthesized
gtgatccacctcagccttccaa

SEQ ID NO: 134819 - DNA, 22 bp, Artificial Sequence
  chemically synthesized
agccttccaaagtgctaggatt

SEQ ID NO: 134820 - DNA, 22 bp, Artificial Sequence
  chemically synthesized
ccaaagtgctaggattacaggc

SEQ ID NO: 134821 - DNA, 22 bp, Artificial Sequence
  chemically synthesized
caaagtgctaggattacaggca

SEQ ID NO: 134822 - DNA, 22 bp, Artificial Sequence
  chemically synthesized
ggattacaggcatgagcctctg

SEQ ID NO: 134823 - DNA, 22 bp, Artificial Sequence
  chemically synthesized
caggcatgagcctctgtgcctg

SEQ ID NO: 134824 - DNA, 22 bp, Artificial Sequence
  chemically synthesized
tgtgcctggccacctcttccat

SEQ ID NO: 134825 - DNA, 22 bp, Artificial Sequence
  chemically synthesized
tgcctggccacctcttccattt

SEQ ID NO: 134826 - DNA, 22 bp, Artificial Sequence
  chemically synthesized
gccacctcttccattttaattt

SEQ ID NO: 134827 - DNA, 22 bp, Artificial Sequence
  chemically synthesized
ttccattttaatttgtacttaa

SEQ ID NO: 134828 - DNA, 22 bp, Artificial Sequence
  chemically synthesized
ccattttaatttgtacttaagg

SEQ ID NO: 134829 - DNA, 22 bp, Artificial Sequence
  chemically synthesized
cattttaatttgtacttaaggt

SEQ ID NO: 134830 - DNA, 22 bp, Artificial Sequence
  chemically synthesized
taatttgtacttaaggtaagat

SEQ ID NO: 134831 - DNA, 22 bp, Artificial Sequence
  chemically synthesized
aatttgtacttaaggtaagata

SEQ ID NO: 134832 - DNA, 22 bp, Artificial Sequence
  chemically synthesized
atttgtacttaaggtaagatat

SEQ ID NO: 134833 - DNA, 22 bp, Artificial Sequence
  chemically synthesized
gtacttaaggtaagatataaaa

SEQ ID NO: 134834 - DNA, 22 bp, Artificial Sequence
  chemically synthesized
tacttaaggtaagatataaaaa

SEQ ID NO: 134835 - DNA, 22 bp, Artificial Sequence
  chemically synthesized
aaggtaagatataaaaaagtca

SEQ ID NO: 134836 - DNA, 22 bp, Artificial Sequence
  chemically synthesized
aggtaagatataaaaaagtcac

SEQ ID NO: 134837 - DNA, 22 bp, Artificial Sequence
  chemically synthesized
aaaagctgagatttttcagata

SEQ ID NO: 134838 - DNA, 22 bp, Artificial Sequence
  chemically synthesized
aaagctgagatttttcagatat

SEQ ID NO: 134839 - DNA, 22 bp, Artificial Sequence
  chemically synthesized
agatttttcagatattttgtct

SEQ ID NO: 134840 - DNA, 22 bp, Artificial Sequence
  chemically synthesized
ttcagatattttgtcttcatct

SEQ ID NO: 134841 - DNA, 22 bp, Artificial Sequence
  chemically synthesized
tcagatattttgtcttcatctc

SEQ ID NO: 134842 - DNA, 22 bp, Artificial Sequence
  chemically synthesized
cagatattttgtcttcatctca

SEQ ID NO: 134843 - DNA, 22 bp, Artificial Sequence
  chemically synthesized
agatattttgtcttcatctcat

SEQ ID NO: 134844 - DNA, 22 bp, Artificial Sequence
  chemically synthesized
tgtcttcatctcatggcttccc

SEQ ID NO: 134845 - DNA, 22 bp, Artificial Sequence
  chemically synthesized
gtcttcatctcatggcttccca

SEQ ID NO: 134846 - DNA, 22 bp, Artificial Sequence
  chemically synthesized
tcttcatctcatggcttcccat

SEQ ID NO: 134847 - DNA, 22 bp, Artificial Sequence
  chemically synthesized
catctcatggcttcccattgtc

SEQ ID NO: 134848 - DNA, 22 bp, Artificial Sequence
  chemically synthesized
atctcatggcttcccattgtca

SEQ ID NO: 134849 - DNA, 22 bp, Artificial Sequence
  chemically synthesized
atggcttcccattgtcagttga

SEQ ID NO: 134850 - DNA, 22 bp, Artificial Sequence
  chemically synthesized
cccattgtcagttgactttaaa

SEQ ID NO: 134851 - DNA, 22 bp, Artificial Sequence
  chemically synthesized
ccattgtcagttgactttaaat

SEQ ID NO: 134852 - DNA, 22 bp, Artificial Sequence
  chemically synthesized
tcagttgactttaaatatttat

SEQ ID NO: 134853 - DNA, 22 bp, Artificial Sequence
  chemically synthesized
actttaaatatttattttggta

SEQ ID NO: 134854 - DNA, 22 bp, Artificial Sequence
  chemically synthesized
taaatatttattttggtatatt

SEQ ID NO: 134855 - DNA, 22 bp, Artificial Sequence
  chemically synthesized
aaatatttattttggtatattt

SEQ ID NO: 134856 - DNA, 22 bp, Artificial Sequence
  chemically synthesized
aatatttattttggtatattta

SEQ ID NO: 134857 - DNA, 22 bp, Artificial Sequence
  chemically synthesized
attttggtatatttattaattt

SEQ ID NO: 134858 - DNA, 22 bp, Artificial Sequence
  chemically synthesized
ttttggtatatttattaatttc

SEQ ID NO: 134859 - DNA, 22 bp, Artificial Sequence
  chemically synthesized
tggtatatttattaatttcttc

SEQ ID NO: 134860 - DNA, 22 bp, Artificial Sequence
  chemically synthesized
ggtatatttattaatttcttct

SEQ ID NO: 134861 - DNA, 22 bp, Artificial Sequence
  chemically synthesized
gtatatttattaatttcttcta

SEQ ID NO: 134862 - DNA, 22 bp, Artificial Sequence
  chemically synthesized
attaatttcttctataggaaca

SEQ ID NO: 134863 - DNA, 22 bp, Artificial Sequence
  chemically synthesized
ttaatttcttctataggaacac

SEQ ID NO: 134864 - DNA, 22 bp, Artificial Sequence
  chemically synthesized
atttcttctataggaacacaat

SEQ ID NO: 134865 - DNA, 22 bp, Artificial Sequence
  chemically synthesized
cttctataggaacacaattttg

SEQ ID NO: 134866 - DNA, 22 bp, Artificial Sequence
  chemically synthesized
ttctataggaacacaattttgg

SEQ ID NO: 134867 - DNA, 22 bp, Artificial Sequence
  chemically synthesized
ctataggaacacaattttgggg

SEQ ID NO: 134868 - DNA, 22 bp, Artificial Sequence
  chemically synthesized
tataggaacacaattttggggc

SEQ ID NO: 134869 - DNA, 22 bp, Artificial Sequence
  chemically synthesized
taggaacacaattttggggcaa

SEQ ID NO: 134870 - DNA, 22 bp, Artificial Sequence
  chemically synthesized
tggggcaatatgtggagatgaa

SEQ ID NO: 134871 - DNA, 22 bp, Artificial Sequence
  chemically synthesized
ggggcaatatgtggagatgaaa

SEQ ID NO: 134872 - DNA, 22 bp, Artificial Sequence
  chemically synthesized
gggcaatatgtggagatgaaaa

SEQ ID NO: 134873 - DNA, 22 bp, Artificial Sequence
  chemically synthesized
aggggacactgattgtacaggg

SEQ ID NO: 134874 - DNA, 22 bp, Artificial Sequence
  chemically synthesized
attgtacagggcacttgcagat

SEQ ID NO: 134875 - DNA, 22 bp, Artificial Sequence
  chemically synthesized
tacagggcacttgcagattatc

SEQ ID NO: 134876 - DNA, 22 bp, Artificial Sequence
  chemically synthesized
gcagattatctggaactaaacg

SEQ ID NO: 134877 - DNA, 22 bp, Artificial Sequence
  chemically synthesized
cagattatctggaactaaacgg

SEQ ID NO: 134878 - DNA, 22 bp, Artificial Sequence
  chemically synthesized
tctggaactaaacggaagactg

SEQ ID NO: 134879 - DNA, 22 bp, Artificial Sequence
  chemically synthesized
gaactaaacggaagactgttct

SEQ ID NO: 134880 - DNA, 22 bp, Artificial Sequence
  chemically synthesized
aacggaagactgttctttttta

SEQ ID NO: 134881 - DNA, 22 bp, Artificial Sequence
  chemically synthesized
ttcttttttaacacgatcttaa

SEQ ID NO: 134882 - DNA, 22 bp, Artificial Sequence
  chemically synthesized
ttttttaacacgatcttaatat

SEQ ID NO: 134883 - DNA, 22 bp, Artificial Sequence
  chemically synthesized
ttttaacacgatcttaatattc

SEQ ID NO: 134884 - DNA, 22 bp, Artificial Sequence
  chemically synthesized
tttaacacgatcttaatattct

SEQ ID NO: 134885 - DNA, 22 bp, Artificial Sequence
  chemically synthesized
ttaacacgatcttaatattctc

SEQ ID NO: 134886 - DNA, 22 bp, Artificial Sequence
  chemically synthesized
taacacgatcttaatattctct

SEQ ID NO: 134887 - DNA, 22 bp, Artificial Sequence
  chemically synthesized
aacacgatcttaatattctctt

SEQ ID NO: 134888 - DNA, 22 bp, Artificial Sequence
  chemically synthesized
acacgatcttaatattctcttt

SEQ ID NO: 134889 - DNA, 22 bp, Artificial Sequence
  chemically synthesized
aatattctctttttgtcttctc

SEQ ID NO: 134890 - DNA, 22 bp, Artificial Sequence
  chemically synthesized
atattctctttttgtcttctca

SEQ ID NO: 134891 - DNA, 22 bp, Artificial Sequence
  chemically synthesized
tctttttgtcttctcattttag

SEQ ID NO: 134892 - DNA, 22 bp, Artificial Sequence
  chemically synthesized
tttttgtcttctcattttagtt

SEQ ID NO: 134893 - DNA, 22 bp, Artificial Sequence
  chemically synthesized
tttgtcttctcattttagttta

SEQ ID NO: 134894 - DNA, 22 bp, Artificial Sequence
  chemically synthesized
ttgtcttctcattttagtttat

SEQ ID NO: 134895 - DNA, 22 bp, Artificial Sequence
  chemically synthesized
tgtcttctcattttagtttatg

SEQ ID NO: 134896 - DNA, 22 bp, Artificial Sequence
  chemically synthesized
gtcttctcattttagtttatgt

SEQ ID NO: 134897 - DNA, 22 bp, Artificial Sequence
  chemically synthesized
tcttctcattttagtttatgtc

SEQ ID NO: 134898 - DNA, 22 bp, Artificial Sequence
  chemically synthesized
ctcattttagtttatgtcttta

SEQ ID NO: 134899 - DNA, 22 bp, Artificial Sequence
  chemically synthesized
tcattttagtttatgtctttat

SEQ ID NO: 134900 - DNA, 22 bp, Artificial Sequence
  chemically synthesized
attttagtttatgtctttataa

SEQ ID NO: 134901 - DNA, 22 bp, Artificial Sequence
  chemically synthesized
tagtttatgtctttataaatgg

SEQ ID NO: 134902 - DNA, 22 bp, Artificial Sequence
  chemically synthesized
agtttatgtctttataaatggt

SEQ ID NO: 134903 - DNA, 22 bp, Artificial Sequence
  chemically synthesized
gtttatgtctttataaatggtt

SEQ ID NO: 134904 - DNA, 22 bp, Artificial Sequence
  chemically synthesized
atgtctttataaatggtttcct

SEQ ID NO: 134905 - DNA, 22 bp, Artificial Sequence
  chemically synthesized
tgtctttataaatggtttcctg

SEQ ID NO: 134906 - DNA, 22 bp, Artificial Sequence
  chemically synthesized
tataaatggtttcctgaacagt

SEQ ID NO: 134907 - DNA, 22 bp, Artificial Sequence
  chemically synthesized
ataaatggtttcctgaacagtt

SEQ ID NO: 134908 - DNA, 22 bp, Artificial Sequence
  chemically synthesized
taaatggtttcctgaacagttc

SEQ ID NO: 134909 - DNA, 22 bp, Artificial Sequence
  chemically synthesized
cctgaacagttcctaagctttt

SEQ ID NO: 134910 - DNA, 22 bp, Artificial Sequence
  chemically synthesized
ctgaacagttcctaagcttttt

SEQ ID NO: 134911 - DNA, 22 bp, Artificial Sequence
  chemically synthesized
aacagttcctaagctttttgtc

SEQ ID NO: 134912 - DNA, 22 bp, Artificial Sequence
  chemically synthesized
ctaagctttttgtcagcatggc

SEQ ID NO: 134913 - DNA, 22 bp, Artificial Sequence
  chemically synthesized
agctttttgtcagcatggcaag

SEQ ID NO: 134914 - DNA, 22 bp, Artificial Sequence
  chemically synthesized
tttgtcagcatggcaagttgaa

SEQ ID NO: 134915 - DNA, 22 bp, Artificial Sequence
  chemically synthesized
ttgtcagcatggcaagttgaag

SEQ ID NO: 134916 - DNA, 22 bp, Artificial Sequence
  chemically synthesized
tgtcagcatggcaagttgaaga

SEQ ID NO: 134917 - DNA, 22 bp, Artificial Sequence
  chemically synthesized
gtcagcatggcaagttgaagaa

SEQ ID NO: 134918 - DNA, 22 bp, Artificial Sequence
  chemically synthesized
tcagcatggcaagttgaagaag

SEQ ID NO: 134919 - DNA, 22 bp, Artificial Sequence
  chemically synthesized
aagaagctctggatgatggatc

SEQ ID NO: 134920 - DNA, 22 bp, Artificial Sequence
  chemically synthesized
tggatgatggatctatgttacc

SEQ ID NO: 134921 - DNA, 22 bp, Artificial Sequence
  chemically synthesized
gatgatggatctatgttacctt

SEQ ID NO: 134922 - DNA, 22 bp, Artificial Sequence
  chemically synthesized
tgttaccttcagaaactcttga

SEQ ID NO: 134923 - DNA, 22 bp, Artificial Sequence
  chemically synthesized
ccttcagaaactcttgaggact

SEQ ID NO: 134924 - DNA, 22 bp, Artificial Sequence
  chemically synthesized
cagaaactcttgaggactctgg

SEQ ID NO: 134925 - DNA, 22 bp, Artificial Sequence
  chemically synthesized
agaaactcttgaggactctggg

SEQ ID NO: 134926 - DNA, 22 bp, Artificial Sequence
  chemically synthesized
ttgaggactctgggatagttgc

SEQ ID NO: 134927 - DNA, 22 bp, Artificial Sequence
  chemically synthesized
gaggactctgggatagttgctg

SEQ ID NO: 134928 - DNA, 22 bp, Artificial Sequence
  chemically synthesized
aggactctgggatagttgctgt

SEQ ID NO: 134929 - DNA, 22 bp, Artificial Sequence
  chemically synthesized
tgggatagttgctgtcaaagaa

SEQ ID NO: 134930 - DNA, 22 bp, Artificial Sequence
  chemically synthesized
ggatagttgctgtcaaagaatc

SEQ ID NO: 134931 - DNA, 22 bp, Artificial Sequence
  chemically synthesized
ctgtcaaagaatcagtccaaag

SEQ ID NO: 134932 - DNA, 22 bp, Artificial Sequence
  chemically synthesized
tcaaagaatcagtccaaaggca

SEQ ID NO: 134933 - DNA, 22 bp, Artificial Sequence
  chemically synthesized
agaaaggggcaagagaacagtg

SEQ ID NO: 134934 - DNA, 22 bp, Artificial Sequence
  chemically synthesized
ttgcatccctcagggggcctct

SEQ ID NO: 134935 - DNA, 22 bp, Artificial Sequence
  chemically synthesized
tgcatccctcagggggcctcta

SEQ ID NO: 134936 - DNA, 22 bp, Artificial Sequence
  chemically synthesized
gcatccctcagggggcctctat

SEQ ID NO: 134937 - DNA, 22 bp, Artificial Sequence
  chemically synthesized
catccctcagggggcctctatg

SEQ ID NO: 134938 - DNA, 22 bp, Artificial Sequence
  chemically synthesized
agggggcctctatgcttgcctg

SEQ ID NO: 134939 - DNA, 22 bp, Artificial Sequence
  chemically synthesized
tatgcttgcctgagagtgataa

SEQ ID NO: 134940 - DNA, 22 bp, Artificial Sequence
  chemically synthesized
tgcttgcctgagagtgataaat

SEQ ID NO: 134941 - DNA, 22 bp, Artificial Sequence
  chemically synthesized
gcctgagagtgataaattccac

SEQ ID NO: 134942 - DNA, 22 bp, Artificial Sequence
  chemically synthesized
cctgagagtgataaattccact

SEQ ID NO: 134943 - DNA, 22 bp, Artificial Sequence
  chemically synthesized
agagtgataaattccactaaag

SEQ ID NO: 134944 - DNA, 22 bp, Artificial Sequence
  chemically synthesized
cactaaagttatgactctcact

SEQ ID NO: 134945 - DNA, 22 bp, Artificial Sequence
  chemically synthesized
aagttatgactctcacttttgt

SEQ ID NO: 134946 - DNA, 22 bp, Artificial Sequence
  chemically synthesized
tgactctcacttttgtcatgta

SEQ ID NO: 134947 - DNA, 22 bp, Artificial Sequence
  chemically synthesized
tcacttttgtcatgtatcacat

SEQ ID NO: 134948 - DNA, 22 bp, Artificial Sequence
  chemically synthesized
acttttgtcatgtatcacattc

SEQ ID NO: 134949 - DNA, 22 bp, Artificial Sequence
  chemically synthesized
ttgtcatgtatcacattctagg

SEQ ID NO: 134950 - DNA, 22 bp, Artificial Sequence
  chemically synthesized
tgtcatgtatcacattctagga

SEQ ID NO: 134951 - DNA, 22 bp, Artificial Sequence
  chemically synthesized
gtcatgtatcacattctaggag

SEQ ID NO: 134952 - DNA, 22 bp, Artificial Sequence
  chemically synthesized
tcatgtatcacattctaggaga

SEQ ID NO: 134953 - DNA, 22 bp, Artificial Sequence
  chemically synthesized
taggagactccctaaactatta

SEQ ID NO: 134954 - DNA, 22 bp, Artificial Sequence
  chemically synthesized
ggagactccctaaactattagg

SEQ ID NO: 134955 - DNA, 22 bp, Artificial Sequence
  chemically synthesized
cctaaactattagggcaactat

SEQ ID NO: 134956 - DNA, 22 bp, Artificial Sequence
  chemically synthesized
aactattagggcaactattctc

SEQ ID NO: 134957 - DNA, 22 bp, Artificial Sequence
  chemically synthesized
ttagggcaactattctccctgg

SEQ ID NO: 134958 - DNA, 22 bp, Artificial Sequence
  chemically synthesized
gggcaactattctccctggaat

SEQ ID NO: 134959 - DNA, 22 bp, Artificial Sequence
  chemically synthesized
ttctccctggaatatttgggta

SEQ ID NO: 134960 - DNA, 22 bp, Artificial Sequence
  chemically synthesized
tccctggaatatttgggtatgt

SEQ ID NO: 134961 - DNA, 22 bp, Artificial Sequence
  chemically synthesized
cctggaatatttgggtatgtgg

SEQ ID NO: 134962 - DNA, 22 bp, Artificial Sequence
  chemically synthesized
gaatatttgggtatgtggacag

SEQ ID NO: 134963 - DNA, 22 bp, Artificial Sequence
  chemically synthesized
gggtatgtggacagtttctggt

SEQ ID NO: 134964 - DNA, 22 bp, Artificial Sequence
  chemically synthesized
ggtatgtggacagtttctggta

SEQ ID NO: 134965 - DNA, 22 bp, Artificial Sequence
  chemically synthesized
ctggtactaccaaatttgccac

SEQ ID NO: 134966 - DNA, 22 bp, Artificial Sequence
  chemically synthesized
tggtactaccaaatttgccaca

SEQ ID NO: 134967 - DNA, 22 bp, Artificial Sequence
  chemically synthesized
gtactaccaaatttgccacaat

SEQ ID NO: 134968 - DNA, 22 bp, Artificial Sequence
  chemically synthesized
ccaaatttgccacaattaaatg

SEQ ID NO: 134969 - DNA, 22 bp, Artificial Sequence
  chemically synthesized
gccacaattaaatgccagcgta

SEQ ID NO: 134970 - DNA, 22 bp, Artificial Sequence
  chemically synthesized
ccacaattaaatgccagcgtag

SEQ ID NO: 134971 - DNA, 22 bp, Artificial Sequence
  chemically synthesized
aatgccagcgtagctgttttgc

SEQ ID NO: 134972 - DNA, 22 bp, Artificial Sequence
  chemically synthesized
ttttgctagagactgcagatgt

SEQ ID NO: 134973 - DNA, 22 bp, Artificial Sequence
  chemically synthesized
tgctagagactgcagatgttaa

SEQ ID NO: 134974 - DNA, 22 bp, Artificial Sequence
  chemically synthesized
gctagagactgcagatgttaaa

SEQ ID NO: 134975 - DNA, 22 bp, Artificial Sequence
  chemically synthesized
ctagagactgcagatgttaaat

SEQ ID NO: 134976 - DNA, 22 bp, Artificial Sequence
  chemically synthesized
gagactgcagatgttaaataga

SEQ ID NO: 134977 - DNA, 22 bp, Artificial Sequence
  chemically synthesized
cagatgttaaatagagggctat

SEQ ID NO: 134978 - DNA, 22 bp, Artificial Sequence
  chemically synthesized
aatagagggctatctttaggtc

SEQ ID NO: 134979 - DNA, 22 bp, Artificial Sequence
  chemically synthesized
tctttaggtcaataaaatatac

SEQ ID NO: 134980 - DNA, 22 bp, Artificial Sequence
  chemically synthesized
taggtcaataaaatatacttat

SEQ ID NO: 134981 - DNA, 22 bp, Artificial Sequence
  chemically synthesized
aggtcaataaaatatacttata

SEQ ID NO: 134982 - DNA, 22 bp, Artificial Sequence
  chemically synthesized
ggtcaataaaatatacttataa

SEQ ID NO: 134983 - DNA, 22 bp, Artificial Sequence
  chemically synthesized
ataaattgtattaactatttcc

SEQ ID NO: 134984 - DNA, 22 bp, Artificial Sequence
  chemically synthesized
taaattgtattaactatttccc

SEQ ID NO: 134985 - DNA, 22 bp, Artificial Sequence
  chemically synthesized
tattaactatttccccagtaat

SEQ ID NO: 134986 - DNA, 22 bp, Artificial Sequence
  chemically synthesized
actatttccccagtaattacca

SEQ ID NO: 134987 - DNA, 22 bp, Artificial Sequence
  chemically synthesized
tttccccagtaattaccacaca

SEQ ID NO: 134988 - DNA, 22 bp, Artificial Sequence
  chemically synthesized
ccccagtaattaccacacagtt

SEQ ID NO: 134989 - DNA, 22 bp, Artificial Sequence
  chemically synthesized
cccagtaattaccacacagttt

SEQ ID NO: 134990 - DNA, 22 bp, Artificial Sequence
  chemically synthesized
ccacacagttttaataaaaccc

SEQ ID NO: 134991 - DNA, 22 bp, Artificial Sequence
  chemically synthesized
taataaaaccctgtgcatccgc

SEQ ID NO: 134992 - DNA, 22 bp, Artificial Sequence
  chemically synthesized
aataaaaccctgtgcatccgca

SEQ ID NO: 134993 - DNA, 22 bp, Artificial Sequence
  chemically synthesized
ataaaaccctgtgcatccgcat

SEQ ID NO: 134994 - DNA, 22 bp, Artificial Sequence
  chemically synthesized
tgcatccgcatgtcccaaacgc

SEQ ID NO: 134995 - DNA, 22 bp, Artificial Sequence
  chemically synthesized
aggttttgaaaacacgactata

SEQ ID NO: 134996 - DNA, 22 bp, Artificial Sequence
  chemically synthesized
tgaaaacacgactatagtttaa

SEQ ID NO: 134997 - DNA, 22 bp, Artificial Sequence
  chemically synthesized
gaaaacacgactatagtttaag

SEQ ID NO: 134998 - DNA, 22 bp, Artificial Sequence
  chemically synthesized
aaaacacgactatagtttaaga

SEQ ID NO: 134999 - DNA, 22 bp, Artificial Sequence
  chemically synthesized
tagtttaagaataatcaggcct

SEQ ID NO: 135000 - DNA, 22 bp, Artificial Sequence
  chemically synthesized
aagaataatcaggcctcctccg

SEQ ID NO: 135001 - DNA, 22 bp, Artificial Sequence
  chemically synthesized
agaataatcaggcctcctccgg

SEQ ID NO: 135002 - DNA, 22 bp, Artificial Sequence
  chemically synthesized
ctccggcttcctccatctggtc

SEQ ID NO: 135003 - DNA, 22 bp, Artificial Sequence
  chemically synthesized
cggcttcctccatctggtccat

SEQ ID NO: 135004 - DNA, 22 bp, Artificial Sequence
  chemically synthesized
cctccatctggtccattatctg

SEQ ID NO: 135005 - DNA, 22 bp, Artificial Sequence
  chemically synthesized
ctccatctggtccattatctgg

SEQ ID NO: 135006 - DNA, 22 bp, Artificial Sequence
  chemically synthesized
catctggtccattatctgggtg

SEQ ID NO: 135007 - DNA, 22 bp, Artificial Sequence
  chemically synthesized
gtccattatctgggtgacagta

SEQ ID NO: 135008 - DNA, 22 bp, Artificial Sequence
  chemically synthesized
tctgggtgacagtagatccaaa

SEQ ID NO: 135009 - DNA, 22 bp, Artificial Sequence
  chemically synthesized
ggtgacagtagatccaaataag

SEQ ID NO: 135010 - DNA, 22 bp, Artificial Sequence
  chemically synthesized
gctcttatcctgtacaacaaat

SEQ ID NO: 135011 - DNA, 22 bp, Artificial Sequence
  chemically synthesized
ttatcctgtacaacaaattttg

SEQ ID NO: 135012 - DNA, 22 bp, Artificial Sequence
  chemically synthesized
atcctgtacaacaaattttggc

SEQ ID NO: 135013 - DNA, 22 bp, Artificial Sequence
  chemically synthesized
tcctgtacaacaaattttggca

SEQ ID NO: 135014 - DNA, 22 bp, Artificial Sequence
  chemically synthesized
tacaacaaattttggcattaat

SEQ ID NO: 135015 - DNA, 22 bp, Artificial Sequence
  chemically synthesized
tggcattaatccattctcttat

SEQ ID NO: 135016 - DNA, 22 bp, Artificial Sequence
  chemically synthesized
ggcattaatccattctcttata

SEQ ID NO: 135017 - DNA, 22 bp, Artificial Sequence
  chemically synthesized
gcattaatccattctcttataa

SEQ ID NO: 135018 - DNA, 22 bp, Artificial Sequence
  chemically synthesized
atccattctcttataaggcaac

SEQ ID NO: 135019 - DNA, 22 bp, Artificial Sequence
  chemically synthesized
tcttataaggcaacattggaag

SEQ ID NO: 135020 - DNA, 22 bp, Artificial Sequence
  chemically synthesized
ttataaggcaacattggaaggt

SEQ ID NO: 135021 - DNA, 22 bp, Artificial Sequence
  chemically synthesized
ataaggcaacattggaaggtta

SEQ ID NO: 135022 - DNA, 22 bp, Artificial Sequence
  chemically synthesized
taaggcaacattggaaggttaa

SEQ ID NO: 135023 - DNA, 22 bp, Artificial Sequence
  chemically synthesized
gaaggttaagagaacttataat

SEQ ID NO: 135024 - DNA, 22 bp, Artificial Sequence
  chemically synthesized
agagaacttataatgatataca

SEQ ID NO: 135025 - DNA, 22 bp, Artificial Sequence
  chemically synthesized
ataatgatatacacatcactcc

SEQ ID NO: 135026 - DNA, 22 bp, Artificial Sequence
  chemically synthesized
taatgatatacacatcactcct

SEQ ID NO: 135027 - DNA, 22 bp, Artificial Sequence
  chemically synthesized
ctgtggcggtagataagttctg

SEQ ID NO: 135028 - DNA, 22 bp, Artificial Sequence
  chemically synthesized
tggcggtagataagttctgcca

SEQ ID NO: 135029 - DNA, 22 bp, Artificial Sequence
  chemically synthesized
tgccacattaagcactatgcag

SEQ ID NO: 135030 - DNA, 22 bp, Artificial Sequence
  chemically synthesized
ccacattaagcactatgcaggt

SEQ ID NO: 135031 - DNA, 22 bp, Artificial Sequence
  chemically synthesized
agcactatgcaggtcataattc

SEQ ID NO: 135032 - DNA, 22 bp, Artificial Sequence
  chemically synthesized
tgcaggtcataattcagtggat

SEQ ID NO: 135033 - DNA, 22 bp, Artificial Sequence
  chemically synthesized
agtggatcaagttagttagcag

SEQ ID NO: 135034 - DNA, 22 bp, Artificial Sequence
  chemically synthesized
gttagcagtgtttttagtatcc

SEQ ID NO: 135035 - DNA, 22 bp, Artificial Sequence
  chemically synthesized
gcagtgtttttagtatccatat

SEQ ID NO: 135036 - DNA, 22 bp, Artificial Sequence
  chemically synthesized
ttagtatccatatgaacatagt

SEQ ID NO: 135037 - DNA, 22 bp, Artificial Sequence
  chemically synthesized
tagtatccatatgaacatagtc

SEQ ID NO: 135038 - DNA, 22 bp, Artificial Sequence
  chemically synthesized
agtatccatatgaacatagtct

SEQ ID NO: 135039 - DNA, 22 bp, Artificial Sequence
  chemically synthesized
gtatccatatgaacatagtctc

SEQ ID NO: 135040 - DNA, 22 bp, Artificial Sequence
  chemically synthesized
tgctactgcagtgcctagactg

SEQ ID NO: 135041 - DNA, 22 bp, Artificial Sequence
  chemically synthesized
ctactgcagtgcctagactgac

SEQ ID NO: 135042 - DNA, 22 bp, Artificial Sequence
  chemically synthesized
ctgcagtgcctagactgacatt

SEQ ID NO: 135043 - DNA, 22 bp, Artificial Sequence
  chemically synthesized
cagtgcctagactgacattttt

SEQ ID NO: 135044 - DNA, 22 bp, Artificial Sequence
  chemically synthesized
gactgacatttttgttatcaac

SEQ ID NO: 135045 - DNA, 22 bp, Artificial Sequence
  chemically synthesized
acatttttgttatcaacagtgt

SEQ ID NO: 135046 - DNA, 22 bp, Artificial Sequence
  chemically synthesized
ttgttatcaacagtgtcccctg

SEQ ID NO: 135047 - DNA, 22 bp, Artificial Sequence
  chemically synthesized
tgttatcaacagtgtcccctga

SEQ ID NO: 135048 - DNA, 22 bp, Artificial Sequence
  chemically synthesized
gttatcaacagtgtcccctgaa

SEQ ID NO: 135049 - DNA, 22 bp, Artificial Sequence
  chemically synthesized
ttatcaacagtgtcccctgaag

SEQ ID NO: 135050 - DNA, 22 bp, Artificial Sequence
  chemically synthesized
tcaacagtgtcccctgaagtag

SEQ ID NO: 135051 - DNA, 22 bp, Artificial Sequence
  chemically synthesized
aagtagcagccctttcaaaagt

SEQ ID NO: 135052 - DNA, 22 bp, Artificial Sequence
  chemically synthesized
tcaaaagtcctttcacctttcc

SEQ ID NO: 135053 - DNA, 22 bp, Artificial Sequence
  chemically synthesized
caaaagtcctttcacctttcct

SEQ ID NO: 135054 - DNA, 22 bp, Artificial Sequence
  chemically synthesized
aaaagtcctttcacctttcctc

SEQ ID NO: 135055 - DNA, 22 bp, Artificial Sequence
  chemically synthesized
tcacctttcctctgtccatctc

SEQ ID NO: 135056 - DNA, 22 bp, Artificial Sequence
  chemically synthesized
cacctttcctctgtccatctct

SEQ ID NO: 135057 - DNA, 22 bp, Artificial Sequence
  chemically synthesized
acctttcctctgtccatctctc

SEQ ID NO: 135058 - DNA, 22 bp, Artificial Sequence
  chemically synthesized
tcctctgtccatctctctccac

SEQ ID NO: 135059 - DNA, 22 bp, Artificial Sequence
  chemically synthesized
cctctgtccatctctctccacc

SEQ ID NO: 135060 - DNA, 22 bp, Artificial Sequence
  chemically synthesized
ctctgtccatctctctccacca

SEQ ID NO: 135061 - DNA, 22 bp, Artificial Sequence
  chemically synthesized
tgtccatctctctccaccaata

SEQ ID NO: 135062 - DNA, 22 bp, Artificial Sequence
  chemically synthesized
tccatctctctccaccaataat

SEQ ID NO: 135063 - DNA, 22 bp, Artificial Sequence
  chemically synthesized
tctccaccaataattgcttata

SEQ ID NO: 135064 - DNA, 22 bp, Artificial Sequence
  chemically synthesized
tccaccaataattgcttatatt

SEQ ID NO: 135065 - DNA, 22 bp, Artificial Sequence
  chemically synthesized
caccaataattgcttatattag

SEQ ID NO: 135066 - DNA, 22 bp, Artificial Sequence
  chemically synthesized
cttatattagagatgttactat

SEQ ID NO: 135067 - DNA, 22 bp, Artificial Sequence
  chemically synthesized
atattagagatgttactatgtg

SEQ ID NO: 135068 - DNA, 22 bp, Artificial Sequence
  chemically synthesized
tattagagatgttactatgtgc

SEQ ID NO: 135069 - DNA, 22 bp, Artificial Sequence
  chemically synthesized
gagatgttactatgtgccaaaa

SEQ ID NO: 135070 - DNA, 22 bp, Artificial Sequence
  chemically synthesized
ctatgtgccaaaattctgaaac

SEQ ID NO: 135071 - DNA, 22 bp, Artificial Sequence
  chemically synthesized
tgtgccaaaattctgaaacata

SEQ ID NO: 135072 - DNA, 22 bp, Artificial Sequence
  chemically synthesized
tgaaacatataattattattgt

SEQ ID NO: 135073 - DNA, 22 bp, Artificial Sequence
  chemically synthesized
aaacatataattattattgttt

SEQ ID NO: 135074 - DNA, 22 bp, Artificial Sequence
  chemically synthesized
ttattgtttctataggttttta

SEQ ID NO: 135075 - DNA, 22 bp, Artificial Sequence
  chemically synthesized
ttgtttctataggtttttataa

SEQ ID NO: 135076 - DNA, 22 bp, Artificial Sequence
  chemically synthesized
tttctataggtttttataaaat

SEQ ID NO: 135077 - DNA, 22 bp, Artificial Sequence
  chemically synthesized
ctataggtttttataaaataaa

SEQ ID NO: 135078 - DNA, 22 bp, Artificial Sequence
  chemically synthesized
tataggtttttataaaataaaa

SEQ ID NO: 135079 - DNA, 22 bp, Artificial Sequence
  chemically synthesized
taggtttttataaaataaaaaa

SEQ ID NO: 135080 - DNA, 22 bp, Artificial Sequence
  chemically synthesized
ttataaaataaaaaaggtgcaa

SEQ ID NO: 135081 - DNA, 22 bp, Artificial Sequence
  chemically synthesized
tataaaataaaaaaggtgcaaa

SEQ ID NO: 135082 - DNA, 22 bp, Artificial Sequence
  chemically synthesized
ataaaataaaaaaggtgcaaag

SEQ ID NO: 135083 - DNA, 22 bp, Artificial Sequence
  chemically synthesized
taaaataaaaaaggtgcaaaga

SEQ ID NO: 135084 - DNA, 22 bp, Artificial Sequence
  chemically synthesized
ttatcacttcatttttactgaa

SEQ ID NO: 135085 - DNA, 22 bp, Artificial Sequence
  chemically synthesized
tcacttcatttttactgaatta

SEQ ID NO: 135086 - DNA, 22 bp, Artificial Sequence
  chemically synthesized
catttttactgaattacacttc

SEQ ID NO: 135087 - DNA, 22 bp, Artificial Sequence
  chemically synthesized
atttttactgaattacacttca

SEQ ID NO: 135088 - DNA, 22 bp, Artificial Sequence
  chemically synthesized
ttactgaattacacttcaaagg

SEQ ID NO: 135089 - DNA, 22 bp, Artificial Sequence
  chemically synthesized
tactgaattacacttcaaaggt

SEQ ID NO: 135090 - DNA, 22 bp, Artificial Sequence
  chemically synthesized
actgaattacacttcaaaggtg

SEQ ID NO: 135091 - DNA, 22 bp, Artificial Sequence
  chemically synthesized
ctgaattacacttcaaaggtgt

SEQ ID NO: 135092 - DNA, 22 bp, Artificial Sequence
  chemically synthesized
aattacacttcaaaggtgtcgg

SEQ ID NO: 135093 - DNA, 22 bp, Artificial Sequence
  chemically synthesized
cacttcaaaggtgtcggtagta

SEQ ID NO: 135094 - DNA, 22 bp, Artificial Sequence
  chemically synthesized
caaaggtgtcggtagtaatatt

SEQ ID NO: 135095 - DNA, 22 bp, Artificial Sequence
  chemically synthesized
aaaggtgtcggtagtaatattt

SEQ ID NO: 135096 - DNA, 22 bp, Artificial Sequence
  chemically synthesized
ataatattgaatgatattttaa

SEQ ID NO: 135097 - DNA, 22 bp, Artificial Sequence
  chemically synthesized
taatattgaatgatattttaaa

SEQ ID NO: 135098 - DNA, 22 bp, Artificial Sequence
  chemically synthesized
aatgatattttaaaagactctg

SEQ ID NO: 135099 - DNA, 22 bp, Artificial Sequence
  chemically synthesized
taaaagactctggacacataca

SEQ ID NO: 135100 - DNA, 22 bp, Artificial Sequence
  chemically synthesized
aaaagactctggacacatacag

SEQ ID NO: 135101 - DNA, 22 bp, Artificial Sequence
  chemically synthesized
aaagactctggacacatacaga

SEQ ID NO: 135102 - DNA, 22 bp, Artificial Sequence
  chemically synthesized
tggacacatacagaatcaattg

SEQ ID NO: 135103 - DNA, 22 bp, Artificial Sequence
  chemically synthesized
gacacatacagaatcaattgaa

SEQ ID NO: 135104 - DNA, 22 bp, Artificial Sequence
  chemically synthesized
aatttgggagaaactgagtttc

SEQ ID NO: 135105 - DNA, 22 bp, Artificial Sequence
  chemically synthesized
gggagaaactgagtttcccttg

SEQ ID NO: 135106 - DNA, 22 bp, Artificial Sequence
  chemically synthesized
ggagaaactgagtttcccttgt

SEQ ID NO: 135107 - DNA, 22 bp, Artificial Sequence
  chemically synthesized
agtttcccttgtagttctcttt

SEQ ID NO: 135108 - DNA, 22 bp, Artificial Sequence
  chemically synthesized
cccttgtagttctctttgtttt

SEQ ID NO: 135109 - DNA, 22 bp, Artificial Sequence
  chemically synthesized
ccttgtagttctctttgttttc

SEQ ID NO: 135110 - DNA, 22 bp, Artificial Sequence
  chemically synthesized
gtagttctctttgttttcccaa

SEQ ID NO: 135111 - DNA, 22 bp, Artificial Sequence
  chemically synthesized
tagttctctttgttttcccaat

SEQ ID NO: 135112 - DNA, 22 bp, Artificial Sequence
  chemically synthesized
tctttgttttcccaataaacct

SEQ ID NO: 135113 - DNA, 22 bp, Artificial Sequence
  chemically synthesized
tttgttttcccaataaacctgc

SEQ ID NO: 135114 - DNA, 22 bp, Artificial Sequence
  chemically synthesized
tgttttcccaataaacctgcta

SEQ ID NO: 135115 - DNA, 22 bp, Artificial Sequence
  chemically synthesized
gttttcccaataaacctgctac

SEQ ID NO: 135116 - DNA, 22 bp, Artificial Sequence
  chemically synthesized
ttttcccaataaacctgctaca

SEQ ID NO: 135117 - DNA, 22 bp, Artificial Sequence
  chemically synthesized
tcccaataaacctgctacaaaa

SEQ ID NO: 135118 - DNA, 22 bp, Artificial Sequence
  chemically synthesized
cccaataaacctgctacaaaat

SEQ ID NO: 135119 - DNA, 22 bp, Artificial Sequence
  chemically synthesized
ccaataaacctgctacaaaatt

SEQ ID NO: 135120 - DNA, 22 bp, Artificial Sequence
  chemically synthesized
ctacaaaatttcttggtatcac

SEQ ID NO: 135121 - DNA, 22 bp, Artificial Sequence
  chemically synthesized
caaaatttcttggtatcacaac

SEQ ID NO: 135122 - DNA, 22 bp, Artificial Sequence
  chemically synthesized
cttggtatcacaacaacaaaaa

SEQ ID NO: 135123 - DNA, 22 bp, Artificial Sequence
  chemically synthesized
ttggtatcacaacaacaaaaat

SEQ ID NO: 135124 - DNA, 22 bp, Artificial Sequence
  chemically synthesized
ggtatcacaacaacaaaaatct

SEQ ID NO: 135125 - DNA, 22 bp, Artificial Sequence
  chemically synthesized
gtatcacaacaacaaaaatctt

SEQ ID NO: 135126 - DNA, 22 bp, Artificial Sequence
  chemically synthesized
gactttgtaaaagtgtaattat

SEQ ID NO: 135127 - DNA, 22 bp, Artificial Sequence
  chemically synthesized
actttgtaaaagtgtaattata

SEQ ID NO: 135128 - DNA, 22 bp, Artificial Sequence
  chemically synthesized
tgtaaaagtgtaattataaata

SEQ ID NO: 135129 - DNA, 22 bp, Artificial Sequence
  chemically synthesized
gtaaaagtgtaattataaatat

SEQ ID NO: 135130 - DNA, 22 bp, Artificial Sequence
  chemically synthesized
taaaagtgtaattataaatata

SEQ ID NO: 135131 - DNA, 22 bp, Artificial Sequence
  chemically synthesized
taaatataaataaatattaatt

SEQ ID NO: 135132 - DNA, 22 bp, Artificial Sequence
  chemically synthesized
attataaatagacttcatagtt

SEQ ID NO: 135133 - DNA, 22 bp, Artificial Sequence
  chemically synthesized
taaatagacttcatagttccct

SEQ ID NO: 135134 - DNA, 22 bp, Artificial Sequence
  chemically synthesized
catagttccctatgaggatcct

SEQ ID NO: 135135 - DNA, 22 bp, Artificial Sequence
  chemically synthesized
atagttccctatgaggatcctt

SEQ ID NO: 135136 - DNA, 22 bp, Artificial Sequence
  chemically synthesized
cctatgaggatccttgtgaatt

SEQ ID NO: 135137 - DNA, 22 bp, Artificial Sequence
  chemically synthesized
tgaggatccttgtgaatttttc

SEQ ID NO: 135138 - DNA, 22 bp, Artificial Sequence
  chemically synthesized
gtgaatttttctcaatacgagt

SEQ ID NO: 135139 - DNA, 22 bp, Artificial Sequence
  chemically synthesized
tgaatttttctcaatacgagtc

SEQ ID NO: 135140 - DNA, 22 bp, Artificial Sequence
  chemically synthesized
ttctcaatacgagtcttacaga

SEQ ID NO: 135141 - DNA, 22 bp, Artificial Sequence
  chemically synthesized
tctcaatacgagtcttacagat

SEQ ID NO: 135142 - DNA, 22 bp, Artificial Sequence
  chemically synthesized
ctcaatacgagtcttacagatt

SEQ ID NO: 135143 - DNA, 22 bp, Artificial Sequence
  chemically synthesized
tcaatacgagtcttacagattc

SEQ ID NO: 135144 - DNA, 22 bp, Artificial Sequence
  chemically synthesized
aatacgagtcttacagattcat

SEQ ID NO: 135145 - DNA, 22 bp, Artificial Sequence
  chemically synthesized
acagattcataatgattagagg

SEQ ID NO: 135146 - DNA, 22 bp, Artificial Sequence
  chemically synthesized
cagattcataatgattagaggg

SEQ ID NO: 135147 - DNA, 22 bp, Artificial Sequence
  chemically synthesized
ataatgattagagggtctgtaa

SEQ ID NO: 135148 - DNA, 22 bp, Artificial Sequence
  chemically synthesized
gagggtctgtaagattgtctcc

SEQ ID NO: 135149 - DNA, 22 bp, Artificial Sequence
  chemically synthesized
taagattgtctccatcagcaac

SEQ ID NO: 135150 - DNA, 22 bp, Artificial Sequence
  chemically synthesized
tctccatcagcaacatagttgc

SEQ ID NO: 135151 - DNA, 22 bp, Artificial Sequence
  chemically synthesized
catcagcaacatagttgccgta

SEQ ID NO: 135152 - DNA, 22 bp, Artificial Sequence
  chemically synthesized
ccgtattttctctctgggagtg

SEQ ID NO: 135153 - DNA, 22 bp, Artificial Sequence
  chemically synthesized
tctctctgggagtgcttatctt

SEQ ID NO: 135154 - DNA, 22 bp, Artificial Sequence
  chemically synthesized
ctctctgggagtgcttatcttt

SEQ ID NO: 135155 - DNA, 22 bp, Artificial Sequence
  chemically synthesized
tctctgggagtgcttatctttt

SEQ ID NO: 135156 - DNA, 22 bp, Artificial Sequence
  chemically synthesized
tctgggagtgcttatcttttcc

SEQ ID NO: 135157 - DNA, 22 bp, Artificial Sequence
  chemically synthesized
tgggagtgcttatcttttccct

SEQ ID NO: 135158 - DNA, 22 bp, Artificial Sequence
  chemically synthesized
ggagtgcttatcttttccctag

SEQ ID NO: 135159 - DNA, 22 bp, Artificial Sequence
  chemically synthesized
atcttttccctagaactggttg

SEQ ID NO: 135160 - DNA, 22 bp, Artificial Sequence
  chemically synthesized
tcttttccctagaactggttgt

SEQ ID NO: 135161 - DNA, 22 bp, Artificial Sequence
  chemically synthesized
ttccctagaactggttgtgtga

SEQ ID NO: 135162 - DNA, 22 bp, Artificial Sequence
  chemically synthesized
tccctagaactggttgtgtgaa

SEQ ID NO: 135163 - DNA, 22 bp, Artificial Sequence
  chemically synthesized
ccctagaactggttgtgtgaag

SEQ ID NO: 135164 - DNA, 22 bp, Artificial Sequence
  chemically synthesized
cctagaactggttgtgtgaagt

SEQ ID NO: 135165 - DNA, 22 bp, Artificial Sequence
  chemically synthesized
gaactggttgtgtgaagtttat

SEQ ID NO: 135166 - DNA, 22 bp, Artificial Sequence
  chemically synthesized
gttgtgtgaagtttattaactc

SEQ ID NO: 135167 - DNA, 22 bp, Artificial Sequence
  chemically synthesized
tgtgaagtttattaactcaatt

SEQ ID NO: 135168 - DNA, 22 bp, Artificial Sequence
  chemically synthesized
attaactcaattaccaacttcc

SEQ ID NO: 135169 - DNA, 22 bp, Artificial Sequence
  chemically synthesized
ttaactcaattaccaacttccg

SEQ ID NO: 135170 - DNA, 22 bp, Artificial Sequence
  chemically synthesized
actcaattaccaacttccgata

SEQ ID NO: 135171 - DNA, 22 bp, Artificial Sequence
  chemically synthesized
aattaccaacttccgatattac

SEQ ID NO: 135172 - DNA, 22 bp, Artificial Sequence
  chemically synthesized
ccaacttccgatattactattg

SEQ ID NO: 135173 - DNA, 22 bp, Artificial Sequence
  chemically synthesized
ccgatattactattgcccttca

SEQ ID NO: 135174 - DNA, 22 bp, Artificial Sequence
  chemically synthesized
cgatattactattgcccttcag

SEQ ID NO: 135175 - DNA, 22 bp, Artificial Sequence
  chemically synthesized
ctattgcccttcagatcaacat

SEQ ID NO: 135176 - DNA, 22 bp, Artificial Sequence
  chemically synthesized
ttgcccttcagatcaacatact

SEQ ID NO: 135177 - DNA, 22 bp, Artificial Sequence
  chemically synthesized
cccttcagatcaacatacttac

SEQ ID NO: 135178 - DNA, 22 bp, Artificial Sequence
  chemically synthesized
cagatcaacatacttacgaatc

SEQ ID NO: 135179 - DNA, 22 bp, Artificial Sequence
  chemically synthesized
agatcaacatacttacgaatct

SEQ ID NO: 135180 - DNA, 22 bp, Artificial Sequence
  chemically synthesized
acgaatctatgactctaacaag

SEQ ID NO: 135181 - DNA, 22 bp, Artificial Sequence
  chemically synthesized
cgaatctatgactctaacaagt

SEQ ID NO: 135182 - DNA, 22 bp, Artificial Sequence
  chemically synthesized
tgactctaacaagtattaggct

SEQ ID NO: 135183 - DNA, 22 bp, Artificial Sequence
  chemically synthesized
taacaagtattaggcttttgtg

SEQ ID NO: 135184 - DNA, 22 bp, Artificial Sequence
  chemically synthesized
acaagtattaggcttttgtgga

SEQ ID NO: 135185 - DNA, 22 bp, Artificial Sequence
  chemically synthesized
ggcttttgtggaggccctcatt

SEQ ID NO: 135186 - DNA, 22 bp, Artificial Sequence
  chemically synthesized
ttgtggaggccctcattgtaga

SEQ ID NO: 135187 - DNA, 22 bp, Artificial Sequence
  chemically synthesized
tgtggaggccctcattgtagaa

SEQ ID NO: 135188 - DNA, 22 bp, Artificial Sequence
  chemically synthesized
gtggaggccctcattgtagaag

SEQ ID NO: 135189 - DNA, 22 bp, Artificial Sequence
  chemically synthesized
tggaggccctcattgtagaagt

SEQ ID NO: 135190 - DNA, 22 bp, Artificial Sequence
  chemically synthesized
attgtagaagtatgtccttaaa

SEQ ID NO: 135191 - DNA, 22 bp, Artificial Sequence
  chemically synthesized
tagaagtatgtccttaaaatat

SEQ ID NO: 135192 - DNA, 22 bp, Artificial Sequence
  chemically synthesized
aaaatatttccgttatgagctt

SEQ ID NO: 135193 - DNA, 22 bp, Artificial Sequence
  chemically synthesized
aaatatttccgttatgagcttc

SEQ ID NO: 135194 - DNA, 22 bp, Artificial Sequence
  chemically synthesized
ccgttatgagcttccaacatga

SEQ ID NO: 135195 - DNA, 22 bp, Artificial Sequence
  chemically synthesized
cgttatgagcttccaacatgag

SEQ ID NO: 135196 - DNA, 22 bp, Artificial Sequence
  chemically synthesized
tgagcttccaacatgagtctcc

SEQ ID NO: 135197 - DNA, 22 bp, Artificial Sequence
  chemically synthesized
ccaacatgagtctcctattttc

SEQ ID NO: 135198 - DNA, 22 bp, Artificial Sequence
  chemically synthesized
caacatgagtctcctattttca

SEQ ID NO: 135199 - DNA, 22 bp, Artificial Sequence
  chemically synthesized
ctattttcatgtttgtccctaa

SEQ ID NO: 135200 - DNA, 22 bp, Artificial Sequence
  chemically synthesized
ttttcatgtttgtccctaatgt

SEQ ID NO: 135201 - DNA, 22 bp, Artificial Sequence
  chemically synthesized
tcatgtttgtccctaatgtgcc

SEQ ID NO: 135202 - DNA, 22 bp, Artificial Sequence
  chemically synthesized
catgtttgtccctaatgtgcca

SEQ ID NO: 135203 - DNA, 22 bp, Artificial Sequence
  chemically synthesized
atgtttgtccctaatgtgccaa

SEQ ID NO: 135204 - DNA, 22 bp, Artificial Sequence
  chemically synthesized
gtccctaatgtgccaaaactca

SEQ ID NO: 135205 - DNA, 22 bp, Artificial Sequence
  chemically synthesized
tccctaatgtgccaaaactcag

SEQ ID NO: 135206 - DNA, 22 bp, Artificial Sequence
  chemically synthesized
atgtgccaaaactcagactttt

SEQ ID NO: 135207 - DNA, 22 bp, Artificial Sequence
  chemically synthesized
agactttttgcagcatagggaa

SEQ ID NO: 135208 - DNA, 22 bp, Artificial Sequence
  chemically synthesized
tttgcagcatagggaacttgct

SEQ ID NO: 135209 - DNA, 22 bp, Artificial Sequence
  chemically synthesized
ttgcagcatagggaacttgctg

SEQ ID NO: 135210 - DNA, 22 bp, Artificial Sequence
  chemically synthesized
tgcagcatagggaacttgctga

SEQ ID NO: 135211 - DNA, 22 bp, Artificial Sequence
  chemically synthesized
gcagcatagggaacttgctgag

SEQ ID NO: 135212 - DNA, 22 bp, Artificial Sequence
  chemically synthesized
cagcatagggaacttgctgagt

SEQ ID NO: 135213 - DNA, 22 bp, Artificial Sequence
  chemically synthesized
gctgagtcccaagtccactgag

SEQ ID NO: 135214 - DNA, 22 bp, Artificial Sequence
  chemically synthesized
ctgagtcccaagtccactgagt

SEQ ID NO: 135215 - DNA, 22 bp, Artificial Sequence
  chemically synthesized
agtcccaagtccactgagtaat

SEQ ID NO: 135216 - DNA, 22 bp, Artificial Sequence
  chemically synthesized
agtaattacacctttctaaaat

SEQ ID NO: 135217 - DNA, 22 bp, Artificial Sequence
  chemically synthesized
cacctttctaaaatgagtttac

SEQ ID NO: 135218 - DNA, 22 bp, Artificial Sequence
  chemically synthesized
tctaaaatgagtttactaactt

SEQ ID NO: 135219 - DNA, 22 bp, Artificial Sequence
  chemically synthesized
ctaaaatgagtttactaacttt

SEQ ID NO: 135220 - DNA, 22 bp, Artificial Sequence
  chemically synthesized
taaaatgagtttactaacttta

SEQ ID NO: 135221 - DNA, 22 bp, Artificial Sequence
  chemically synthesized
aaatgagtttactaactttacc

SEQ ID NO: 135222 - DNA, 22 bp, Artificial Sequence
  chemically synthesized
actaactttacccacttgttca

SEQ ID NO: 135223 - DNA, 22 bp, Artificial Sequence
  chemically synthesized
ctaactttacccacttgttcag

SEQ ID NO: 135224 - DNA, 22 bp, Artificial Sequence
  chemically synthesized
actttacccacttgttcaggtg

SEQ ID NO: 135225 - DNA, 22 bp, Artificial Sequence
  chemically synthesized
tacccacttgttcaggtgttca

SEQ ID NO: 135226 - DNA, 22 bp, Artificial Sequence
  chemically synthesized
acccacttgttcaggtgttcag

SEQ ID NO: 135227 - DNA, 22 bp, Artificial Sequence
  chemically synthesized
cccacttgttcaggtgttcaga

SEQ ID NO: 135228 - DNA, 22 bp, Artificial Sequence
  chemically synthesized
gttcaggtgttcagatttctgt

SEQ ID NO: 135229 - DNA, 22 bp, Artificial Sequence
  chemically synthesized
ttcaggtgttcagatttctgtg

SEQ ID NO: 135230 - DNA, 22 bp, Artificial Sequence
  chemically synthesized
aggtgttcagatttctgtggaa

SEQ ID NO: 135231 - DNA, 22 bp, Artificial Sequence
  chemically synthesized
agatttctgtggaaactcacaa

SEQ ID NO: 135232 - DNA, 22 bp, Artificial Sequence
  chemically synthesized
ctgtggaaactcacaatagatg

SEQ ID NO: 135233 - DNA, 22 bp, Artificial Sequence
  chemically synthesized
tgtggaaactcacaatagatga

SEQ ID NO: 135234 - DNA, 22 bp, Artificial Sequence
  chemically synthesized
tggaaactcacaatagatgagt

SEQ ID NO: 135235 - DNA, 22 bp, Artificial Sequence
  chemically synthesized
acaatagatgagttattttctt

SEQ ID NO: 135236 - DNA, 22 bp, Artificial Sequence
  chemically synthesized
ttttctttcgttttattttatt

SEQ ID NO: 135237 - DNA, 22 bp, Artificial Sequence
  chemically synthesized
tctttcgttttattttatttta

SEQ ID NO: 135238 - DNA, 22 bp, Artificial Sequence
  chemically synthesized
ctttcgttttattttattttat

SEQ ID NO: 135239 - DNA, 22 bp, Artificial Sequence
  chemically synthesized
tttcgttttattttattttatt

SEQ ID NO: 135240 - DNA, 22 bp, Artificial Sequence
  chemically synthesized
tcgttttattttattttatttt

SEQ ID NO: 135241 - DNA, 22 bp, Artificial Sequence
  chemically synthesized
cgttttattttattttattttt

SEQ ID NO: 135242 - DNA, 22 bp, Artificial Sequence
  chemically synthesized
gttttattttattttatttttt

SEQ ID NO: 135243 - DNA, 22 bp, Artificial Sequence
  chemically synthesized
tattttattttattttttatag

SEQ ID NO: 135244 - DNA, 22 bp, Artificial Sequence
  chemically synthesized
attttattttattttttataga

SEQ ID NO: 135245 - DNA, 22 bp, Artificial Sequence
  chemically synthesized
ttttattttattttttatagag

SEQ ID NO: 135246 - DNA, 22 bp, Artificial Sequence
  chemically synthesized
tattttattttttatagagaca

SEQ ID NO: 135247 - DNA, 22 bp, Artificial Sequence
  chemically synthesized
attttattttttatagagacag

SEQ ID NO: 135248 - DNA, 22 bp, Artificial Sequence
  chemically synthesized
ttttattttttatagagacaga

SEQ ID NO: 135249 - DNA, 22 bp, Artificial Sequence
  chemically synthesized
tattttttatagagacagagtc

SEQ ID NO: 135250 - DNA, 22 bp, Artificial Sequence
  chemically synthesized
attttttatagagacagagtct

SEQ ID NO: 135251 - DNA, 22 bp, Artificial Sequence
  chemically synthesized
ttttttatagagacagagtctg

SEQ ID NO: 135252 - DNA, 22 bp, Artificial Sequence
  chemically synthesized
tttatagagacagagtctgact

SEQ ID NO: 135253 - DNA, 22 bp, Artificial Sequence
  chemically synthesized
ttatagagacagagtctgactc

SEQ ID NO: 135254 - DNA, 22 bp, Artificial Sequence
  chemically synthesized
tatagagacagagtctgactcc

SEQ ID NO: 135255 - DNA, 22 bp, Artificial Sequence
  chemically synthesized
atagagacagagtctgactccg

SEQ ID NO: 135256 - DNA, 22 bp, Artificial Sequence
  chemically synthesized
tagagacagagtctgactccgt

SEQ ID NO: 135257 - DNA, 22 bp, Artificial Sequence
  chemically synthesized
actccgttgcccaggctggaga

SEQ ID NO: 135258 - DNA, 22 bp, Artificial Sequence
  chemically synthesized
cgttgcccaggctggagagcag

SEQ ID NO: 135259 - DNA, 22 bp, Artificial Sequence
  chemically synthesized
cccaggctggagagcagtgctg

SEQ ID NO: 135260 - DNA, 22 bp, Artificial Sequence
  chemically synthesized
gagagcagtgctgcaatcatag

SEQ ID NO: 135261 - DNA, 22 bp, Artificial Sequence
  chemically synthesized
caatcatagctccctgcagcct

SEQ ID NO: 135262 - DNA, 22 bp, Artificial Sequence
  chemically synthesized
cctgcagcctcacagtcctggg

SEQ ID NO: 135263 - DNA, 22 bp, Artificial Sequence
  chemically synthesized
cagcctcacagtcctgggctca

SEQ ID NO: 135264 - DNA, 22 bp, Artificial Sequence
  chemically synthesized
acagtcctgggctcaggtgatg

SEQ ID NO: 135265 - DNA, 22 bp, Artificial Sequence
  chemically synthesized
ggctcaggtgatgtgtgcccct

SEQ ID NO: 135266 - DNA, 22 bp, Artificial Sequence
  chemically synthesized
aggtgatgtgtgcccctgtgcc

SEQ ID NO: 135267 - DNA, 22 bp, Artificial Sequence
  chemically synthesized
tgcccagctaatttttatcttt

SEQ ID NO: 135268 - DNA, 22 bp, Artificial Sequence
  chemically synthesized
atttttatcttttctttttttt

SEQ ID NO: 135269 - DNA, 22 bp, Artificial Sequence
  chemically synthesized
ttatcttttcttttttttttgg

SEQ ID NO: 135270 - DNA, 22 bp, Artificial Sequence
  chemically synthesized
tatcttttcttttttttttggt

SEQ ID NO: 135271 - DNA, 22 bp, Artificial Sequence
  chemically synthesized
atcttttcttttttttttggtg

SEQ ID NO: 135272 - DNA, 22 bp, Artificial Sequence
  chemically synthesized
tcttttcttttttttttggtgg

SEQ ID NO: 135273 - DNA, 22 bp, Artificial Sequence
  chemically synthesized
ttcttttttttttggtggaggc

SEQ ID NO: 135274 - DNA, 22 bp, Artificial Sequence
  chemically synthesized
tcttttttttttggtggaggca

SEQ ID NO: 135275 - DNA, 22 bp, Artificial Sequence
  chemically synthesized
cttttttttttggtggaggcag

SEQ ID NO: 135276 - DNA, 22 bp, Artificial Sequence
  chemically synthesized
ttttttttttggtggaggcagg

SEQ ID NO: 135277 - DNA, 22 bp, Artificial Sequence
  chemically synthesized
ttttttttggtggaggcagggt

SEQ ID NO: 135278 - DNA, 22 bp, Artificial Sequence
  chemically synthesized
tttttttggtggaggcagggtc

SEQ ID NO: 135279 - DNA, 22 bp, Artificial Sequence
  chemically synthesized
ttttttggtggaggcagggtct

SEQ ID NO: 135280 - DNA, 22 bp, Artificial Sequence
  chemically synthesized
tttttggtggaggcagggtcta

SEQ ID NO: 135281 - DNA, 22 bp, Artificial Sequence
  chemically synthesized
ttttggtggaggcagggtctag

SEQ ID NO: 135282 - DNA, 22 bp, Artificial Sequence
  chemically synthesized
tttggtggaggcagggtctagc

SEQ ID NO: 135283 - DNA, 22 bp, Artificial Sequence
  chemically synthesized
ttggtggaggcagggtctagct

SEQ ID NO: 135284 - DNA, 22 bp, Artificial Sequence
  chemically synthesized
tggtggaggcagggtctagcta

SEQ ID NO: 135285 - DNA, 22 bp, Artificial Sequence
  chemically synthesized
ggtggaggcagggtctagctat

SEQ ID NO: 135286 - DNA, 22 bp, Artificial Sequence
  chemically synthesized
gtggaggcagggtctagctatg

SEQ ID NO: 135287 - DNA, 22 bp, Artificial Sequence
  chemically synthesized
gctatgttgcccaggctgggtt

SEQ ID NO: 135288 - DNA, 22 bp, Artificial Sequence
  chemically synthesized
tgttgcccaggctgggttctct

SEQ ID NO: 135289 - DNA, 22 bp, Artificial Sequence
  chemically synthesized
cccaggctgggttctcttctta

SEQ ID NO: 135290 - DNA, 22 bp, Artificial Sequence
  chemically synthesized
ggttctcttcttattcacagtc

SEQ ID NO: 135291 - DNA, 22 bp, Artificial Sequence
  chemically synthesized
tcttcttattcacagtccactt

SEQ ID NO: 135292 - DNA, 22 bp, Artificial Sequence
  chemically synthesized
ttcttattcacagtccacttga

SEQ ID NO: 135293 - DNA, 22 bp, Artificial Sequence
  chemically synthesized
cttattcacagtccacttgaga

SEQ ID NO: 135294 - DNA, 22 bp, Artificial Sequence
  chemically synthesized
ttattcacagtccacttgagat

SEQ ID NO: 135295 - DNA, 22 bp, Artificial Sequence
  chemically synthesized
attcacagtccacttgagatag

SEQ ID NO: 135296 - DNA, 22 bp, Artificial Sequence
  chemically synthesized
ttcacagtccacttgagatagc

SEQ ID NO: 135297 - DNA, 22 bp, Artificial Sequence
  chemically synthesized
acagtccacttgagatagcaac

SEQ ID NO: 135298 - DNA, 22 bp, Artificial Sequence
  chemically synthesized
gagatagcaacattgatcacaa

SEQ ID NO: 135299 - DNA, 22 bp, Artificial Sequence
  chemically synthesized
agatagcaacattgatcacaat

SEQ ID NO: 135300 - DNA, 22 bp, Artificial Sequence
  chemically synthesized
atcacaatatttctcagtcatt

SEQ ID NO: 135301 - DNA, 22 bp, Artificial Sequence
  chemically synthesized
ctcagtcatttctattgaataa

SEQ ID NO: 135302 - DNA, 22 bp, Artificial Sequence
  chemically synthesized
tcagtcatttctattgaataag

SEQ ID NO: 135303 - DNA, 22 bp, Artificial Sequence
  chemically synthesized
agtcatttctattgaataagca

SEQ ID NO: 135304 - DNA, 22 bp, Artificial Sequence
  chemically synthesized
ctattgaataagcattttcctc

SEQ ID NO: 135305 - DNA, 22 bp, Artificial Sequence
  chemically synthesized
tattgaataagcattttcctca

SEQ ID NO: 135306 - DNA, 22 bp, Artificial Sequence
  chemically synthesized
ttgaataagcattttcctcagt

SEQ ID NO: 135307 - DNA, 22 bp, Artificial Sequence
  chemically synthesized
aataagcattttcctcagtggt

SEQ ID NO: 135308 - DNA, 22 bp, Artificial Sequence
  chemically synthesized
tcctcagtggttaatcctaaat

SEQ ID NO: 135309 - DNA, 22 bp, Artificial Sequence
  chemically synthesized
cctcagtggttaatcctaaata

SEQ ID NO: 135310 - DNA, 22 bp, Artificial Sequence
  chemically synthesized
ctcagtggttaatcctaaatac

SEQ ID NO: 135311 - DNA, 22 bp, Artificial Sequence
  chemically synthesized
agtggttaatcctaaatacagc

SEQ ID NO: 135312 - DNA, 22 bp, Artificial Sequence
  chemically synthesized
atcctaaatacagctgtcccat

SEQ ID NO: 135313 - DNA, 22 bp, Artificial Sequence
  chemically synthesized
aatacagctgtcccattagttt

SEQ ID NO: 135314 - DNA, 22 bp, Artificial Sequence
  chemically synthesized
tcccattagtttcaagagaaaa

SEQ ID NO: 135315 - DNA, 22 bp, Artificial Sequence
  chemically synthesized
gtttcaagagaaaaaatttgaa

SEQ ID NO: 135316 - DNA, 22 bp, Artificial Sequence
  chemically synthesized
caagagaaaaaatttgaactga

SEQ ID NO: 135317 - DNA, 22 bp, Artificial Sequence
  chemically synthesized
aagagaaaaaatttgaactgac

SEQ ID NO: 135318 - DNA, 22 bp, Artificial Sequence
  chemically synthesized
gaactgactcaacttggatagt

SEQ ID NO: 135319 - DNA, 22 bp, Artificial Sequence
  chemically synthesized
aactgactcaacttggatagta

SEQ ID NO: 135320 - DNA, 22 bp, Artificial Sequence
  chemically synthesized
actcaacttggatagtaacaca

SEQ ID NO: 135321 - DNA, 22 bp, Artificial Sequence
  chemically synthesized
aacttggatagtaacacagtaa

SEQ ID NO: 135322 - DNA, 22 bp, Artificial Sequence
  chemically synthesized
ggatagtaacacagtaagggcc

SEQ ID NO: 135323 - DNA, 22 bp, Artificial Sequence
  chemically synthesized
gatagtaacacagtaagggccc

SEQ ID NO: 135324 - DNA, 22 bp, Artificial Sequence
  chemically synthesized
tttgggaccaagagtcaaggct

SEQ ID NO: 135325 - DNA, 22 bp, Artificial Sequence
  chemically synthesized
gggaccaagagtcaaggctatg

SEQ ID NO: 135326 - DNA, 22 bp, Artificial Sequence
  chemically synthesized
ggaccaagagtcaaggctatga

SEQ ID NO: 135327 - DNA, 22 bp, Artificial Sequence
  chemically synthesized
tgagcacagacgtaagatgagt

SEQ ID NO: 135328 - DNA, 22 bp, Artificial Sequence
  chemically synthesized
aaaaaataaaggttgtatgctt

SEQ ID NO: 135329 - DNA, 22 bp, Artificial Sequence
  chemically synthesized
tatgcttcatagtgaattggaa

SEQ ID NO: 135330 - DNA, 22 bp, Artificial Sequence
  chemically synthesized
catagtgaattggaattattat

SEQ ID NO: 135331 - DNA, 22 bp, Artificial Sequence
  chemically synthesized
atagtgaattggaattattatt

SEQ ID NO: 135332 - DNA, 22 bp, Artificial Sequence
  chemically synthesized
gaattattattctgaccatgat

SEQ ID NO: 135333 - DNA, 22 bp, Artificial Sequence
  chemically synthesized
ttattctgaccatgatttttgt

SEQ ID NO: 135334 - DNA, 22 bp, Artificial Sequence
  chemically synthesized
ttctgaccatgatttttgttat

SEQ ID NO: 135335 - DNA, 22 bp, Artificial Sequence
  chemically synthesized
tgaccatgatttttgttatttg

SEQ ID NO: 135336 - DNA, 22 bp, Artificial Sequence
  chemically synthesized
accatgatttttgttatttgtt

SEQ ID NO: 135337 - DNA, 22 bp, Artificial Sequence
  chemically synthesized
ttgttatttgttattctaggga

SEQ ID NO: 135338 - DNA, 22 bp, Artificial Sequence
  chemically synthesized
tgttatttgttattctagggaa

SEQ ID NO: 135339 - DNA, 22 bp, Artificial Sequence
  chemically synthesized
gttatttgttattctagggaaa

SEQ ID NO: 135340 - DNA, 22 bp, Artificial Sequence
  chemically synthesized
ttatttgttattctagggaaag

SEQ ID NO: 135341 - DNA, 22 bp, Artificial Sequence
  chemically synthesized
tttgttattctagggaaaggcc

SEQ ID NO: 135342 - DNA, 22 bp, Artificial Sequence
  chemically synthesized
gttattctagggaaaggccttg

SEQ ID NO: 135343 - DNA, 22 bp, Artificial Sequence
  chemically synthesized
ttattctagggaaaggccttgt

SEQ ID NO: 135344 - DNA, 22 bp, Artificial Sequence
  chemically synthesized
ttctagggaaaggccttgtgag

SEQ ID NO: 135345 - DNA, 22 bp, Artificial Sequence
  chemically synthesized
tagggaaaggccttgtgagtac

SEQ ID NO: 135346 - DNA, 22 bp, Artificial Sequence
  chemically synthesized
gggaaaggccttgtgagtacag

SEQ ID NO: 135347 - DNA, 22 bp, Artificial Sequence
  chemically synthesized
gtgagtacaggcttacaattaa

SEQ ID NO: 135348 - DNA, 22 bp, Artificial Sequence
  chemically synthesized
tgagtacaggcttacaattaat

SEQ ID NO: 135349 - DNA, 22 bp, Artificial Sequence
  chemically synthesized
acaattaattaagtatgagaca

SEQ ID NO: 135350 - DNA, 22 bp, Artificial Sequence
  chemically synthesized
caattaattaagtatgagacaa

SEQ ID NO: 135351 - DNA, 22 bp, Artificial Sequence
  chemically synthesized
attaagtatgagacaatccaga

SEQ ID NO: 135352 - DNA, 22 bp, Artificial Sequence
  chemically synthesized
agtatgagacaatccagaaaaa

SEQ ID NO: 135353 - DNA, 22 bp, Artificial Sequence
  chemically synthesized
aagttttgaggtaaaaaatggc

SEQ ID NO: 135354 - DNA, 22 bp, Artificial Sequence
  chemically synthesized
agttttgaggtaaaaaatggcc

SEQ ID NO: 135355 - DNA, 22 bp, Artificial Sequence
  chemically synthesized
tgaggtaaaaaatggcctgatg

SEQ ID NO: 135356 - DNA, 22 bp, Artificial Sequence
  chemically synthesized
gaggtaaaaaatggcctgatga

SEQ ID NO: 135357 - DNA, 22 bp, Artificial Sequence
  chemically synthesized
aggtaaaaaatggcctgatgat

SEQ ID NO: 135358 - DNA, 22 bp, Artificial Sequence
  chemically synthesized
atgatgtgctacaagaagattg

SEQ ID NO: 135359 - DNA, 22 bp, Artificial Sequence
  chemically synthesized
caagaagattgtgagagaaaaa

SEQ ID NO: 135360 - DNA, 22 bp, Artificial Sequence
  chemically synthesized
tgagagaaaaaagaaaactgca

SEQ ID NO: 135361 - DNA, 22 bp, Artificial Sequence
  chemically synthesized
catctttggaggtcatcacccc

SEQ ID NO: 135362 - DNA, 22 bp, Artificial Sequence
  chemically synthesized
tggaggtcatcacccctaaaaa

SEQ ID NO: 135363 - DNA, 22 bp, Artificial Sequence
  chemically synthesized
ggaggtcatcacccctaaaaaa

SEQ ID NO: 135364 - DNA, 22 bp, Artificial Sequence
  chemically synthesized
gaggtcatcacccctaaaaaat

SEQ ID NO: 135365 - DNA, 22 bp, Artificial Sequence
  chemically synthesized
aaaaatatcttctccacctgca

SEQ ID NO: 135366 - DNA, 22 bp, Artificial Sequence
  chemically synthesized
ctccacctgcaaaacctaccat

SEQ ID NO: 135367 - DNA, 22 bp, Artificial Sequence
  chemically synthesized
tccacctgcaaaacctaccatg

SEQ ID NO: 135368 - DNA, 22 bp, Artificial Sequence
  chemically synthesized
cacctgcaaaacctaccatgtg

SEQ ID NO: 135369 - DNA, 22 bp, Artificial Sequence
  chemically synthesized
caaaacctaccatgtggtataa

SEQ ID NO: 135370 - DNA, 22 bp, Artificial Sequence
  chemically synthesized
ccatgtggtataacaacagtgc

SEQ ID NO: 135371 - DNA, 22 bp, Artificial Sequence
  chemically synthesized
gccccttcttgctgactggctt

SEQ ID NO: 135372 - DNA, 22 bp, Artificial Sequence
  chemically synthesized
cttgctgactggcttcttgggc

SEQ ID NO: 135373 - DNA, 22 bp, Artificial Sequence
  chemically synthesized
ttgctgactggcttcttgggct

SEQ ID NO: 135374 - DNA, 22 bp, Artificial Sequence
  chemically synthesized
gctgactggcttcttgggctca

SEQ ID NO: 135375 - DNA, 22 bp, Artificial Sequence
  chemically synthesized
ctgactggcttcttgggctcag

SEQ ID NO: 135376 - DNA, 22 bp, Artificial Sequence
  chemically synthesized
actggcttcttgggctcagagg

SEQ ID NO: 135377 - DNA, 22 bp, Artificial Sequence
  chemically synthesized
gcttcttgggctcagaggcagt

SEQ ID NO: 135378 - DNA, 22 bp, Artificial Sequence
  chemically synthesized
cttgggctcagaggcagttcac

SEQ ID NO: 135379 - DNA, 22 bp, Artificial Sequence
  chemically synthesized
ttgggctcagaggcagttcact

SEQ ID NO: 135380 - DNA, 22 bp, Artificial Sequence
  chemically synthesized
gggctcagaggcagttcactac

SEQ ID NO: 135381 - DNA, 22 bp, Artificial Sequence
  chemically synthesized
ggctcagaggcagttcactacc

SEQ ID NO: 135382 - DNA, 22 bp, Artificial Sequence
  chemically synthesized
agaggcagttcactaccggatc

SEQ ID NO: 135383 - DNA, 22 bp, Artificial Sequence
  chemically synthesized
actaccggatctctatgtcctt

SEQ ID NO: 135384 - DNA, 22 bp, Artificial Sequence
  chemically synthesized
ccggatctctatgtccttcttt

SEQ ID NO: 135385 - DNA, 22 bp, Artificial Sequence
  chemically synthesized
tatgtccttctttgtcatctac

SEQ ID NO: 135386 - DNA, 22 bp, Artificial Sequence
  chemically synthesized
tgtccttctttgtcatctactt

SEQ ID NO: 135387 - DNA, 22 bp, Artificial Sequence
  chemically synthesized
ctttgtcatctacttctccgtc

SEQ ID NO: 135388 - DNA, 22 bp, Artificial Sequence
  chemically synthesized
tttgtcatctacttctccgtcc

SEQ ID NO: 135389 - DNA, 22 bp, Artificial Sequence
  chemically synthesized
tgtcatctacttctccgtcctt

SEQ ID NO: 135390 - DNA, 22 bp, Artificial Sequence
  chemically synthesized
gtcatctacttctccgtccttt

SEQ ID NO: 135391 - DNA, 22 bp, Artificial Sequence
  chemically synthesized
tcatctacttctccgtcctttt

SEQ ID NO: 135392 - DNA, 22 bp, Artificial Sequence
  chemically synthesized
cttctccgtcctttttggaaat

SEQ ID NO: 135393 - DNA, 22 bp, Artificial Sequence
  chemically synthesized
ctccgtcctttttggaaatggc

SEQ ID NO: 135394 - DNA, 22 bp, Artificial Sequence
  chemically synthesized
tccgtcctttttggaaatggca

SEQ ID NO: 135395 - DNA, 22 bp, Artificial Sequence
  chemically synthesized
cgtcctttttggaaatggcact

SEQ ID NO: 135396 - DNA, 22 bp, Artificial Sequence
  chemically synthesized
tttggaaatggcactcttcttg

SEQ ID NO: 135397 - DNA, 22 bp, Artificial Sequence
  chemically synthesized
ttggaaatggcactcttcttgt

SEQ ID NO: 135398 - DNA, 22 bp, Artificial Sequence
  chemically synthesized
tggaaatggcactcttcttgtc

SEQ ID NO: 135399 - DNA, 22 bp, Artificial Sequence
  chemically synthesized
ggaaatggcactcttcttgtcc

SEQ ID NO: 135400 - DNA, 22 bp, Artificial Sequence
  chemically synthesized
gaaatggcactcttcttgtcct

SEQ ID NO: 135401 - DNA, 22 bp, Artificial Sequence
  chemically synthesized
ttcttgtcctcatttggaatga

SEQ ID NO: 135402 - DNA, 22 bp, Artificial Sequence
  chemically synthesized
cttgtcctcatttggaatgatc

SEQ ID NO: 135403 - DNA, 22 bp, Artificial Sequence
  chemically synthesized
ttgtcctcatttggaatgatca

SEQ ID NO: 135404 - DNA, 22 bp, Artificial Sequence
  chemically synthesized
gtcctcatttggaatgatcaca

SEQ ID NO: 135405 - DNA, 22 bp, Artificial Sequence
  chemically synthesized
tcctcatttggaatgatcacag

SEQ ID NO: 135406 - DNA, 22 bp, Artificial Sequence
  chemically synthesized
atttggaatgatcacagcctcc

SEQ ID NO: 135407 - DNA, 22 bp, Artificial Sequence
  chemically synthesized
ggaatgatcacagcctccatga

SEQ ID NO: 135408 - DNA, 22 bp, Artificial Sequence
  chemically synthesized
gaatgatcacagcctccatgag

SEQ ID NO: 135409 - DNA, 22 bp, Artificial Sequence
  chemically synthesized
catgagcccatgtactacttcc

SEQ ID NO: 135410 - DNA, 22 bp, Artificial Sequence
  chemically synthesized
cttcctggctatgctggcagac

SEQ ID NO: 135411 - DNA, 22 bp, Artificial Sequence
  chemically synthesized
cctggctatgctggcagacacg

SEQ ID NO: 135412 - DNA, 22 bp, Artificial Sequence
  chemically synthesized
ctggctatgctggcagacacgg

SEQ ID NO: 135413 - DNA, 22 bp, Artificial Sequence
  chemically synthesized
gctatgctggcagacacggacc

SEQ ID NO: 135414 - DNA, 22 bp, Artificial Sequence
  chemically synthesized
tgctggcagacacggaccttgg

SEQ ID NO: 135415 - DNA, 22 bp, Artificial Sequence
  chemically synthesized
gcagacacggaccttgggatga

SEQ ID NO: 135416 - DNA, 22 bp, Artificial Sequence
  chemically synthesized
gggatgacattcactacaatgc

SEQ ID NO: 135417 - DNA, 22 bp, Artificial Sequence
  chemically synthesized
ggatgacattcactacaatgcc

SEQ ID NO: 135418 - DNA, 22 bp, Artificial Sequence
  chemically synthesized
actacaatgcccacagtcctgg

SEQ ID NO: 135419 - DNA, 22 bp, Artificial Sequence
  chemically synthesized
caatgcccacagtcctgggtgt

SEQ ID NO: 135420 - DNA, 22 bp, Artificial Sequence
  chemically synthesized
ggtgtcctgctgctagaccaga

SEQ ID NO: 135421 - DNA, 22 bp, Artificial Sequence
  chemically synthesized
ctgctagaccagagggagattg

SEQ ID NO: 135422 - DNA, 22 bp, Artificial Sequence
  chemically synthesized
ctagaccagagggagattgccc

SEQ ID NO: 135423 - DNA, 22 bp, Artificial Sequence
  chemically synthesized
gaccagagggagattgcccatg

SEQ ID NO: 135424 - DNA, 22 bp, Artificial Sequence
  chemically synthesized
cccatgctgcctgtttcaccca

SEQ ID NO: 135425 - DNA, 22 bp, Artificial Sequence
  chemically synthesized
cctgtttcacccaatccttcat

SEQ ID NO: 135426 - DNA, 22 bp, Artificial Sequence
  chemically synthesized
tttcacccaatccttcattcat

SEQ ID NO: 135427 - DNA, 22 bp, Artificial Sequence
  chemically synthesized
cacccaatccttcattcattca

SEQ ID NO: 135428 - DNA, 22 bp, Artificial Sequence
  chemically synthesized
acccaatccttcattcattcac

SEQ ID NO: 135429 - DNA, 22 bp, Artificial Sequence
  chemically synthesized
cattcattcactggccattgta

SEQ ID NO: 135430 - DNA, 22 bp, Artificial Sequence
  chemically synthesized
attcattcactggccattgtag

SEQ ID NO: 135431 - DNA, 22 bp, Artificial Sequence
  chemically synthesized
attcactggccattgtagaatc

SEQ ID NO: 135432 - DNA, 22 bp, Artificial Sequence
  chemically synthesized
actggccattgtagaatcaggt

SEQ ID NO: 135433 - DNA, 22 bp, Artificial Sequence
  chemically synthesized
gccattgtagaatcaggtatct

SEQ ID NO: 135434 - DNA, 22 bp, Artificial Sequence
  chemically synthesized
tagaatcaggtatcttgcttgt

SEQ ID NO: 135435 - DNA, 22 bp, Artificial Sequence
  chemically synthesized
gcttgttttggcctatgactgt

SEQ ID NO: 135436 - DNA, 22 bp, Artificial Sequence
  chemically synthesized
cttgttttggcctatgactgtt

SEQ ID NO: 135437 - DNA, 22 bp, Artificial Sequence
  chemically synthesized
gttttggcctatgactgtttca

SEQ ID NO: 135438 - DNA, 22 bp, Artificial Sequence
  chemically synthesized
ttttggcctatgactgtttcat

SEQ ID NO: 135439 - DNA, 22 bp, Artificial Sequence
  chemically synthesized
tggcctatgactgtttcattgc

SEQ ID NO: 135440 - DNA, 22 bp, Artificial Sequence
  chemically synthesized
ggcctatgactgtttcattgcc

SEQ ID NO: 135441 - DNA, 22 bp, Artificial Sequence
  chemically synthesized
gcctatgactgtttcattgcca

SEQ ID NO: 135442 - DNA, 22 bp, Artificial Sequence
  chemically synthesized
tgactgtttcattgccatccgc

SEQ ID NO: 135443 - DNA, 22 bp, Artificial Sequence
  chemically synthesized
tttcattgccatccgcacacca

SEQ ID NO: 135444 - DNA, 22 bp, Artificial Sequence
  chemically synthesized
cattgccatccgcacaccactg

SEQ ID NO: 135445 - DNA, 22 bp, Artificial Sequence
  chemically synthesized
attgccatccgcacaccactga

SEQ ID NO: 135446 - DNA, 22 bp, Artificial Sequence
  chemically synthesized
ccatccgcacaccactgaggta

SEQ ID NO: 135447 - DNA, 22 bp, Artificial Sequence
  chemically synthesized
aggtacaactgcattcttacca

SEQ ID NO: 135448 - DNA, 22 bp, Artificial Sequence
  chemically synthesized
cattcttaccaattcccgagtg

SEQ ID NO: 135449 - DNA, 22 bp, Artificial Sequence
  chemically synthesized
ttaccaattcccgagtgatgaa

SEQ ID NO: 135450 - DNA, 22 bp, Artificial Sequence
  chemically synthesized
accaattcccgagtgatgaaca

SEQ ID NO: 135451 - DNA, 22 bp, Artificial Sequence
  chemically synthesized
ccaattcccgagtgatgaacat

SEQ ID NO: 135452 - DNA, 22 bp, Artificial Sequence
  chemically synthesized
ccgagtgatgaacataggactg

SEQ ID NO: 135453 - DNA, 22 bp, Artificial Sequence
  chemically synthesized
ggggtactgatgagaggtttta

SEQ ID NO: 135454 - DNA, 22 bp, Artificial Sequence
  chemically synthesized
atgagaggttttatgtccattt

SEQ ID NO: 135455 - DNA, 22 bp, Artificial Sequence
  chemically synthesized
tatgtccattttgcccataatt

SEQ ID NO: 135456 - DNA, 22 bp, Artificial Sequence
  chemically synthesized
atgtccattttgcccataattc

SEQ ID NO: 135457 - DNA, 22 bp, Artificial Sequence
  chemically synthesized
tgtccattttgcccataattct

SEQ ID NO: 135458 - DNA, 22 bp, Artificial Sequence
  chemically synthesized
tgcccataattctttcactcta

SEQ ID NO: 135459 - DNA, 22 bp, Artificial Sequence
  chemically synthesized
gcccataattctttcactctac

SEQ ID NO: 135460 - DNA, 22 bp, Artificial Sequence
  chemically synthesized
cccataattctttcactctact

SEQ ID NO: 135461 - DNA, 22 bp, Artificial Sequence
  chemically synthesized
tttcactctactgctacccata

SEQ ID NO: 135462 - DNA, 22 bp, Artificial Sequence
  chemically synthesized
tcactctactgctacccatatt

SEQ ID NO: 135463 - DNA, 22 bp, Artificial Sequence
  chemically synthesized
cactctactgctacccatattg

SEQ ID NO: 135464 - DNA, 22 bp, Artificial Sequence
  chemically synthesized
actctactgctacccatattgt

SEQ ID NO: 135465 - DNA, 22 bp, Artificial Sequence
  chemically synthesized
tactgctacccatattgtggtt

SEQ ID NO: 135466 - DNA, 22 bp, Artificial Sequence
  chemically synthesized
ctgctacccatattgtggttcc

SEQ ID NO: 135467 - DNA, 22 bp, Artificial Sequence
  chemically synthesized
ctacccatattgtggttcccgt

SEQ ID NO: 135468 - DNA, 22 bp, Artificial Sequence
  chemically synthesized
cccatattgtggttcccgtgcc

SEQ ID NO: 135469 - DNA, 22 bp, Artificial Sequence
  chemically synthesized
tggttcccgtgccctcttgcac

SEQ ID NO: 135470 - DNA, 22 bp, Artificial Sequence
  chemically synthesized
ccgtgccctcttgcacacattt

SEQ ID NO: 135471 - DNA, 22 bp, Artificial Sequence
  chemically synthesized
ttgcacacattttgcctccatc

SEQ ID NO: 135472 - DNA, 22 bp, Artificial Sequence
  chemically synthesized
gcacacattttgcctccatcaa

SEQ ID NO: 135473 - DNA, 22 bp, Artificial Sequence
  chemically synthesized
cacacattttgcctccatcaag

SEQ ID NO: 135474 - DNA, 22 bp, Artificial Sequence
  chemically synthesized
tgcctccatcaagatgtcataa

SEQ ID NO: 135475 - DNA, 22 bp, Artificial Sequence
  chemically synthesized
gcctccatcaagatgtcataaa

SEQ ID NO: 135476 - DNA, 22 bp, Artificial Sequence
  chemically synthesized
cctccatcaagatgtcataaaa

SEQ ID NO: 135477 - DNA, 22 bp, Artificial Sequence
  chemically synthesized
catcaagatgtcataaaactcg

SEQ ID NO: 135478 - DNA, 22 bp, Artificial Sequence
  chemically synthesized
gcctgtgctgatatcacgttta

SEQ ID NO: 135479 - DNA, 22 bp, Artificial Sequence
  chemically synthesized
tgctgatatcacgtttaatcac

SEQ ID NO: 135480 - DNA, 22 bp, Artificial Sequence
  chemically synthesized
atatcacgtttaatcacatata

SEQ ID NO: 135481 - DNA, 22 bp, Artificial Sequence
  chemically synthesized
aatcacatatatccaattattc

SEQ ID NO: 135482 - DNA, 22 bp, Artificial Sequence
  chemically synthesized
atcacatatatccaattattca

SEQ ID NO: 135483 - DNA, 22 bp, Artificial Sequence
  chemically synthesized
ttcagacttctttgactgtctt

SEQ ID NO: 135484 - DNA, 22 bp, Artificial Sequence
  chemically synthesized
agacttctttgactgtcttttt

SEQ ID NO: 135485 - DNA, 22 bp, Artificial Sequence
  chemically synthesized
ctttgactgtctttttagatgc

SEQ ID NO: 135486 - DNA, 22 bp, Artificial Sequence
  chemically synthesized
tttgactgtctttttagatgct

SEQ ID NO: 135487 - DNA, 22 bp, Artificial Sequence
  chemically synthesized
tgactgtctttttagatgctct

SEQ ID NO: 135488 - DNA, 22 bp, Artificial Sequence
  chemically synthesized
gactgtctttttagatgctcta

SEQ ID NO: 135489 - DNA, 22 bp, Artificial Sequence
  chemically synthesized
actgtctttttagatgctctaa

SEQ ID NO: 135490 - DNA, 22 bp, Artificial Sequence
  chemically synthesized
tctttttagatgctctaatcat

SEQ ID NO: 135491 - DNA, 22 bp, Artificial Sequence
  chemically synthesized
tttagatgctctaatcatcatc

SEQ ID NO: 135492 - DNA, 22 bp, Artificial Sequence
  chemically synthesized
ttagatgctctaatcatcatct

SEQ ID NO: 135493 - DNA, 22 bp, Artificial Sequence
  chemically synthesized
tagatgctctaatcatcatctt

SEQ ID NO: 135494 - DNA, 22 bp, Artificial Sequence
  chemically synthesized
agatgctctaatcatcatcttt

SEQ ID NO: 135495 - DNA, 22 bp, Artificial Sequence
  chemically synthesized
gatgctctaatcatcatctttt

SEQ ID NO: 135496 - DNA, 22 bp, Artificial Sequence
  chemically synthesized
taatcatcatcttttcttatat

SEQ ID NO: 135497 - DNA, 22 bp, Artificial Sequence
  chemically synthesized
atcatcatcttttcttatatac

SEQ ID NO: 135498 - DNA, 22 bp, Artificial Sequence
  chemically synthesized
ttcttatatactaatcctcaag

SEQ ID NO: 135499 - DNA, 22 bp, Artificial Sequence
  chemically synthesized
tcttatatactaatcctcaaga

SEQ ID NO: 135500 - DNA, 22 bp, Artificial Sequence
  chemically synthesized
cttatatactaatcctcaagac

SEQ ID NO: 135501 - DNA, 22 bp, Artificial Sequence
  chemically synthesized
ttatatactaatcctcaagaca

SEQ ID NO: 135502 - DNA, 22 bp, Artificial Sequence
  chemically synthesized
atatactaatcctcaagacagt

SEQ ID NO: 135503 - DNA, 22 bp, Artificial Sequence
  chemically synthesized
tatactaatcctcaagacagtg

SEQ ID NO: 135504 - DNA, 22 bp, Artificial Sequence
  chemically synthesized
atcctcaagacagtgatgggca

SEQ ID NO: 135505 - DNA, 22 bp, Artificial Sequence
  chemically synthesized
aagacagtgatgggcattgcgt

SEQ ID NO: 135506 - DNA, 22 bp, Artificial Sequence
  chemically synthesized
cgtctggacaagaggaagctaa

SEQ ID NO: 135507 - DNA, 22 bp, Artificial Sequence
  chemically synthesized
gacaagaggaagctaaatctct

SEQ ID NO: 135508 - DNA, 22 bp, Artificial Sequence
  chemically synthesized
aatctctcaacacttgtgtctc

SEQ ID NO: 135509 - DNA, 22 bp, Artificial Sequence
  chemically synthesized
tcaacacttgtgtctcccatat

SEQ ID NO: 135510 - DNA, 22 bp, Artificial Sequence
  chemically synthesized
aacacttgtgtctcccatatta

SEQ ID NO: 135511 - DNA, 22 bp, Artificial Sequence
  chemically synthesized
gtgtctcccatattagctgtgt

SEQ ID NO: 135512 - DNA, 22 bp, Artificial Sequence
  chemically synthesized
tgtctcccatattagctgtgtc

SEQ ID NO: 135513 - DNA, 22 bp, Artificial Sequence
  chemically synthesized
ccatattagctgtgtcctagta

SEQ ID NO: 135514 - DNA, 22 bp, Artificial Sequence
  chemically synthesized
gctgtgtcctagtatttcacat

SEQ ID NO: 135515 - DNA, 22 bp, Artificial Sequence
  chemically synthesized
tgtcctagtatttcacatcact

SEQ ID NO: 135516 - DNA, 22 bp, Artificial Sequence
  chemically synthesized
gtatttcacatcactgtgatgg

SEQ ID NO: 135517 - DNA, 22 bp, Artificial Sequence
  chemically synthesized
cacatcactgtgatgggactgt

SEQ ID NO: 135518 - DNA, 22 bp, Artificial Sequence
  chemically synthesized
acatcactgtgatgggactgtc

SEQ ID NO: 135519 - DNA, 22 bp, Artificial Sequence
  chemically synthesized
tgatgggactgtcattcattca

SEQ ID NO: 135520 - DNA, 22 bp, Artificial Sequence
  chemically synthesized
tcattcattcacaggtttggga

SEQ ID NO: 135521 - DNA, 22 bp, Artificial Sequence
  chemically synthesized
attcacaggtttgggaaacatg

SEQ ID NO: 135522 - DNA, 22 bp, Artificial Sequence
  chemically synthesized
acaggtttgggaaacatgcacc

SEQ ID NO: 135523 - DNA, 22 bp, Artificial Sequence
  chemically synthesized
gggaaacatgcacctcatgtgg

SEQ ID NO: 135524 - DNA, 22 bp, Artificial Sequence
  chemically synthesized
ggaaacatgcacctcatgtggt

SEQ ID NO: 135525 - DNA, 22 bp, Artificial Sequence
  chemically synthesized
atgtggtccccattaccatgag

SEQ ID NO: 135526 - DNA, 22 bp, Artificial Sequence
  chemically synthesized
ccatgagctatgtccattttct

SEQ ID NO: 135527 - DNA, 22 bp, Artificial Sequence
  chemically synthesized
tgtccattttctctttcctcca

SEQ ID NO: 135528 - DNA, 22 bp, Artificial Sequence
  chemically synthesized
tctctttcctccattcgtgaat

SEQ ID NO: 135529 - DNA, 22 bp, Artificial Sequence
  chemically synthesized
ctctttcctccattcgtgaatc

SEQ ID NO: 135530 - DNA, 22 bp, Artificial Sequence
  chemically synthesized
tctttcctccattcgtgaatcc

SEQ ID NO: 135531 - DNA, 22 bp, Artificial Sequence
  chemically synthesized
tttcctccattcgtgaatccta

SEQ ID NO: 135532 - DNA, 22 bp, Artificial Sequence
  chemically synthesized
tcctccattcgtgaatcctatc

SEQ ID NO: 135533 - DNA, 22 bp, Artificial Sequence
  chemically synthesized
cctccattcgtgaatcctatca

SEQ ID NO: 135534 - DNA, 22 bp, Artificial Sequence
  chemically synthesized
ctccattcgtgaatcctatcat

SEQ ID NO: 135535 - DNA, 22 bp, Artificial Sequence
  chemically synthesized
cattcgtgaatcctatcattta

SEQ ID NO: 135536 - DNA, 22 bp, Artificial Sequence
  chemically synthesized
gtgaatcctatcatttatagca

SEQ ID NO: 135537 - DNA, 22 bp, Artificial Sequence
  chemically synthesized
tcatttatagcatcaagaccaa

SEQ ID NO: 135538 - DNA, 22 bp, Artificial Sequence
  chemically synthesized
atagcatcaagaccaagcagat

SEQ ID NO: 135539 - DNA, 22 bp, Artificial Sequence
  chemically synthesized
tagcatcaagaccaagcagatt

SEQ ID NO: 135540 - DNA, 22 bp, Artificial Sequence
  chemically synthesized
aaagaagcattattcgcctatt

SEQ ID NO: 135541 - DNA, 22 bp, Artificial Sequence
  chemically synthesized
ttcgcctattttctgggcagag

SEQ ID NO: 135542 - DNA, 22 bp, Artificial Sequence
  chemically synthesized
gcctattttctgggcagagtag

SEQ ID NO: 135543 - DNA, 22 bp, Artificial Sequence
  chemically synthesized
ttttctgggcagagtagggctt

SEQ ID NO: 135544 - DNA, 22 bp, Artificial Sequence
  chemically synthesized
tctgggcagagtagggcttgag

SEQ ID NO: 135545 - DNA, 22 bp, Artificial Sequence
  chemically synthesized
ctgggcagagtagggcttgagc

SEQ ID NO: 135546 - DNA, 22 bp, Artificial Sequence
  chemically synthesized
tgggcagagtagggcttgagcc

SEQ ID NO: 135547 - DNA, 22 bp, Artificial Sequence
  chemically synthesized
ggcagagtagggcttgagccct

SEQ ID NO: 135548 - DNA, 22 bp, Artificial Sequence
  chemically synthesized
gagcccttatttcagaatctca

SEQ ID NO: 135549 - DNA, 22 bp, Artificial Sequence
  chemically synthesized
agcccttatttcagaatctcaa

SEQ ID NO: 135550 - DNA, 22 bp, Artificial Sequence
  chemically synthesized
atttcagaatctcaagatctct

SEQ ID NO: 135551 - DNA, 22 bp, Artificial Sequence
  chemically synthesized
tttcagaatctcaagatctcta

SEQ ID NO: 135552 - DNA, 22 bp, Artificial Sequence
  chemically synthesized
cagaatctcaagatctctagga

SEQ ID NO: 135553 - DNA, 22 bp, Artificial Sequence
  chemically synthesized
agaatctcaagatctctaggat

SEQ ID NO: 135554 - DNA, 22 bp, Artificial Sequence
  chemically synthesized
aagatctctaggatttctgggc

SEQ ID NO: 135555 - DNA, 22 bp, Artificial Sequence
  chemically synthesized
taggatttctgggcctctccca

SEQ ID NO: 135556 - DNA, 22 bp, Artificial Sequence
  chemically synthesized
ggatttctgggcctctcccatt

SEQ ID NO: 135557 - DNA, 22 bp, Artificial Sequence
  chemically synthesized
ctgggcctctcccattactgaa

SEQ ID NO: 135558 - DNA, 22 bp, Artificial Sequence
  chemically synthesized
tgggcctctcccattactgaaa

SEQ ID NO: 135559 - DNA, 22 bp, Artificial Sequence
  chemically synthesized
ggcctctcccattactgaaaag

SEQ ID NO: 135560 - DNA, 22 bp, Artificial Sequence
  chemically synthesized
tcccattactgaaaaggaaccc

SEQ ID NO: 135561 - DNA, 22 bp, Artificial Sequence
  chemically synthesized
ccattactgaaaaggaaccctg

SEQ ID NO: 135562 - DNA, 22 bp, Artificial Sequence
  chemically synthesized
ctgaaaaggaaccctggtttta

SEQ ID NO: 135563 - DNA, 22 bp, Artificial Sequence
  chemically synthesized
aaaaggaaccctggttttatat

SEQ ID NO: 135564 - DNA, 22 bp, Artificial Sequence
  chemically synthesized
gttttatatccacacttttttt

SEQ ID NO: 135565 - DNA, 22 bp, Artificial Sequence
  chemically synthesized
tatatccacacttttttttcct

SEQ ID NO: 135566 - DNA, 22 bp, Artificial Sequence
  chemically synthesized
atatccacacttttttttcctc

SEQ ID NO: 135567 - DNA, 22 bp, Artificial Sequence
  chemically synthesized
tatccacacttttttttcctca

SEQ ID NO: 135568 - DNA, 22 bp, Artificial Sequence
  chemically synthesized
ttttttcctcagagttagattc

SEQ ID NO: 135569 - DNA, 22 bp, Artificial Sequence
  chemically synthesized
tttttcctcagagttagattca

SEQ ID NO: 135570 - DNA, 22 bp, Artificial Sequence
  chemically synthesized
ttttcctcagagttagattcaa

SEQ ID NO: 135571 - DNA, 22 bp, Artificial Sequence
  chemically synthesized
tttcctcagagttagattcaat

SEQ ID NO: 135572 - DNA, 22 bp, Artificial Sequence
  chemically synthesized
ttcctcagagttagattcaatt

SEQ ID NO: 135573 - DNA, 22 bp, Artificial Sequence
  chemically synthesized
tcctcagagttagattcaattt

SEQ ID NO: 135574 - DNA, 22 bp, Artificial Sequence
  chemically synthesized
cctcagagttagattcaatttt

SEQ ID NO: 135575 - DNA, 22 bp, Artificial Sequence
  chemically synthesized
ctcagagttagattcaatttta

SEQ ID NO: 135576 - DNA, 22 bp, Artificial Sequence
  chemically synthesized
agagttagattcaattttaatt

SEQ ID NO: 135577 - DNA, 22 bp, Artificial Sequence
  chemically synthesized
gattcaattttaattatcacat

SEQ ID NO: 135578 - DNA, 22 bp, Artificial Sequence
  chemically synthesized
aattttaattatcacatgaaaa

SEQ ID NO: 135579 - DNA, 22 bp, Artificial Sequence
  chemically synthesized
taattatcacatgaaaaagctg

SEQ ID NO: 135580 - DNA, 22 bp, Artificial Sequence
  chemically synthesized
aattatcacatgaaaaagctga

SEQ ID NO: 135581 - DNA, 22 bp, Artificial Sequence
  chemically synthesized
attatcacatgaaaaagctgat

SEQ ID NO: 135582 - DNA, 22 bp, Artificial Sequence
  chemically synthesized
tcacatgaaaaagctgatgtga

SEQ ID NO: 135583 - DNA, 22 bp, Artificial Sequence
  chemically synthesized
atgtgagcgagaaatttttata

SEQ ID NO: 135584 - DNA, 22 bp, Artificial Sequence
  chemically synthesized
ttatacatatgtgtgtgtgtgt

SEQ ID NO: 135585 - DNA, 22 bp, Artificial Sequence
  chemically synthesized
tatacatatgtgtgtgtgtgtg

SEQ ID NO: 135586 - DNA, 22 bp, Artificial Sequence
  chemically synthesized
atacatatgtgtgtgtgtgtgt

SEQ ID NO: 135587 - DNA, 22 bp, Artificial Sequence
  chemically synthesized
tacatatgtgtgtgtgtgtgtg

SEQ ID NO: 135588 - DNA, 22 bp, Artificial Sequence
  chemically synthesized
ataaagagggaatgccagtgat

SEQ ID NO: 135589 - DNA, 22 bp, Artificial Sequence
  chemically synthesized
aagaaaaagaatacaggaagca

SEQ ID NO: 135590 - DNA, 22 bp, Artificial Sequence
  chemically synthesized
tgatttcagaaatagtcaagat

SEQ ID NO: 135591 - DNA, 22 bp, Artificial Sequence
  chemically synthesized
cagaaatagtcaagataagtgg

SEQ ID NO: 135592 - DNA, 22 bp, Artificial Sequence
  chemically synthesized
agaaatagtcaagataagtgga

SEQ ID NO: 135593 - DNA, 22 bp, Artificial Sequence
  chemically synthesized
aagcagcttgggtcaaatacag

SEQ ID NO: 135594 - DNA, 22 bp, Artificial Sequence
  chemically synthesized
gggtcaaatacagttcatctaa

SEQ ID NO: 135595 - DNA, 22 bp, Artificial Sequence
  chemically synthesized
ggtcaaatacagttcatctaaa

SEQ ID NO: 135596 - DNA, 22 bp, Artificial Sequence
  chemically synthesized
atctaaagaaaaatgtgcagtt

SEQ ID NO: 135597 - DNA, 22 bp, Artificial Sequence
  chemically synthesized
aagaaaaatgtgcagttggagg

SEQ ID NO: 135598 - DNA, 22 bp, Artificial Sequence
  chemically synthesized
gaggtacattttatgtgtctta

SEQ ID NO: 135599 - DNA, 22 bp, Artificial Sequence
  chemically synthesized
tatgtgtcttataaaggtgaat

SEQ ID NO: 135600 - DNA, 22 bp, Artificial Sequence
  chemically synthesized
atgtgtcttataaaggtgaatt

SEQ ID NO: 135601 - DNA, 22 bp, Artificial Sequence
  chemically synthesized
tgtgtcttataaaggtgaattt

SEQ ID NO: 135602 - DNA, 22 bp, Artificial Sequence
  chemically synthesized
ataaaggtgaatttgaataata

SEQ ID NO: 135603 - DNA, 22 bp, Artificial Sequence
  chemically synthesized
taaaggtgaatttgaataatac

SEQ ID NO: 135604 - DNA, 22 bp, Artificial Sequence
  chemically synthesized
gaataatacatgatcatatttt

SEQ ID NO: 135605 - DNA, 22 bp, Artificial Sequence
  chemically synthesized
aataatacatgatcatattttc

SEQ ID NO: 135606 - DNA, 22 bp, Artificial Sequence
  chemically synthesized
tcatctccatactttgaaacta

SEQ ID NO: 135607 - DNA, 22 bp, Artificial Sequence
  chemically synthesized
catctccatactttgaaactag

SEQ ID NO: 135608 - DNA, 22 bp, Artificial Sequence
  chemically synthesized
atctccatactttgaaactagt

SEQ ID NO: 135609 - DNA, 22 bp, Artificial Sequence
  chemically synthesized
catactttgaaactagttactc

SEQ ID NO: 135610 - DNA, 22 bp, Artificial Sequence
  chemically synthesized
tgaaactagttactctgaaaag

SEQ ID NO: 135611 - DNA, 22 bp, Artificial Sequence
  chemically synthesized
gaaactagttactctgaaaagg

SEQ ID NO: 135612 - DNA, 22 bp, Artificial Sequence
  chemically synthesized
aaactagttactctgaaaagga

SEQ ID NO: 135613 - DNA, 22 bp, Artificial Sequence
  chemically synthesized
gttactctgaaaaggatcttgc

SEQ ID NO: 135614 - DNA, 22 bp, Artificial Sequence
  chemically synthesized
ctctgaaaaggatcttgcttga

SEQ ID NO: 135615 - DNA, 22 bp, Artificial Sequence
  chemically synthesized
tgaaaaggatcttgcttgatta

SEQ ID NO: 135616 - DNA, 22 bp, Artificial Sequence
  chemically synthesized
aaaaggatcttgcttgattagt

SEQ ID NO: 135617 - DNA, 22 bp, Artificial Sequence
  chemically synthesized
gcttgattagtaagcaaacttg

SEQ ID NO: 135618 - DNA, 22 bp, Artificial Sequence
  chemically synthesized
cttgattagtaagcaaacttgt

SEQ ID NO: 135619 - DNA, 22 bp, Artificial Sequence
  chemically synthesized
gattagtaagcaaacttgtgtg

SEQ ID NO: 135620 - DNA, 22 bp, Artificial Sequence
  chemically synthesized
attagtaagcaaacttgtgtga

SEQ ID NO: 135621 - DNA, 22 bp, Artificial Sequence
  chemically synthesized
gtaagcaaacttgtgtgaggct

SEQ ID NO: 135622 - DNA, 22 bp, Artificial Sequence
  chemically synthesized
gtgtgaggctaaacagcaaata

SEQ ID NO: 135623 - DNA, 22 bp, Artificial Sequence
  chemically synthesized
tgtgaggctaaacagcaaatat

SEQ ID NO: 135624 - DNA, 22 bp, Artificial Sequence
  chemically synthesized
aacagcaaatatctagaacttt

SEQ ID NO: 135625 - DNA, 22 bp, Artificial Sequence
  chemically synthesized
gaactttaggaagcttactcat

SEQ ID NO: 135626 - DNA, 22 bp, Artificial Sequence
  chemically synthesized
taggaagcttactcatgaaatg

SEQ ID NO: 135627 - DNA, 22 bp, Artificial Sequence
  chemically synthesized
aggaagcttactcatgaaatgt

SEQ ID NO: 135628 - DNA, 22 bp, Artificial Sequence
  chemically synthesized
ggaagcttactcatgaaatgta

SEQ ID NO: 135629 - DNA, 22 bp, Artificial Sequence
  chemically synthesized
actcatgaaatgtaatttccct

SEQ ID NO: 135630 - DNA, 22 bp, Artificial Sequence
  chemically synthesized
ctcatgaaatgtaatttccctt

SEQ ID NO: 135631 - DNA, 22 bp, Artificial Sequence
  chemically synthesized
atgaaatgtaatttcccttagt

SEQ ID NO: 135632 - DNA, 22 bp, Artificial Sequence
  chemically synthesized
cccttagtagactggcatattt

SEQ ID NO: 135633 - DNA, 22 bp, Artificial Sequence
  chemically synthesized
ccttagtagactggcatatttt

SEQ ID NO: 135634 - DNA, 22 bp, Artificial Sequence
  chemically synthesized
agtagactggcatattttacta

SEQ ID NO: 135635 - DNA, 22 bp, Artificial Sequence
  chemically synthesized
gtagactggcatattttactac

SEQ ID NO: 135636 - DNA, 22 bp, Artificial Sequence
  chemically synthesized
gcatattttactactaaaaggc

SEQ ID NO: 135637 - DNA, 22 bp, Artificial Sequence
  chemically synthesized
tactactaaaaggcgtgtgata

SEQ ID NO: 135638 - DNA, 22 bp, Artificial Sequence
  chemically synthesized
actactaaaaggcgtgtgatac

SEQ ID NO: 135639 - DNA, 22 bp, Artificial Sequence
  chemically synthesized
ctactaaaaggcgtgtgataca

SEQ ID NO: 135640 - DNA, 22 bp, Artificial Sequence
  chemically synthesized
ctaaaaggcgtgtgatacagac

SEQ ID NO: 135641 - DNA, 22 bp, Artificial Sequence
  chemically synthesized
aaaggcgtgtgatacagactaa

SEQ ID NO: 135642 - DNA, 22 bp, Artificial Sequence
  chemically synthesized
acagctaaatagcagcaaacac

SEQ ID NO: 135643 - DNA, 22 bp, Artificial Sequence
  chemically synthesized
aatagcagcaaacacatttctt

SEQ ID NO: 135644 - DNA, 22 bp, Artificial Sequence
  chemically synthesized
cttatcatctcgtggaagccag

SEQ ID NO: 135645 - DNA, 22 bp, Artificial Sequence
  chemically synthesized
ttatcatctcgtggaagccaga

SEQ ID NO: 135646 - DNA, 22 bp, Artificial Sequence
  chemically synthesized
atcatctcgtggaagccagata

SEQ ID NO: 135647 - DNA, 22 bp, Artificial Sequence
  chemically synthesized
tcatctcgtggaagccagatat

SEQ ID NO: 135648 - DNA, 22 bp, Artificial Sequence
  chemically synthesized
gtggaagccagatatcccagcc

SEQ ID NO: 135649 - DNA, 22 bp, Artificial Sequence
  chemically synthesized
tccttcttcccattgtctgctg

SEQ ID NO: 135650 - DNA, 22 bp, Artificial Sequence
  chemically synthesized
ccttcttcccattgtctgctga

SEQ ID NO: 135651 - DNA, 22 bp, Artificial Sequence
  chemically synthesized
cttcttcccattgtctgctgaa

SEQ ID NO: 135652 - DNA, 22 bp, Artificial Sequence
  chemically synthesized
cttcccattgtctgctgaaact

SEQ ID NO: 135653 - DNA, 22 bp, Artificial Sequence
  chemically synthesized
ttcccattgtctgctgaaacta

SEQ ID NO: 135654 - DNA, 22 bp, Artificial Sequence
  chemically synthesized
cccattgtctgctgaaactaac

SEQ ID NO: 135655 - DNA, 22 bp, Artificial Sequence
  chemically synthesized
ccattgtctgctgaaactaact

SEQ ID NO: 135656 - DNA, 22 bp, Artificial Sequence
  chemically synthesized
tctgctgaaactaacttaatac

SEQ ID NO: 135657 - DNA, 22 bp, Artificial Sequence
  chemically synthesized
ctgaaactaacttaatactttt

SEQ ID NO: 135658 - DNA, 22 bp, Artificial Sequence
  chemically synthesized
aaactaacttaatactttttct

SEQ ID NO: 135659 - DNA, 22 bp, Artificial Sequence
  chemically synthesized
acttaatactttttcttctttc

SEQ ID NO: 135660 - DNA, 22 bp, Artificial Sequence
  chemically synthesized
aatactttttcttctttccagc

SEQ ID NO: 135661 - DNA, 22 bp, Artificial Sequence
  chemically synthesized
atactttttcttctttccagct

SEQ ID NO: 135662 - DNA, 22 bp, Artificial Sequence
  chemically synthesized
tttcttctttccagctttctat

SEQ ID NO: 135663 - DNA, 22 bp, Artificial Sequence
  chemically synthesized
ttcttctttccagctttctatt

SEQ ID NO: 135664 - DNA, 22 bp, Artificial Sequence
  chemically synthesized
tcttctttccagctttctattt

SEQ ID NO: 135665 - DNA, 22 bp, Artificial Sequence
  chemically synthesized
cttctttccagctttctatttt

SEQ ID NO: 135666 - DNA, 22 bp, Artificial Sequence
  chemically synthesized
ttctttccagctttctattttg

SEQ ID NO: 135667 - DNA, 22 bp, Artificial Sequence
  chemically synthesized
ctttccagctttctattttgtc

SEQ ID NO: 135668 - DNA, 22 bp, Artificial Sequence
  chemically synthesized
tttccagctttctattttgtct

SEQ ID NO: 135669 - DNA, 22 bp, Artificial Sequence
  chemically synthesized
tccagctttctattttgtctcc

SEQ ID NO: 135670 - DNA, 22 bp, Artificial Sequence
  chemically synthesized
ccagctttctattttgtctcct

SEQ ID NO: 135671 - DNA, 22 bp, Artificial Sequence
  chemically synthesized
cagctttctattttgtctcctg

SEQ ID NO: 135672 - DNA, 22 bp, Artificial Sequence
  chemically synthesized
tctattttgtctcctgacattt

SEQ ID NO: 135673 - DNA, 22 bp, Artificial Sequence
  chemically synthesized
ctattttgtctcctgacatttt

SEQ ID NO: 135674 - DNA, 22 bp, Artificial Sequence
  chemically synthesized
tattttgtctcctgacattttt

SEQ ID NO: 135675 - DNA, 22 bp, Artificial Sequence
  chemically synthesized
ttttgtctcctgacatttttct

SEQ ID NO: 135676 - DNA, 22 bp, Artificial Sequence
  chemically synthesized
tgtctcctgacatttttcttct

SEQ ID NO: 135677 - DNA, 22 bp, Artificial Sequence
  chemically synthesized
gtctcctgacatttttcttctg

SEQ ID NO: 135678 - DNA, 22 bp, Artificial Sequence
  chemically synthesized
tctcctgacatttttcttctga

SEQ ID NO: 135679 - DNA, 22 bp, Artificial Sequence
  chemically synthesized
ctgacatttttcttctgaaaaa

SEQ ID NO: 135680 - DNA, 22 bp, Artificial Sequence
  chemically synthesized
acatttttcttctgaaaaaaat

SEQ ID NO: 135681 - DNA, 22 bp, Artificial Sequence
  chemically synthesized
ttcttctgaaaaaaataaccaa

SEQ ID NO: 135682 - DNA, 22 bp, Artificial Sequence
  chemically synthesized
tcttctgaaaaaaataaccaac

SEQ ID NO: 135683 - DNA, 22 bp, Artificial Sequence
  chemically synthesized
cttctgaaaaaaataaccaact

SEQ ID NO: 135684 - DNA, 22 bp, Artificial Sequence
  chemically synthesized
ttctgaaaaaaataaccaacta

SEQ ID NO: 135685 - DNA, 22 bp, Artificial Sequence
  chemically synthesized
ctgaaaaaaataaccaactata

SEQ ID NO: 135686 - DNA, 22 bp, Artificial Sequence
  chemically synthesized
tgaaaaaaataaccaactataa

SEQ ID NO: 135687 - DNA, 22 bp, Artificial Sequence
  chemically synthesized
aaaaaaataaccaactataaat

SEQ ID NO: 135688 - DNA, 22 bp, Artificial Sequence
  chemically synthesized
taaatttagatatcaccaccca

SEQ ID NO: 135689 - DNA, 22 bp, Artificial Sequence
  chemically synthesized
agatatcaccacccatttctat

SEQ ID NO: 135690 - DNA, 22 bp, Artificial Sequence
  chemically synthesized
gatatcaccacccatttctatt

SEQ ID NO: 135691 - DNA, 22 bp, Artificial Sequence
  chemically synthesized
ctatttcccctcttgcttctca

SEQ ID NO: 135692 - DNA, 22 bp, Artificial Sequence
  chemically synthesized
tatttcccctcttgcttctcac

SEQ ID NO: 135693 - DNA, 22 bp, Artificial Sequence
  chemically synthesized
tttcccctcttgcttctcacat

SEQ ID NO: 135694 - DNA, 22 bp, Artificial Sequence
  chemically synthesized
cccctcttgcttctcacataaa

SEQ ID NO: 135695 - DNA, 22 bp, Artificial Sequence
  chemically synthesized
ccctcttgcttctcacataaaa

SEQ ID NO: 135696 - DNA, 22 bp, Artificial Sequence
  chemically synthesized
ttgcttctcacataaaaaatct

SEQ ID NO: 135697 - DNA, 22 bp, Artificial Sequence
  chemically synthesized
gcttctcacataaaaaatctcg

SEQ ID NO: 135698 - DNA, 22 bp, Artificial Sequence
  chemically synthesized
cttctcacataaaaaatctcga

SEQ ID NO: 135699 - DNA, 22 bp, Artificial Sequence
  chemically synthesized
ctcacataaaaaatctcgagac

SEQ ID NO: 135700 - DNA, 22 bp, Artificial Sequence
  chemically synthesized
tcacataaaaaatctcgagact

SEQ ID NO: 135701 - DNA, 22 bp, Artificial Sequence
  chemically synthesized
acataaaaaatctcgagacttt

SEQ ID NO: 135702 - DNA, 22 bp, Artificial Sequence
  chemically synthesized
gagactttttcacttcatgaaa

SEQ ID NO: 135703 - DNA, 22 bp, Artificial Sequence
  chemically synthesized
tttcacttcatgaaatagtttt

SEQ ID NO: 135704 - DNA, 22 bp, Artificial Sequence
  chemically synthesized
ttcacttcatgaaatagttttg

SEQ ID NO: 135705 - DNA, 22 bp, Artificial Sequence
  chemically synthesized
tcacttcatgaaatagttttga

SEQ ID NO: 135706 - DNA, 22 bp, Artificial Sequence
  chemically synthesized
cacttcatgaaatagttttgat

SEQ ID NO: 135707 - DNA, 22 bp, Artificial Sequence
  chemically synthesized
acttcatgaaatagttttgata

SEQ ID NO: 135708 - DNA, 22 bp, Artificial Sequence
  chemically synthesized
catgaaatagttttgataatta

SEQ ID NO: 135709 - DNA, 22 bp, Artificial Sequence
  chemically synthesized
atgaaatagttttgataattaa

SEQ ID NO: 135710 - DNA, 22 bp, Artificial Sequence
  chemically synthesized
tgataattaatgcaaaaacttg

SEQ ID NO: 135711 - DNA, 22 bp, Artificial Sequence
  chemically synthesized
gataattaatgcaaaaacttgg

SEQ ID NO: 135712 - DNA, 22 bp, Artificial Sequence
  chemically synthesized
ataattaatgcaaaaacttggc

SEQ ID NO: 135713 - DNA, 22 bp, Artificial Sequence
  chemically synthesized
atgcaaaaacttggcaaaggta

SEQ ID NO: 135714 - DNA, 22 bp, Artificial Sequence
  chemically synthesized
ggcaaaggtaatgttatatttt

SEQ ID NO: 135715 - DNA, 22 bp, Artificial Sequence
  chemically synthesized
gcaaaggtaatgttatatttta

SEQ ID NO: 135716 - DNA, 22 bp, Artificial Sequence
  chemically synthesized
tattttagaaatttttcactga

SEQ ID NO: 135717 - DNA, 22 bp, Artificial Sequence
  chemically synthesized
tagaaatttttcactgatggaa

SEQ ID NO: 135718 - DNA, 22 bp, Artificial Sequence
  chemically synthesized
agaaatttttcactgatggaat

SEQ ID NO: 135719 - DNA, 22 bp, Artificial Sequence
  chemically synthesized
gaaatttttcactgatggaata

SEQ ID NO: 135720 - DNA, 22 bp, Artificial Sequence
  chemically synthesized
ttcactgatggaatagtttctt

SEQ ID NO: 135721 - DNA, 22 bp, Artificial Sequence
  chemically synthesized
tcactgatggaatagtttcttc

SEQ ID NO: 135722 - DNA, 22 bp, Artificial Sequence
  chemically synthesized
cactgatggaatagtttcttcc

SEQ ID NO: 135723 - DNA, 22 bp, Artificial Sequence
  chemically synthesized
actgatggaatagtttcttcct

SEQ ID NO: 135724 - DNA, 22 bp, Artificial Sequence
  chemically synthesized
atggaatagtttcttccttcaa

SEQ ID NO: 135725 - DNA, 22 bp, Artificial Sequence
  chemically synthesized
cttccttcaatcttcttcaaag

SEQ ID NO: 135726 - DNA, 22 bp, Artificial Sequence
  chemically synthesized
ttccttcaatcttcttcaaagt

SEQ ID NO: 135727 - DNA, 22 bp, Artificial Sequence
  chemically synthesized
ccttcaatcttcttcaaagtgt

SEQ ID NO: 135728 - DNA, 22 bp, Artificial Sequence
  chemically synthesized
cttcaatcttcttcaaagtgtt

SEQ ID NO: 135729 - DNA, 22 bp, Artificial Sequence
  chemically synthesized
caatcttcttcaaagtgtttgt

SEQ ID NO: 135730 - DNA, 22 bp, Artificial Sequence
  chemically synthesized
aatcttcttcaaagtgtttgta

SEQ ID NO: 135731 - DNA, 22 bp, Artificial Sequence
  chemically synthesized
cttcaaagtgtttgtaagtctt

SEQ ID NO: 135732 - DNA, 22 bp, Artificial Sequence
  chemically synthesized
ttcaaagtgtttgtaagtcttt

SEQ ID NO: 135733 - DNA, 22 bp, Artificial Sequence
  chemically synthesized
caaagtgtttgtaagtctttat

SEQ ID NO: 135734 - DNA, 22 bp, Artificial Sequence
  chemically synthesized
aaagtgtttgtaagtctttatg

SEQ ID NO: 135735 - DNA, 22 bp, Artificial Sequence
  chemically synthesized
gtaagtctttatgctgttcatt

SEQ ID NO: 135736 - DNA, 22 bp, Artificial Sequence
  chemically synthesized
taagtctttatgctgttcattg

SEQ ID NO: 135737 - DNA, 22 bp, Artificial Sequence
  chemically synthesized
tatgctgttcattgggtctgaa

SEQ ID NO: 135738 - DNA, 22 bp, Artificial Sequence
  chemically synthesized
atgctgttcattgggtctgaac

SEQ ID NO: 135739 - DNA, 22 bp, Artificial Sequence
  chemically synthesized
tgctgttcattgggtctgaacc

SEQ ID NO: 135740 - DNA, 22 bp, Artificial Sequence
  chemically synthesized
ttcattgggtctgaaccgcagt

SEQ ID NO: 135741 - DNA, 22 bp, Artificial Sequence
  chemically synthesized
attgggtctgaaccgcagtcta

SEQ ID NO: 135742 - DNA, 22 bp, Artificial Sequence
  chemically synthesized
ggtctgaaccgcagtctaccac

SEQ ID NO: 135743 - DNA, 22 bp, Artificial Sequence
  chemically synthesized
aaccgcagtctaccacttgcta

SEQ ID NO: 135744 - DNA, 22 bp, Artificial Sequence
  chemically synthesized
ccacttgctattagtgtaacag

SEQ ID NO: 135745 - DNA, 22 bp, Artificial Sequence
  chemically synthesized
gctattagtgtaacaggggatg

SEQ ID NO: 135746 - DNA, 22 bp, Artificial Sequence
  chemically synthesized
ctattagtgtaacaggggatga

SEQ ID NO: 135747 - DNA, 22 bp, Artificial Sequence
  chemically synthesized
ttagtgtaacaggggatgacaa

SEQ ID NO: 135748 - DNA, 22 bp, Artificial Sequence
  chemically synthesized
gtgtaacaggggatgacaattt

SEQ ID NO: 135749 - DNA, 22 bp, Artificial Sequence
  chemically synthesized
cttcatctactgctagttctgc

SEQ ID NO: 135750 - DNA, 22 bp, Artificial Sequence
  chemically synthesized
ttcatctactgctagttctgcg

SEQ ID NO: 135751 - DNA, 22 bp, Artificial Sequence
  chemically synthesized
catctactgctagttctgcgct

SEQ ID NO: 135752 - DNA, 22 bp, Artificial Sequence
  chemically synthesized
atctactgctagttctgcgcta

SEQ ID NO: 135753 - DNA, 22 bp, Artificial Sequence
  chemically synthesized
ctgctagttctgcgctagtatt

SEQ ID NO: 135754 - DNA, 22 bp, Artificial Sequence
  chemically synthesized
ctagttctgcgctagtatttgc

SEQ ID NO: 135755 - DNA, 22 bp, Artificial Sequence
  chemically synthesized
gttctgcgctagtatttgcagc

SEQ ID NO: 135756 - DNA, 22 bp, Artificial Sequence
  chemically synthesized
tgcgctagtatttgcagctgat

SEQ ID NO: 135757 - DNA, 22 bp, Artificial Sequence
  chemically synthesized
cgctagtatttgcagctgatct

SEQ ID NO: 135758 - DNA, 22 bp, Artificial Sequence
  chemically synthesized
gtatttgcagctgatctcctta

SEQ ID NO: 135759 - DNA, 22 bp, Artificial Sequence
  chemically synthesized
gcagctgatctccttataggaa

SEQ ID NO: 135760 - DNA, 22 bp, Artificial Sequence
  chemically synthesized
cagctgatctccttataggaaa

SEQ ID NO: 135761 - DNA, 22 bp, Artificial Sequence
  chemically synthesized
atctccttataggaaactaatc

SEQ ID NO: 135762 - DNA, 22 bp, Artificial Sequence
  chemically synthesized
cttataggaaactaatctcaaa

SEQ ID NO: 135763 - DNA, 22 bp, Artificial Sequence
  chemically synthesized
ataggaaactaatctcaaaagt

SEQ ID NO: 135764 - DNA, 22 bp, Artificial Sequence
  chemically synthesized
taggaaactaatctcaaaagtt

SEQ ID NO: 135765 - DNA, 22 bp, Artificial Sequence
  chemically synthesized
atctcaaaagttgcattcattc

SEQ ID NO: 135766 - DNA, 22 bp, Artificial Sequence
  chemically synthesized
aaaagttgcattcattcctctc

SEQ ID NO: 135767 - DNA, 22 bp, Artificial Sequence
  chemically synthesized
cattcattcctctctgaagact

SEQ ID NO: 135768 - DNA, 22 bp, Artificial Sequence
  chemically synthesized
attcctctctgaagactgctgt

SEQ ID NO: 135769 - DNA, 22 bp, Artificial Sequence
  chemically synthesized
ctctctgaagactgctgtttct

SEQ ID NO: 135770 - DNA, 22 bp, Artificial Sequence
  chemically synthesized
tctgaagactgctgtttcttcc

SEQ ID NO: 135771 - DNA, 22 bp, Artificial Sequence
  chemically synthesized
tgaagactgctgtttcttccaa

SEQ ID NO: 135772 - DNA, 22 bp, Artificial Sequence
  chemically synthesized
aagactgctgtttcttccaatt

SEQ ID NO: 135773 - DNA, 22 bp, Artificial Sequence
  chemically synthesized
ctgtttcttccaatttttaagt

SEQ ID NO: 135774 - DNA, 22 bp, Artificial Sequence
  chemically synthesized
tttcttccaatttttaagttct

SEQ ID NO: 135775 - DNA, 22 bp, Artificial Sequence
  chemically synthesized
cttccaatttttaagttctcgt

SEQ ID NO: 135776 - DNA, 22 bp, Artificial Sequence
  chemically synthesized
ttccaatttttaagttctcgtt

SEQ ID NO: 135777 - DNA, 22 bp, Artificial Sequence
  chemically synthesized
ccaatttttaagttctcgttga

SEQ ID NO: 135778 - DNA, 22 bp, Artificial Sequence
  chemically synthesized
caatttttaagttctcgttgag

SEQ ID NO: 135779 - DNA, 22 bp, Artificial Sequence
  chemically synthesized
ttaagttctcgttgagcttgct

SEQ ID NO: 135780 - DNA, 22 bp, Artificial Sequence
  chemically synthesized
taagttctcgttgagcttgctt

SEQ ID NO: 135781 - DNA, 22 bp, Artificial Sequence
  chemically synthesized
aagttctcgttgagcttgcttc

SEQ ID NO: 135782 - DNA, 22 bp, Artificial Sequence
  chemically synthesized
agttctcgttgagcttgcttct

SEQ ID NO: 135783 - DNA, 22 bp, Artificial Sequence
  chemically synthesized
tcgttgagcttgcttctaatat

SEQ ID NO: 135784 - DNA, 22 bp, Artificial Sequence
  chemically synthesized
gttgagcttgcttctaatattt

SEQ ID NO: 135785 - DNA, 22 bp, Artificial Sequence
  chemically synthesized
agcttgcttctaatattttctt

SEQ ID NO: 135786 - DNA, 22 bp, Artificial Sequence
  chemically synthesized
gcttctaatattttcttttctg

SEQ ID NO: 135787 - DNA, 22 bp, Artificial Sequence
  chemically synthesized
cttctaatattttcttttctga

SEQ ID NO: 135788 - DNA, 22 bp, Artificial Sequence
  chemically synthesized
ctaatattttcttttctgattg

SEQ ID NO: 135789 - DNA, 22 bp, Artificial Sequence
  chemically synthesized
taatattttcttttctgattga

SEQ ID NO: 135790 - DNA, 22 bp, Artificial Sequence
  chemically synthesized
atattttcttttctgattgaaa

SEQ ID NO: 135791 - DNA, 22 bp, Artificial Sequence
  chemically synthesized
tcttttctgattgaaagtccat

SEQ ID NO: 135792 - DNA, 22 bp, Artificial Sequence
  chemically synthesized
cttttctgattgaaagtccatg

SEQ ID NO: 135793 - DNA, 22 bp, Artificial Sequence
  chemically synthesized
ttttctgattgaaagtccatgt

SEQ ID NO: 135794 - DNA, 22 bp, Artificial Sequence
  chemically synthesized
ttctgattgaaagtccatgttc

SEQ ID NO: 135795 - DNA, 22 bp, Artificial Sequence
  chemically synthesized
tctgattgaaagtccatgttca

SEQ ID NO: 135796 - DNA, 22 bp, Artificial Sequence
  chemically synthesized
ctgattgaaagtccatgttcag

SEQ ID NO: 135797 - DNA, 22 bp, Artificial Sequence
  chemically synthesized
tgattgaaagtccatgttcaga

SEQ ID NO: 135798 - DNA, 22 bp, Artificial Sequence
  chemically synthesized
attgaaagtccatgttcagaac

SEQ ID NO: 135799 - DNA, 22 bp, Artificial Sequence
  chemically synthesized
aaagtccatgttcagaacccag

SEQ ID NO: 135800 - DNA, 22 bp, Artificial Sequence
  chemically synthesized
agaacccagtatataattattc

SEQ ID NO: 135801 - DNA, 22 bp, Artificial Sequence
  chemically synthesized
ttccattctaaattctctctgc

SEQ ID NO: 135802 - DNA, 22 bp, Artificial Sequence
  chemically synthesized
cattctaaattctctctgcttc

SEQ ID NO: 135803 - DNA, 22 bp, Artificial Sequence
  chemically synthesized
taaattctctctgcttcactta

SEQ ID NO: 135804 - DNA, 22 bp, Artificial Sequence
  chemically synthesized
aattctctctgcttcacttaag

SEQ ID NO: 135805 - DNA, 22 bp, Artificial Sequence
  chemically synthesized
tctctgcttcacttaagaaatc

SEQ ID NO: 135806 - DNA, 22 bp, Artificial Sequence
  chemically synthesized
tctgcttcacttaagaaatctt

SEQ ID NO: 135807 - DNA, 22 bp, Artificial Sequence
  chemically synthesized
tgcttcacttaagaaatctttc

SEQ ID NO: 135808 - DNA, 22 bp, Artificial Sequence
  chemically synthesized
cttcacttaagaaatctttcat

SEQ ID NO: 135809 - DNA, 22 bp, Artificial Sequence
  chemically synthesized
cacttaagaaatctttcatatt

SEQ ID NO: 135810 - DNA, 22 bp, Artificial Sequence
  chemically synthesized
acttaagaaatctttcatattt

SEQ ID NO: 135811 - DNA, 22 bp, Artificial Sequence
  chemically synthesized
aagaaatctttcatatttattt

SEQ ID NO: 135812 - DNA, 22 bp, Artificial Sequence
  chemically synthesized
agaaatctttcatatttatttt

SEQ ID NO: 135813 - DNA, 22 bp, Artificial Sequence
  chemically synthesized
tcatatttattttacatctgga

SEQ ID NO: 135814 - DNA, 22 bp, Artificial Sequence
  chemically synthesized
catatttattttacatctggac

SEQ ID NO: 135815 - DNA, 22 bp, Artificial Sequence
  chemically synthesized
atatttattttacatctggaca

SEQ ID NO: 135816 - DNA, 22 bp, Artificial Sequence
  chemically synthesized
attttacatctggacagtgagc

SEQ ID NO: 135817 - DNA, 22 bp, Artificial Sequence
  chemically synthesized
ttttacatctggacagtgagca

SEQ ID NO: 135818 - DNA, 22 bp, Artificial Sequence
  chemically synthesized
tacatctggacagtgagcactc

SEQ ID NO: 135819 - DNA, 22 bp, Artificial Sequence
  chemically synthesized
acatctggacagtgagcactct

SEQ ID NO: 135820 - DNA, 22 bp, Artificial Sequence
  chemically synthesized
catctggacagtgagcactctg

SEQ ID NO: 135821 - DNA, 22 bp, Artificial Sequence
  chemically synthesized
gacagtgagcactctgaaaata

SEQ ID NO: 135822 - DNA, 22 bp, Artificial Sequence
  chemically synthesized
tgaaaatattccagagatttga

SEQ ID NO: 135823 - DNA, 22 bp, Artificial Sequence
  chemically synthesized
aaaatattccagagatttgata

SEQ ID NO: 135824 - DNA, 22 bp, Artificial Sequence
  chemically synthesized
cagagatttgataagaaaatac

SEQ ID NO: 135825 - DNA, 22 bp, Artificial Sequence
  chemically synthesized
gataagaaaatacttactgaaa

SEQ ID NO: 135826 - DNA, 22 bp, Artificial Sequence
  chemically synthesized
ataagaaaatacttactgaaaa

SEQ ID NO: 135827 - DNA, 22 bp, Artificial Sequence
  chemically synthesized
actgaaaactaaagctaaataa

SEQ ID NO: 135828 - DNA, 22 bp, Artificial Sequence
  chemically synthesized
ctgaaaactaaagctaaataat

SEQ ID NO: 135829 - DNA, 22 bp, Artificial Sequence
  chemically synthesized
aaaactaaagctaaataatgca

SEQ ID NO: 135830 - DNA, 22 bp, Artificial Sequence
  chemically synthesized
aagctaaataatgcagtatttc

SEQ ID NO: 135831 - DNA, 22 bp, Artificial Sequence
  chemically synthesized
aataatgcagtatttctccaaa

SEQ ID NO: 135832 - DNA, 22 bp, Artificial Sequence
  chemically synthesized
ctccaaattagaaggcccattt

SEQ ID NO: 135833 - DNA, 22 bp, Artificial Sequence
  chemically synthesized
tccaaattagaaggcccatttg

SEQ ID NO: 135834 - DNA, 22 bp, Artificial Sequence
  chemically synthesized
caaattagaaggcccatttgga

SEQ ID NO: 135835 - DNA, 22 bp, Artificial Sequence
  chemically synthesized
gaaggcccatttggatgcagga

SEQ ID NO: 135836 - DNA, 22 bp, Artificial Sequence
  chemically synthesized
ggatgcaggaaaaataaaaact

SEQ ID NO: 135837 - DNA, 22 bp, Artificial Sequence
  chemically synthesized
gatgcaggaaaaataaaaacta

SEQ ID NO: 135838 - DNA, 22 bp, Artificial Sequence
  chemically synthesized
ataaatgactactcctgaagga

SEQ ID NO: 135839 - DNA, 22 bp, Artificial Sequence
  chemically synthesized
ctcctgaaggattcagttattg

SEQ ID NO: 135840 - DNA, 22 bp, Artificial Sequence
  chemically synthesized
ctgaaggattcagttattgtgc

SEQ ID NO: 135841 - DNA, 22 bp, Artificial Sequence
  chemically synthesized
aaggattcagttattgtgcgaa

SEQ ID NO: 135842 - DNA, 22 bp, Artificial Sequence
  chemically synthesized
agttattgtgcgaattgtttgt

SEQ ID NO: 135843 - DNA, 22 bp, Artificial Sequence
  chemically synthesized
ttgtgcgaattgtttgtgagag

SEQ ID NO: 135844 - DNA, 22 bp, Artificial Sequence
  chemically synthesized
tgcgaattgtttgtgagagttc

SEQ ID NO: 135845 - DNA, 22 bp, Artificial Sequence
  chemically synthesized
tttgtgagagttctttgaaagt

SEQ ID NO: 135846 - DNA, 22 bp, Artificial Sequence
  chemically synthesized
gtgagagttctttgaaagtagg

SEQ ID NO: 135847 - DNA, 22 bp, Artificial Sequence
  chemically synthesized
tgagagttctttgaaagtagga

SEQ ID NO: 135848 - DNA, 22 bp, Artificial Sequence
  chemically synthesized
tttgaaagtaggacgtgggggg

SEQ ID NO: 135849 - DNA, 22 bp, Artificial Sequence
  chemically synthesized
tgaaagtaggacgtggggggtt

SEQ ID NO: 135850 - DNA, 22 bp, Artificial Sequence
  chemically synthesized
gaaagtaggacgtggggggttt

SEQ ID NO: 135851 - DNA, 22 bp, Artificial Sequence
  chemically synthesized
aaagtaggacgtggggggttta

SEQ ID NO: 135852 - DNA, 22 bp, Artificial Sequence
  chemically synthesized
attcattgtcattttagttgtt

SEQ ID NO: 135853 - DNA, 22 bp, Artificial Sequence
  chemically synthesized
ttcattgtcattttagttgtta

SEQ ID NO: 135854 - DNA, 22 bp, Artificial Sequence
  chemically synthesized
attgtcattttagttgttattc

SEQ ID NO: 135855 - DNA, 22 bp, Artificial Sequence
  chemically synthesized
tcattttagttgttattctctg

SEQ ID NO: 135856 - DNA, 22 bp, Artificial Sequence
  chemically synthesized
tagttgttattctctgtgtaaa

SEQ ID NO: 135857 - DNA, 22 bp, Artificial Sequence
  chemically synthesized
agttgttattctctgtgtaaaa

SEQ ID NO: 135858 - DNA, 22 bp, Artificial Sequence
  chemically synthesized
gttgttattctctgtgtaaaat

SEQ ID NO: 135859 - DNA, 22 bp, Artificial Sequence
  chemically synthesized
ttattctctgtgtaaaatttat

SEQ ID NO: 135860 - DNA, 22 bp, Artificial Sequence
  chemically synthesized
ttctctgtgtaaaatttattta

SEQ ID NO: 135861 - DNA, 22 bp, Artificial Sequence
  chemically synthesized
tctgtgtaaaatttatttattt

SEQ ID NO: 135862 - DNA, 22 bp, Artificial Sequence
  chemically synthesized
tgtgtaaaatttatttatttgt

SEQ ID NO: 135863 - DNA, 22 bp, Artificial Sequence
  chemically synthesized
tgtaaaatttatttatttgttt

SEQ ID NO: 135864 - DNA, 22 bp, Artificial Sequence
  chemically synthesized
atttatttgtttttccaaagtt

SEQ ID NO: 135865 - DNA, 22 bp, Artificial Sequence
  chemically synthesized
tttatttgtttttccaaagttg

SEQ ID NO: 135866 - DNA, 22 bp, Artificial Sequence
  chemically synthesized
atttgtttttccaaagttggca

SEQ ID NO: 135867 - DNA, 22 bp, Artificial Sequence
  chemically synthesized
tttgtttttccaaagttggcat

SEQ ID NO: 135868 - DNA, 22 bp, Artificial Sequence
  chemically synthesized
gtttttccaaagttggcataca

SEQ ID NO: 135869 - DNA, 22 bp, Artificial Sequence
  chemically synthesized
tttttccaaagttggcatacag

SEQ ID NO: 135870 - DNA, 22 bp, Artificial Sequence
  chemically synthesized
ttccaaagttggcatacagagt

SEQ ID NO: 135871 - DNA, 22 bp, Artificial Sequence
  chemically synthesized
tccaaagttggcatacagagtt

SEQ ID NO: 135872 - DNA, 22 bp, Artificial Sequence
  chemically synthesized
ccaaagttggcatacagagttt

SEQ ID NO: 135873 - DNA, 22 bp, Artificial Sequence
  chemically synthesized
caaagttggcatacagagttta

SEQ ID NO: 135874 - DNA, 22 bp, Artificial Sequence
  chemically synthesized
gcatacagagtttattctattt

SEQ ID NO: 135875 - DNA, 22 bp, Artificial Sequence
  chemically synthesized
attctatttagaaacgtcgttt

SEQ ID NO: 135876 - DNA, 22 bp, Artificial Sequence
  chemically synthesized
ttctatttagaaacgtcgtttt

SEQ ID NO: 135877 - DNA, 22 bp, Artificial Sequence
  chemically synthesized
tatttagaaacgtcgttttctg

SEQ ID NO: 135878 - DNA, 22 bp, Artificial Sequence
  chemically synthesized
tttagaaacgtcgttttctggt

SEQ ID NO: 135879 - DNA, 22 bp, Artificial Sequence
  chemically synthesized
agaaacgtcgttttctggttgc

SEQ ID NO: 135880 - DNA, 22 bp, Artificial Sequence
  chemically synthesized
gaaacgtcgttttctggttgcc

SEQ ID NO: 135881 - DNA, 22 bp, Artificial Sequence
  chemically synthesized
tctggttgcctttgttgtttgg

SEQ ID NO: 135882 - DNA, 22 bp, Artificial Sequence
  chemically synthesized
ctggttgcctttgttgtttggt

SEQ ID NO: 135883 - DNA, 22 bp, Artificial Sequence
  chemically synthesized
tggttgcctttgttgtttggtc

SEQ ID NO: 135884 - DNA, 22 bp, Artificial Sequence
  chemically synthesized
gttgcctttgttgtttggtcta

SEQ ID NO: 135885 - DNA, 22 bp, Artificial Sequence
  chemically synthesized
cctttgttgtttggtctaaaat

SEQ ID NO: 135886 - DNA, 22 bp, Artificial Sequence
  chemically synthesized
tgttgtttggtctaaaatgcac

SEQ ID NO: 135887 - DNA, 22 bp, Artificial Sequence
  chemically synthesized
gttgtttggtctaaaatgcaca

SEQ ID NO: 135888 - DNA, 22 bp, Artificial Sequence
  chemically synthesized
ttgtttggtctaaaatgcacat

SEQ ID NO: 135889 - DNA, 22 bp, Artificial Sequence
  chemically synthesized
tttggtctaaaatgcacattgt

SEQ ID NO: 135890 - DNA, 22 bp, Artificial Sequence
  chemically synthesized
ggtctaaaatgcacattgtgct

SEQ ID NO: 135891 - DNA, 22 bp, Artificial Sequence
  chemically synthesized
gtctaaaatgcacattgtgcta

SEQ ID NO: 135892 - DNA, 22 bp, Artificial Sequence
  chemically synthesized
aaatgcacattgtgctaacata

SEQ ID NO: 135893 - DNA, 22 bp, Artificial Sequence
  chemically synthesized
tgctaacatacaaactacattt

SEQ ID NO: 135894 - DNA, 22 bp, Artificial Sequence
  chemically synthesized
acatacaaactacatttaggaa

SEQ ID NO: 135895 - DNA, 22 bp, Artificial Sequence
  chemically synthesized
catttaggaaagctgcatctct

SEQ ID NO: 135896 - DNA, 22 bp, Artificial Sequence
  chemically synthesized
aggaaagctgcatctctattga

SEQ ID NO: 135897 - DNA, 22 bp, Artificial Sequence
  chemically synthesized
ggaaagctgcatctctattgac

SEQ ID NO: 135898 - DNA, 22 bp, Artificial Sequence
  chemically synthesized
catctctattgaccactgaaag

SEQ ID NO: 135899 - DNA, 22 bp, Artificial Sequence
  chemically synthesized
tattgaccactgaaaggatgtc

SEQ ID NO: 135900 - DNA, 22 bp, Artificial Sequence
  chemically synthesized
ttgaccactgaaaggatgtctg

SEQ ID NO: 135901 - DNA, 22 bp, Artificial Sequence
  chemically synthesized
accactgaaaggatgtctgtaa

SEQ ID NO: 135902 - DNA, 22 bp, Artificial Sequence
  chemically synthesized
aaaggatgtctgtaagagtaaa

SEQ ID NO: 135903 - DNA, 22 bp, Artificial Sequence
  chemically synthesized
taagagtaaaaaacatagcggt

SEQ ID NO: 135904 - DNA, 22 bp, Artificial Sequence
  chemically synthesized
aaattttcaggcgaataagggt

SEQ ID NO: 135905 - DNA, 22 bp, Artificial Sequence
  chemically synthesized
tcaggcgaataagggttttttg

SEQ ID NO: 135906 - DNA, 22 bp, Artificial Sequence
  chemically synthesized
caggcgaataagggttttttgt

SEQ ID NO: 135907 - DNA, 22 bp, Artificial Sequence
  chemically synthesized
aggcgaataagggttttttgta

SEQ ID NO: 135908 - DNA, 22 bp, Artificial Sequence
  chemically synthesized
tttgtaaaaatggcaaatgtat

SEQ ID NO: 135909 - DNA, 22 bp, Artificial Sequence
  chemically synthesized
ttgtaaaaatggcaaatgtatt

SEQ ID NO: 135910 - DNA, 22 bp, Artificial Sequence
  chemically synthesized
tgtaaaaatggcaaatgtattt

SEQ ID NO: 135911 - DNA, 22 bp, Artificial Sequence
  chemically synthesized
gtaaaaatggcaaatgtatttg

SEQ ID NO: 135912 - DNA, 22 bp, Artificial Sequence
  chemically synthesized
taaaaatggcaaatgtatttgt

SEQ ID NO: 135913 - DNA, 22 bp, Artificial Sequence
  chemically synthesized
gtcagtaggggattgcgatgct

SEQ ID NO: 135914 - DNA, 22 bp, Artificial Sequence
  chemically synthesized
tcagtaggggattgcgatgctg

SEQ ID NO: 135915 - DNA, 22 bp, Artificial Sequence
  chemically synthesized
cgatgctgttttcttgattgtt

SEQ ID NO: 135916 - DNA, 22 bp, Artificial Sequence
  chemically synthesized
ttttcttgattgttataagaag

SEQ ID NO: 135917 - DNA, 22 bp, Artificial Sequence
  chemically synthesized
tcttgattgttataagaagaca

SEQ ID NO: 135918 - DNA, 22 bp, Artificial Sequence
  chemically synthesized
cttgattgttataagaagacag

SEQ ID NO: 135919 - DNA, 22 bp, Artificial Sequence
  chemically synthesized
ttgattgttataagaagacagc

SEQ ID NO: 135920 - DNA, 22 bp, Artificial Sequence
  chemically synthesized
gattgttataagaagacagcct

SEQ ID NO: 135921 - DNA, 22 bp, Artificial Sequence
  chemically synthesized
attgttataagaagacagccta

SEQ ID NO: 135922 - DNA, 22 bp, Artificial Sequence
  chemically synthesized
ttataagaagacagcctacaac

SEQ ID NO: 135923 - DNA, 22 bp, Artificial Sequence
  chemically synthesized
taagaagacagcctacaacaat

SEQ ID NO: 135924 - DNA, 22 bp, Artificial Sequence
  chemically synthesized
caacaatgtgtaaatgtgtaat

SEQ ID NO: 135925 - DNA, 22 bp, Artificial Sequence
  chemically synthesized
aggggcgatgtgctgaaaataa

SEQ ID NO: 135926 - DNA, 22 bp, Artificial Sequence
  chemically synthesized
ggggcgatgtgctgaaaataag

SEQ ID NO: 135927 - DNA, 22 bp, Artificial Sequence
  chemically synthesized
aaaataaggtatgatagcgaag

SEQ ID NO: 135928 - DNA, 22 bp, Artificial Sequence
  chemically synthesized
agaaacagaggtatctaattat

SEQ ID NO: 135929 - DNA, 22 bp, Artificial Sequence
  chemically synthesized
attataaataagaagaagtggg

SEQ ID NO: 135930 - DNA, 22 bp, Artificial Sequence
  chemically synthesized
taaataagaagaagtgggaaga

SEQ ID NO: 135931 - DNA, 22 bp, Artificial Sequence
  chemically synthesized
agagctcaagtttactcatatg

SEQ ID NO: 135932 - DNA, 22 bp, Artificial Sequence
  chemically synthesized
aagtttactcatatgttagcaa

SEQ ID NO: 135933 - DNA, 22 bp, Artificial Sequence
  chemically synthesized
actcatatgttagcaagggatg

SEQ ID NO: 135934 - DNA, 22 bp, Artificial Sequence
  chemically synthesized
ctcatatgttagcaagggatga

SEQ ID NO: 135935 - DNA, 22 bp, Artificial Sequence
  chemically synthesized
atatgttagcaagggatgacat

SEQ ID NO: 135936 - DNA, 22 bp, Artificial Sequence
  chemically synthesized
gcaagggatgacataatatgat

SEQ ID NO: 135937 - DNA, 22 bp, Artificial Sequence
  chemically synthesized
tagcctattgatctttaaacag

SEQ ID NO: 135938 - DNA, 22 bp, Artificial Sequence
  chemically synthesized
ttgatctttaaacagcctgtat

SEQ ID NO: 135939 - DNA, 22 bp, Artificial Sequence
  chemically synthesized
atctttaaacagcctgtatcaa

SEQ ID NO: 135940 - DNA, 22 bp, Artificial Sequence
  chemically synthesized
taaacagcctgtatcaatagtc

SEQ ID NO: 135941 - DNA, 22 bp, Artificial Sequence
  chemically synthesized
aaacagcctgtatcaatagtca

SEQ ID NO: 135942 - DNA, 22 bp, Artificial Sequence
  chemically synthesized
aacagcctgtatcaatagtcaa

SEQ ID NO: 135943 - DNA, 22 bp, Artificial Sequence
  chemically synthesized
tatcaatagtcaaaaatcaatt

SEQ ID NO: 135944 - DNA, 22 bp, Artificial Sequence
  chemically synthesized
aaaaggataaattttaaaaatc

SEQ ID NO: 135945 - DNA, 22 bp, Artificial Sequence
  chemically synthesized
taaaaatcactcattttcttaa

SEQ ID NO: 135946 - DNA, 22 bp, Artificial Sequence
  chemically synthesized
aaaaatcactcattttcttaag

SEQ ID NO: 135947 - DNA, 22 bp, Artificial Sequence
  chemically synthesized
aaaatcactcattttcttaagt

SEQ ID NO: 135948 - DNA, 22 bp, Artificial Sequence
  chemically synthesized
attttcttaagtaaatgtatat

SEQ ID NO: 135949 - DNA, 22 bp, Artificial Sequence
  chemically synthesized
tcttaagtaaatgtatatttat

SEQ ID NO: 135950 - DNA, 22 bp, Artificial Sequence
  chemically synthesized
cttaagtaaatgtatatttatg

SEQ ID NO: 135951 - DNA, 22 bp, Artificial Sequence
  chemically synthesized
ttaagtaaatgtatatttatgc

SEQ ID NO: 135952 - DNA, 22 bp, Artificial Sequence
  chemically synthesized
aagtaaatgtatatttatgcgt

SEQ ID NO: 135953 - DNA, 22 bp, Artificial Sequence
  chemically synthesized
agtaaatgtatatttatgcgtt

SEQ ID NO: 135954 - DNA, 22 bp, Artificial Sequence
  chemically synthesized
atgcgttttaattttaattata

SEQ ID NO: 135955 - DNA, 22 bp, Artificial Sequence
  chemically synthesized
tgcgttttaattttaattatat

SEQ ID NO: 135956 - DNA, 22 bp, Artificial Sequence
  chemically synthesized
taattttaattatattcataac

SEQ ID NO: 135957 - DNA, 22 bp, Artificial Sequence
  chemically synthesized
aattttaattatattcataacc

SEQ ID NO: 135958 - DNA, 22 bp, Artificial Sequence
  chemically synthesized
attttaattatattcataacct

SEQ ID NO: 135959 - DNA, 22 bp, Artificial Sequence
  chemically synthesized
taattatattcataacctatat

SEQ ID NO: 135960 - DNA, 22 bp, Artificial Sequence
  chemically synthesized
aattatattcataacctatata

SEQ ID NO: 135961 - DNA, 22 bp, Artificial Sequence
  chemically synthesized
attatattcataacctatatat

SEQ ID NO: 135962 - DNA, 22 bp, Artificial Sequence
  chemically synthesized
tattcataacctatatattata

SEQ ID NO: 135963 - DNA, 22 bp, Artificial Sequence
  chemically synthesized
ataacctatatattatatttta

SEQ ID NO: 135964 - DNA, 22 bp, Artificial Sequence
  chemically synthesized
tatattatattttacaacttct

SEQ ID NO: 135965 - DNA, 22 bp, Artificial Sequence
  chemically synthesized
tattttacaacttcttagtttg

SEQ ID NO: 135966 - DNA, 22 bp, Artificial Sequence
  chemically synthesized
tacaacttcttagtttgaaaat

SEQ ID NO: 135967 - DNA, 22 bp, Artificial Sequence
  chemically synthesized
acaacttcttagtttgaaaatc

SEQ ID NO: 135968 - DNA, 22 bp, Artificial Sequence
  chemically synthesized
caacttcttagtttgaaaatcc

SEQ ID NO: 135969 - DNA, 22 bp, Artificial Sequence
  chemically synthesized
cttagtttgaaaatcctttcaa

SEQ ID NO: 135970 - DNA, 22 bp, Artificial Sequence
  chemically synthesized
ttagtttgaaaatcctttcaat

SEQ ID NO: 135971 - DNA, 22 bp, Artificial Sequence
  chemically synthesized
agtttgaaaatcctttcaatta

SEQ ID NO: 135972 - DNA, 22 bp, Artificial Sequence
  chemically synthesized
gtttgaaaatcctttcaattat

SEQ ID NO: 135973 - DNA, 22 bp, Artificial Sequence
  chemically synthesized
gaaaatcctttcaattattaag

SEQ ID NO: 135974 - DNA, 22 bp, Artificial Sequence
  chemically synthesized
aaaatcctttcaattattaagt

SEQ ID NO: 135975 - DNA, 22 bp, Artificial Sequence
  chemically synthesized
tcaattattaagtcagcatcca

SEQ ID NO: 135976 - DNA, 22 bp, Artificial Sequence
  chemically synthesized
caattattaagtcagcatccac

SEQ ID NO: 135977 - DNA, 22 bp, Artificial Sequence
  chemically synthesized
aattattaagtcagcatccacc

SEQ ID NO: 135978 - DNA, 22 bp, Artificial Sequence
  chemically synthesized
ttaagtcagcatccacctgctg

SEQ ID NO: 135979 - DNA, 22 bp, Artificial Sequence
  chemically synthesized
agtcagcatccacctgctgatc

SEQ ID NO: 135980 - DNA, 22 bp, Artificial Sequence
  chemically synthesized
ctgatccagtgatatataagga

SEQ ID NO: 135981 - DNA, 22 bp, Artificial Sequence
  chemically synthesized
atccagtgatatataaggacat

SEQ ID NO: 135982 - DNA, 22 bp, Artificial Sequence
  chemically synthesized
attgcaccactgaagtaaaatc

SEQ ID NO: 135983 - DNA, 22 bp, Artificial Sequence
  chemically synthesized
ttgcaccactgaagtaaaatca

SEQ ID NO: 135984 - DNA, 22 bp, Artificial Sequence
  chemically synthesized
caccactgaagtaaaatcagtg

SEQ ID NO: 135985 - DNA, 22 bp, Artificial Sequence
  chemically synthesized
aagtaaaatcagtgtcctttca

SEQ ID NO: 135986 - DNA, 22 bp, Artificial Sequence
  chemically synthesized
tcaaacaagtgcagcttccaga

SEQ ID NO: 135987 - DNA, 22 bp, Artificial Sequence
  chemically synthesized
caaacaagtgcagcttccagac

SEQ ID NO: 135988 - DNA, 22 bp, Artificial Sequence
  chemically synthesized
aaacaagtgcagcttccagaca

SEQ ID NO: 135989 - DNA, 22 bp, Artificial Sequence
  chemically synthesized
ccagacaagtctcttagacctc

SEQ ID NO: 135990 - DNA, 22 bp, Artificial Sequence
  chemically synthesized
cagacaagtctcttagacctca

SEQ ID NO: 135991 - DNA, 22 bp, Artificial Sequence
  chemically synthesized
ttagacctcatcctcagtctca

SEQ ID NO: 135992 - DNA, 22 bp, Artificial Sequence
  chemically synthesized
agacctcatcctcagtctcacc

SEQ ID NO: 135993 - DNA, 22 bp, Artificial Sequence
  chemically synthesized
gacctcatcctcagtctcaccc

SEQ ID NO: 135994 - DNA, 22 bp, Artificial Sequence
  chemically synthesized
atcctcagtctcaccctgactg

SEQ ID NO: 135995 - DNA, 22 bp, Artificial Sequence
  chemically synthesized
agtctcaccctgactgacaagt

SEQ ID NO: 135996 - DNA, 22 bp, Artificial Sequence
  chemically synthesized
accctgactgacaagtttgcca

SEQ ID NO: 135997 - DNA, 22 bp, Artificial Sequence
  chemically synthesized
actgacaagtttgccatacttg

SEQ ID NO: 135998 - DNA, 22 bp, Artificial Sequence
  chemically synthesized
acaagtttgccatacttgagaa

SEQ ID NO: 135999 - DNA, 22 bp, Artificial Sequence
  chemically synthesized
gccatacttgagaaccttgtga

SEQ ID NO: 136000 - DNA, 22 bp, Artificial Sequence
  chemically synthesized
ccatacttgagaaccttgtgaa

SEQ ID NO: 136001 - DNA, 22 bp, Artificial Sequence
  chemically synthesized
gagaaccttgtgaagcaggcgt

SEQ ID NO: 136002 - DNA, 22 bp, Artificial Sequence
  chemically synthesized
agaaccttgtgaagcaggcgtt

SEQ ID NO: 136003 - DNA, 22 bp, Artificial Sequence
  chemically synthesized
gtgaagcaggcgttgtgtctat

SEQ ID NO: 136004 - DNA, 22 bp, Artificial Sequence
  chemically synthesized
tgaagcaggcgttgtgtctata

SEQ ID NO: 136005 - DNA, 22 bp, Artificial Sequence
  chemically synthesized
tgtctataagctctcttagaga

SEQ ID NO: 136006 - DNA, 22 bp, Artificial Sequence
  chemically synthesized
taagctctcttagagatctgct

SEQ ID NO: 136007 - DNA, 22 bp, Artificial Sequence
  chemically synthesized
tcttagagatctgctctgagga

SEQ ID NO: 136008 - DNA, 22 bp, Artificial Sequence
  chemically synthesized
ttagagatctgctctgaggaat

SEQ ID NO: 136009 - DNA, 22 bp, Artificial Sequence
  chemically synthesized
agagatctgctctgaggaatta

SEQ ID NO: 136010 - DNA, 22 bp, Artificial Sequence
  chemically synthesized
gagatctgctctgaggaattat

SEQ ID NO: 136011 - DNA, 22 bp, Artificial Sequence
  chemically synthesized
ctctgaggaattatcaagtcag

SEQ ID NO: 136012 - DNA, 22 bp, Artificial Sequence
  chemically synthesized
tgaggaattatcaagtcagcac

SEQ ID NO: 136013 - DNA, 22 bp, Artificial Sequence
  chemically synthesized
aggaattatcaagtcagcacag

SEQ ID NO: 136014 - DNA, 22 bp, Artificial Sequence
  chemically synthesized
tcaagtcagcacagttaattct

SEQ ID NO: 136015 - DNA, 22 bp, Artificial Sequence
  chemically synthesized
attctctgtcatactgtgagtt

SEQ ID NO: 136016 - DNA, 22 bp, Artificial Sequence
  chemically synthesized
tctgtcatactgtgagtttagt

SEQ ID NO: 136017 - DNA, 22 bp, Artificial Sequence
  chemically synthesized
tgtcatactgtgagtttagtca

SEQ ID NO: 136018 - DNA, 22 bp, Artificial Sequence
  chemically synthesized
tcatactgtgagtttagtcagg

SEQ ID NO: 136019 - DNA, 22 bp, Artificial Sequence
  chemically synthesized
tgagtttagtcagggcagtaat

SEQ ID NO: 136020 - DNA, 22 bp, Artificial Sequence
  chemically synthesized
agtcagggcagtaattatattt

SEQ ID NO: 136021 - DNA, 22 bp, Artificial Sequence
  chemically synthesized
gtcagggcagtaattatatttc

SEQ ID NO: 136022 - DNA, 22 bp, Artificial Sequence
  chemically synthesized
tatttccccatcagcatattgt

SEQ ID NO: 136023 - DNA, 22 bp, Artificial Sequence
  chemically synthesized
ccccatcagcatattgtcttcc

SEQ ID NO: 136024 - DNA, 22 bp, Artificial Sequence
  chemically synthesized
cccatcagcatattgtcttccc

SEQ ID NO: 136025 - DNA, 22 bp, Artificial Sequence
  chemically synthesized
tcttcccaaggataactacctg

SEQ ID NO: 136026 - DNA, 22 bp, Artificial Sequence
  chemically synthesized
cccaaggataactacctgccat

SEQ ID NO: 136027 - DNA, 22 bp, Artificial Sequence
  chemically synthesized
ccaaggataactacctgccatt

SEQ ID NO: 136028 - DNA, 22 bp, Artificial Sequence
  chemically synthesized
cctgccattctgtaaaccccca

SEQ ID NO: 136029 - DNA, 22 bp, Artificial Sequence
  chemically synthesized
ccattctgtaaacccccaaatt

SEQ ID NO: 136030 - DNA, 22 bp, Artificial Sequence
  chemically synthesized
tgtaaacccccaaatttattaa

SEQ ID NO: 136031 - DNA, 22 bp, Artificial Sequence
  chemically synthesized
taaacccccaaatttattaatg

SEQ ID NO: 136032 - DNA, 22 bp, Artificial Sequence
  chemically synthesized
attaatgcagtcctttaaaaat

SEQ ID NO: 136033 - DNA, 22 bp, Artificial Sequence
  chemically synthesized
ttaatgcagtcctttaaaaata

SEQ ID NO: 136034 - DNA, 22 bp, Artificial Sequence
  chemically synthesized
atgcagtcctttaaaaatacac

SEQ ID NO: 136035 - DNA, 22 bp, Artificial Sequence
  chemically synthesized
taaaaatacacaatgttacttg

SEQ ID NO: 136036 - DNA, 22 bp, Artificial Sequence
  chemically synthesized
aaaaatacacaatgttacttgt

SEQ ID NO: 136037 - DNA, 22 bp, Artificial Sequence
  chemically synthesized
aaaatacacaatgttacttgtc

SEQ ID NO: 136038 - DNA, 22 bp, Artificial Sequence
  chemically synthesized
cttgtctggtgtggctaaagct

SEQ ID NO: 136039 - DNA, 22 bp, Artificial Sequence
  chemically synthesized
gtctggtgtggctaaagcttat

SEQ ID NO: 136040 - DNA, 22 bp, Artificial Sequence
  chemically synthesized
tctggtgtggctaaagcttatt

SEQ ID NO: 136041 - DNA, 22 bp, Artificial Sequence
  chemically synthesized
gtgtggctaaagcttatttatt

SEQ ID NO: 136042 - DNA, 22 bp, Artificial Sequence
  chemically synthesized
aagcttatttatttatttattt

SEQ ID NO: 136043 - DNA, 22 bp, Artificial Sequence
  chemically synthesized
atttatttatttatttatttat

SEQ ID NO: 136044 - DNA, 22 bp, Artificial Sequence
  chemically synthesized
tttatttatttatttatttatt

SEQ ID NO: 136045 - DNA, 22 bp, Artificial Sequence
  chemically synthesized
atttatttatttatttattttt

SEQ ID NO: 136046 - DNA, 22 bp, Artificial Sequence
  chemically synthesized
tttatttatttatttattttta

SEQ ID NO: 136047 - DNA, 22 bp, Artificial Sequence
  chemically synthesized
atttatttatttatttttatag

SEQ ID NO: 136048 - DNA, 22 bp, Artificial Sequence
  chemically synthesized
tttatttatttatttttataga

SEQ ID NO: 136049 - DNA, 22 bp, Artificial Sequence
  chemically synthesized
atttatttatttttatagacat

SEQ ID NO: 136050 - DNA, 22 bp, Artificial Sequence
  chemically synthesized
tttatttatttttatagacatg

SEQ ID NO: 136051 - DNA, 22 bp, Artificial Sequence
  chemically synthesized
atttatttttatagacatgatc

SEQ ID NO: 136052 - DNA, 22 bp, Artificial Sequence
  chemically synthesized
tttatttttatagacatgatct

SEQ ID NO: 136053 - DNA, 22 bp, Artificial Sequence
  chemically synthesized
atttttatagacatgatcttgc

SEQ ID NO: 136054 - DNA, 22 bp, Artificial Sequence
  chemically synthesized
tttttatagacatgatcttgct

SEQ ID NO: 136055 - DNA, 22 bp, Artificial Sequence
  chemically synthesized
ttatagacatgatcttgctctg

SEQ ID NO: 136056 - DNA, 22 bp, Artificial Sequence
  chemically synthesized
tatagacatgatcttgctctgt

SEQ ID NO: 136057 - DNA, 22 bp, Artificial Sequence
  chemically synthesized
atagacatgatcttgctctgtt

SEQ ID NO: 136058 - DNA, 22 bp, Artificial Sequence
  chemically synthesized
tagacatgatcttgctctgttg

SEQ ID NO: 136059 - DNA, 22 bp, Artificial Sequence
  chemically synthesized
gctctgttgcccaggctggagt

SEQ ID NO: 136060 - DNA, 22 bp, Artificial Sequence
  chemically synthesized
ctctgttgcccaggctggagtg

SEQ ID NO: 136061 - DNA, 22 bp, Artificial Sequence
  chemically synthesized
tgttgcccaggctggagtgcag

SEQ ID NO: 136062 - DNA, 22 bp, Artificial Sequence
  chemically synthesized
ttgcccaggctggagtgcagtg

SEQ ID NO: 136063 - DNA, 22 bp, Artificial Sequence
  chemically synthesized
cccaggctggagtgcagtggtg

SEQ ID NO: 136064 - DNA, 22 bp, Artificial Sequence
  chemically synthesized
gagtgcagtggtgccatcacag

SEQ ID NO: 136065 - DNA, 22 bp, Artificial Sequence
  chemically synthesized
actgcagccttgaaatcctggg

SEQ ID NO: 136066 - DNA, 22 bp, Artificial Sequence
  chemically synthesized
cagccttgaaatcctgggctca

SEQ ID NO: 136067 - DNA, 22 bp, Artificial Sequence
  chemically synthesized
gaaatcctgggctcaagcaatc

SEQ ID NO: 136068 - DNA, 22 bp, Artificial Sequence
  chemically synthesized
aaatcctgggctcaagcaatcc

SEQ ID NO: 136069 - DNA, 22 bp, Artificial Sequence
  chemically synthesized
ggctcaagcaatccttcttcct

SEQ ID NO: 136070 - DNA, 22 bp, Artificial Sequence
  chemically synthesized
aagcaatccttcttcctcagct

SEQ ID NO: 136071 - DNA, 22 bp, Artificial Sequence
  chemically synthesized
cttcctcagctttttgagtacc

SEQ ID NO: 136072 - DNA, 22 bp, Artificial Sequence
  chemically synthesized
ttcctcagctttttgagtacct

SEQ ID NO: 136073 - DNA, 22 bp, Artificial Sequence
  chemically synthesized
cctcagctttttgagtacctag

SEQ ID NO: 136074 - DNA, 22 bp, Artificial Sequence
  chemically synthesized
ctcagctttttgagtacctagg

SEQ ID NO: 136075 - DNA, 22 bp, Artificial Sequence
  chemically synthesized
agctttttgagtacctaggact

SEQ ID NO: 136076 - DNA, 22 bp, Artificial Sequence
  chemically synthesized
tttgagtacctaggactacagg

SEQ ID NO: 136077 - DNA, 22 bp, Artificial Sequence
  chemically synthesized
ttgagtacctaggactacaggt

SEQ ID NO: 136078 - DNA, 22 bp, Artificial Sequence
  chemically synthesized
tgagtacctaggactacaggtt

SEQ ID NO: 136079 - DNA, 22 bp, Artificial Sequence
  chemically synthesized
gagtacctaggactacaggttt

SEQ ID NO: 136080 - DNA, 22 bp, Artificial Sequence
  chemically synthesized
agtacctaggactacaggttta

SEQ ID NO: 136081 - DNA, 22 bp, Artificial Sequence
  chemically synthesized
ggactacaggtttatgccactg

SEQ ID NO: 136082 - DNA, 22 bp, Artificial Sequence
  chemically synthesized
caggtttatgccactgcaccta

SEQ ID NO: 136083 - DNA, 22 bp, Artificial Sequence
  chemically synthesized
atgccactgcacctagctaatg

SEQ ID NO: 136084 - DNA, 22 bp, Artificial Sequence
  chemically synthesized
tgccactgcacctagctaatgt

SEQ ID NO: 136085 - DNA, 22 bp, Artificial Sequence
  chemically synthesized
cacctagctaatgtttttattt

SEQ ID NO: 136086 - DNA, 22 bp, Artificial Sequence
  chemically synthesized
gctaatgtttttattttttgta

SEQ ID NO: 136087 - DNA, 22 bp, Artificial Sequence
  chemically synthesized
atgtttttattttttgtaaata

SEQ ID NO: 136088 - DNA, 22 bp, Artificial Sequence
  chemically synthesized
ttattttttgtaaatatgggat

SEQ ID NO: 136089 - DNA, 22 bp, Artificial Sequence
  chemically synthesized
tattttttgtaaatatgggatc

SEQ ID NO: 136090 - DNA, 22 bp, Artificial Sequence
  chemically synthesized
attttttgtaaatatgggatca

SEQ ID NO: 136091 - DNA, 22 bp, Artificial Sequence
  chemically synthesized
ttttttgtaaatatgggatcat

SEQ ID NO: 136092 - DNA, 22 bp, Artificial Sequence
  chemically synthesized
tttgtaaatatgggatcatgtt

SEQ ID NO: 136093 - DNA, 22 bp, Artificial Sequence
  chemically synthesized
ttgtaaatatgggatcatgtta

SEQ ID NO: 136094 - DNA, 22 bp, Artificial Sequence
  chemically synthesized
tgtaaatatgggatcatgttat

SEQ ID NO: 136095 - DNA, 22 bp, Artificial Sequence
  chemically synthesized
gtaaatatgggatcatgttatg

SEQ ID NO: 136096 - DNA, 22 bp, Artificial Sequence
  chemically synthesized
taaatatgggatcatgttatgt

SEQ ID NO: 136097 - DNA, 22 bp, Artificial Sequence
  chemically synthesized
tgttgccgaggctgctctccaa

SEQ ID NO: 136098 - DNA, 22 bp, Artificial Sequence
  chemically synthesized
ccgaggctgctctccaattcct

SEQ ID NO: 136099 - DNA, 22 bp, Artificial Sequence
  chemically synthesized
ctctccaattcctaacctcaag

SEQ ID NO: 136100 - DNA, 22 bp, Artificial Sequence
  chemically synthesized
tccaattcctaacctcaagcaa

SEQ ID NO: 136101 - DNA, 22 bp, Artificial Sequence
  chemically synthesized
caattcctaacctcaagcaatc

SEQ ID NO: 136102 - DNA, 22 bp, Artificial Sequence
  chemically synthesized
ctaacctcaagcaatcctccca

SEQ ID NO: 136103 - DNA, 22 bp, Artificial Sequence
  chemically synthesized
acctcaagcaatcctcccaccc

SEQ ID NO: 136104 - DNA, 22 bp, Artificial Sequence
  chemically synthesized
aagcaatcctcccaccctggcc

SEQ ID NO: 136105 - DNA, 22 bp, Artificial Sequence
  chemically synthesized
ccaccctggcctcctaatgata

SEQ ID NO: 136106 - DNA, 22 bp, Artificial Sequence
  chemically synthesized
gcctcctaatgatagggacagg

SEQ ID NO: 136107 - DNA, 22 bp, Artificial Sequence
  chemically synthesized
ctaatgatagggacaggaggca

SEQ ID NO: 136108 - DNA, 22 bp, Artificial Sequence
  chemically synthesized
atgatagggacaggaggcagag

SEQ ID NO: 136109 - DNA, 22 bp, Artificial Sequence
  chemically synthesized
taggcagaaaagggcggggtcc

SEQ ID NO: 136110 - DNA, 22 bp, Artificial Sequence
  chemically synthesized
aggcagaaaagggcggggtccc

SEQ ID NO: 136111 - DNA, 22 bp, Artificial Sequence
  chemically synthesized
ggcagaaaagggcggggtccct

SEQ ID NO: 136112 - DNA, 22 bp, Artificial Sequence
  chemically synthesized
gcatgggtcctaccctgaagcc

SEQ ID NO: 136113 - DNA, 22 bp, Artificial Sequence
  chemically synthesized
ccctgaagcctggaacatggcc

SEQ ID NO: 136114 - DNA, 22 bp, Artificial Sequence
  chemically synthesized
aagcctggaacatggccattcc

SEQ ID NO: 136115 - DNA, 22 bp, Artificial Sequence
  chemically synthesized
gaacatggccattcctgagata

SEQ ID NO: 136116 - DNA, 22 bp, Artificial Sequence
  chemically synthesized
ctgagatatttctctcagccag

SEQ ID NO: 136117 - DNA, 22 bp, Artificial Sequence
  chemically synthesized
agatatttctctcagccagaac

SEQ ID NO: 136118 - DNA, 22 bp, Artificial Sequence
  chemically synthesized
ctctcagccagaactgtttcac

SEQ ID NO: 136119 - DNA, 22 bp, Artificial Sequence
  chemically synthesized
tctcagccagaactgtttcaca

SEQ ID NO: 136120 - DNA, 22 bp, Artificial Sequence
  chemically synthesized
tcagccagaactgtttcacatt

SEQ ID NO: 136121 - DNA, 22 bp, Artificial Sequence
  chemically synthesized
agccagaactgtttcacattca

SEQ ID NO: 136122 - DNA, 22 bp, Artificial Sequence
  chemically synthesized
tttcacattcacattttaagtg

SEQ ID NO: 136123 - DNA, 22 bp, Artificial Sequence
  chemically synthesized
cacattcacattttaagtgcca

SEQ ID NO: 136124 - DNA, 22 bp, Artificial Sequence
  chemically synthesized
acattcacattttaagtgccag

SEQ ID NO: 136125 - DNA, 22 bp, Artificial Sequence
  chemically synthesized
acattttaagtgccaggtcttt

SEQ ID NO: 136126 - DNA, 22 bp, Artificial Sequence
  chemically synthesized
taagtgccaggtctttctatct

SEQ ID NO: 136127 - DNA, 22 bp, Artificial Sequence
  chemically synthesized
aagtgccaggtctttctatctt

SEQ ID NO: 136128 - DNA, 22 bp, Artificial Sequence
  chemically synthesized
agtgccaggtctttctatcttt

SEQ ID NO: 136129 - DNA, 22 bp, Artificial Sequence
  chemically synthesized
tctatctttctagctgtcttat

SEQ ID NO: 136130 - DNA, 22 bp, Artificial Sequence
  chemically synthesized
ctatctttctagctgtcttatt

SEQ ID NO: 136131 - DNA, 22 bp, Artificial Sequence
  chemically synthesized
tatctttctagctgtcttattc

SEQ ID NO: 136132 - DNA, 22 bp, Artificial Sequence
  chemically synthesized
tctttctagctgtcttattcat

SEQ ID NO: 136133 - DNA, 22 bp, Artificial Sequence
  chemically synthesized
tctagctgtcttattcatgcac

SEQ ID NO: 136134 - DNA, 22 bp, Artificial Sequence
  chemically synthesized
ctagctgtcttattcatgcact

SEQ ID NO: 136135 - DNA, 22 bp, Artificial Sequence
  chemically synthesized
tagctgtcttattcatgcactt

SEQ ID NO: 136136 - DNA, 22 bp, Artificial Sequence
  chemically synthesized
gctgtcttattcatgcactttc

SEQ ID NO: 136137 - DNA, 22 bp, Artificial Sequence
  chemically synthesized
tcttattcatgcactttctaga

SEQ ID NO: 136138 - DNA, 22 bp, Artificial Sequence
  chemically synthesized
attcatgcactttctagaaatc

SEQ ID NO: 136139 - DNA, 22 bp, Artificial Sequence
  chemically synthesized
ttcatgcactttctagaaatca

SEQ ID NO: 136140 - DNA, 22 bp, Artificial Sequence
  chemically synthesized
atgcactttctagaaatcactt

SEQ ID NO: 136141 - DNA, 22 bp, Artificial Sequence
  chemically synthesized
tctagaaatcacttgtatatta

SEQ ID NO: 136142 - DNA, 22 bp, Artificial Sequence
  chemically synthesized
ctagaaatcacttgtatattaa

SEQ ID NO: 136143 - DNA, 22 bp, Artificial Sequence
  chemically synthesized
tagaaatcacttgtatattaac

SEQ ID NO: 136144 - DNA, 22 bp, Artificial Sequence
  chemically synthesized
gaaatcacttgtatattaacat

SEQ ID NO: 136145 - DNA, 22 bp, Artificial Sequence
  chemically synthesized
gtatattaacatgcctatatta

SEQ ID NO: 136146 - DNA, 22 bp, Artificial Sequence
  chemically synthesized
tatattaacatgcctatattat

SEQ ID NO: 136147 - DNA, 22 bp, Artificial Sequence
  chemically synthesized
acatgcctatattatatttaca

SEQ ID NO: 136148 - DNA, 22 bp, Artificial Sequence
  chemically synthesized
tattatatttacattcccttca

SEQ ID NO: 136149 - DNA, 22 bp, Artificial Sequence
  chemically synthesized
tatttacattcccttcatttct

SEQ ID NO: 136150 - DNA, 22 bp, Artificial Sequence
  chemically synthesized
acattcccttcatttctttatt

SEQ ID NO: 136151 - DNA, 22 bp, Artificial Sequence
  chemically synthesized
cattcccttcatttctttattc

SEQ ID NO: 136152 - DNA, 22 bp, Artificial Sequence
  chemically synthesized
ccttcatttctttattctctgt

SEQ ID NO: 136153 - DNA, 22 bp, Artificial Sequence
  chemically synthesized
catttctttattctctgtttgt

SEQ ID NO: 136154 - DNA, 22 bp, Artificial Sequence
  chemically synthesized
atttctttattctctgtttgtc

SEQ ID NO: 136155 - DNA, 22 bp, Artificial Sequence
  chemically synthesized
ctttattctctgtttgtctcat

SEQ ID NO: 136156 - DNA, 22 bp, Artificial Sequence
  chemically synthesized
tttattctctgtttgtctcatg

SEQ ID NO: 136157 - DNA, 22 bp, Artificial Sequence
  chemically synthesized
tattctctgtttgtctcatgaa

SEQ ID NO: 136158 - DNA, 22 bp, Artificial Sequence
  chemically synthesized
attctctgtttgtctcatgaat

SEQ ID NO: 136159 - DNA, 22 bp, Artificial Sequence
  chemically synthesized
ttctctgtttgtctcatgaata

SEQ ID NO: 136160 - DNA, 22 bp, Artificial Sequence
  chemically synthesized
tctgtttgtctcatgaatattc

SEQ ID NO: 136161 - DNA, 22 bp, Artificial Sequence
  chemically synthesized
tgtttgtctcatgaatattccc

SEQ ID NO: 136162 - DNA, 22 bp, Artificial Sequence
  chemically synthesized
tttgtctcatgaatattccctc

SEQ ID NO: 136163 - DNA, 22 bp, Artificial Sequence
  chemically synthesized
gtctcatgaatattccctcagg

SEQ ID NO: 136164 - DNA, 22 bp, Artificial Sequence
  chemically synthesized
tctcatgaatattccctcagga

SEQ ID NO: 136165 - DNA, 22 bp, Artificial Sequence
  chemically synthesized
atgaatattccctcaggaaaca

SEQ ID NO: 136166 - DNA, 22 bp, Artificial Sequence
  chemically synthesized
cctcaggaaacaccctcccacg

SEQ ID NO: 136167 - DNA, 22 bp, Artificial Sequence
  chemically synthesized
aggaaacaccctcccacgccgt

SEQ ID NO: 136168 - DNA, 22 bp, Artificial Sequence
  chemically synthesized
ccacgccgttccctttatctag

SEQ ID NO: 136169 - DNA, 22 bp, Artificial Sequence
  chemically synthesized
cctttatctagcttcttattca

SEQ ID NO: 136170 - DNA, 22 bp, Artificial Sequence
  chemically synthesized
tatctagcttcttattcattcc

SEQ ID NO: 136171 - DNA, 22 bp, Artificial Sequence
  chemically synthesized
atctagcttcttattcattcct

SEQ ID NO: 136172 - DNA, 22 bp, Artificial Sequence
  chemically synthesized
tctagcttcttattcattcctc

SEQ ID NO: 136173 - DNA, 22 bp, Artificial Sequence
  chemically synthesized
gcttcttattcattcctcttgc

SEQ ID NO: 136174 - DNA, 22 bp, Artificial Sequence
  chemically synthesized
cttattcattcctcttgctgta

SEQ ID NO: 136175 - DNA, 22 bp, Artificial Sequence
  chemically synthesized
ttattcattcctcttgctgtac

SEQ ID NO: 136176 - DNA, 22 bp, Artificial Sequence
  chemically synthesized
attcattcctcttgctgtactg

SEQ ID NO: 136177 - DNA, 22 bp, Artificial Sequence
  chemically synthesized
ttcattcctcttgctgtactga

SEQ ID NO: 136178 - DNA, 22 bp, Artificial Sequence
  chemically synthesized
attcctcttgctgtactgatta

SEQ ID NO: 136179 - DNA, 22 bp, Artificial Sequence
  chemically synthesized
ctcttgctgtactgattagcct

SEQ ID NO: 136180 - DNA, 22 bp, Artificial Sequence
  chemically synthesized
ttgctgtactgattagccttga

SEQ ID NO: 136181 - DNA, 22 bp, Artificial Sequence
  chemically synthesized
gctgtactgattagccttgact

SEQ ID NO: 136182 - DNA, 22 bp, Artificial Sequence
  chemically synthesized
ctgtactgattagccttgactc

SEQ ID NO: 136183 - DNA, 22 bp, Artificial Sequence
  chemically synthesized
tactgattagccttgactcctc

SEQ ID NO: 136184 - DNA, 22 bp, Artificial Sequence
  chemically synthesized
attagccttgactcctcttata

SEQ ID NO: 136185 - DNA, 22 bp, Artificial Sequence
  chemically synthesized
gccttgactcctcttatagctc

SEQ ID NO: 136186 - DNA, 22 bp, Artificial Sequence
  chemically synthesized
gactcctcttatagctcacccc

SEQ ID NO: 136187 - DNA, 22 bp, Artificial Sequence
  chemically synthesized
actcctcttatagctcacccca

SEQ ID NO: 136188 - DNA, 22 bp, Artificial Sequence
  chemically synthesized
ctcttatagctcaccccagcct

SEQ ID NO: 136189 - DNA, 22 bp, Artificial Sequence
  chemically synthesized
ttatagctcaccccagcctctt

SEQ ID NO: 136190 - DNA, 22 bp, Artificial Sequence
  chemically synthesized
atagctcaccccagcctcttgg

SEQ ID NO: 136191 - DNA, 22 bp, Artificial Sequence
  chemically synthesized
tagctcaccccagcctcttggc

SEQ ID NO: 136192 - DNA, 22 bp, Artificial Sequence
  chemically synthesized
accccagcctcttggcattatt

SEQ ID NO: 136193 - DNA, 22 bp, Artificial Sequence
  chemically synthesized
ttggcattattatcaagtgtta

SEQ ID NO: 136194 - DNA, 22 bp, Artificial Sequence
  chemically synthesized
ggcattattatcaagtgttacc

SEQ ID NO: 136195 - DNA, 22 bp, Artificial Sequence
  chemically synthesized
gcattattatcaagtgttacca

SEQ ID NO: 136196 - DNA, 22 bp, Artificial Sequence
  chemically synthesized
ttatcaagtgttaccacagttg

SEQ ID NO: 136197 - DNA, 22 bp, Artificial Sequence
  chemically synthesized
tcaagtgttaccacagttgaac

SEQ ID NO: 136198 - DNA, 22 bp, Artificial Sequence
  chemically synthesized
ccacagttgaacagctggatcc

SEQ ID NO: 136199 - DNA, 22 bp, Artificial Sequence
  chemically synthesized
aacagctggatccaaaagtatt

SEQ ID NO: 136200 - DNA, 22 bp, Artificial Sequence
  chemically synthesized
gatccaaaagtattgaccaata

SEQ ID NO: 136201 - DNA, 22 bp, Artificial Sequence
  chemically synthesized
accaataaggaacagaaaataa

SEQ ID NO: 136202 - DNA, 22 bp, Artificial Sequence
  chemically synthesized
gcaatgtaaattataatatgga

SEQ ID NO: 136203 - DNA, 22 bp, Artificial Sequence
  chemically synthesized
caatgtaaattataatatggat

SEQ ID NO: 136204 - DNA, 22 bp, Artificial Sequence
  chemically synthesized
taatatggataagcattggtac

SEQ ID NO: 136205 - DNA, 22 bp, Artificial Sequence
  chemically synthesized
gtactaaacctgaagttagtat

SEQ ID NO: 136206 - DNA, 22 bp, Artificial Sequence
  chemically synthesized
aacctgaagttagtattttact

SEQ ID NO: 136207 - DNA, 22 bp, Artificial Sequence
  chemically synthesized
aagttagtattttactctatac

SEQ ID NO: 136208 - DNA, 22 bp, Artificial Sequence
  chemically synthesized
gtattttactctatacctacaa

SEQ ID NO: 136209 - DNA, 22 bp, Artificial Sequence
  chemically synthesized
tactctatacctacaaggaaga

SEQ ID NO: 136210 - DNA, 22 bp, Artificial Sequence
  chemically synthesized
actctatacctacaaggaagat

SEQ ID NO: 136211 - DNA, 22 bp, Artificial Sequence
  chemically synthesized
ctctatacctacaaggaagata

SEQ ID NO: 136212 - DNA, 22 bp, Artificial Sequence
  chemically synthesized
tatacctacaaggaagatatac

SEQ ID NO: 136213 - DNA, 22 bp, Artificial Sequence
  chemically synthesized
tacctacaaggaagatatacaa

SEQ ID NO: 136214 - DNA, 22 bp, Artificial Sequence
  chemically synthesized
caaggaagatatacaagtattt

SEQ ID NO: 136215 - DNA, 22 bp, Artificial Sequence
  chemically synthesized
ctctaaggtagtttgaaaagcc

SEQ ID NO: 136216 - DNA, 22 bp, Artificial Sequence
  chemically synthesized
tctaaggtagtttgaaaagcct

SEQ ID NO: 136217 - DNA, 22 bp, Artificial Sequence
  chemically synthesized
taaggtagtttgaaaagcctag

SEQ ID NO: 136218 - DNA, 22 bp, Artificial Sequence
  chemically synthesized
aggtagtttgaaaagcctagat

SEQ ID NO: 136219 - DNA, 22 bp, Artificial Sequence
  chemically synthesized
gaaaagcctagatatagaaact

SEQ ID NO: 136220 - DNA, 22 bp, Artificial Sequence
  chemically synthesized
aaaagcctagatatagaaactg

SEQ ID NO: 136221 - DNA, 22 bp, Artificial Sequence
  chemically synthesized
gatatagaaactggatcctcac

SEQ ID NO: 136222 - DNA, 22 bp, Artificial Sequence
  chemically synthesized
gatcctcacatgagttcagtat

SEQ ID NO: 136223 - DNA, 22 bp, Artificial Sequence
  chemically synthesized
acatgagttcagtatataattg

SEQ ID NO: 136224 - DNA, 22 bp, Artificial Sequence
  chemically synthesized
agtatataattgtaacagaata

SEQ ID NO: 136225 - DNA, 22 bp, Artificial Sequence
  chemically synthesized
taacagaataaaaaatcaatta

SEQ ID NO: 136226 - DNA, 22 bp, Artificial Sequence
  chemically synthesized
tgtattcaagttgctagtgtct

SEQ ID NO: 136227 - DNA, 22 bp, Artificial Sequence
  chemically synthesized
aagttgctagtgtcttaagagg

SEQ ID NO: 136228 - DNA, 22 bp, Artificial Sequence
  chemically synthesized
ctagtgtcttaagaggttcaca

SEQ ID NO: 136229 - DNA, 22 bp, Artificial Sequence
  chemically synthesized
gtgtcttaagaggttcacattt

SEQ ID NO: 136230 - DNA, 22 bp, Artificial Sequence
  chemically synthesized
aagaggttcacatttttatcta

SEQ ID NO: 136231 - DNA, 22 bp, Artificial Sequence
  chemically synthesized
agaggttcacatttttatctaa

SEQ ID NO: 136232 - DNA, 22 bp, Artificial Sequence
  chemically synthesized
acatttttatctaactgattat

SEQ ID NO: 136233 - DNA, 22 bp, Artificial Sequence
  chemically synthesized
ttatctaactgattatcacaaa

SEQ ID NO: 136234 - DNA, 22 bp, Artificial Sequence
  chemically synthesized
tatctaactgattatcacaaaa

SEQ ID NO: 136235 - DNA, 22 bp, Artificial Sequence
  chemically synthesized
atctaactgattatcacaaaaa

SEQ ID NO: 136236 - DNA, 22 bp, Artificial Sequence
  chemically synthesized
tctaactgattatcacaaaaat

SEQ ID NO: 136237 - DNA, 22 bp, Artificial Sequence
  chemically synthesized
actgattatcacaaaaatactt

SEQ ID NO: 136238 - DNA, 22 bp, Artificial Sequence
  chemically synthesized
attatcacaaaaatacttcgag

SEQ ID NO: 136239 - DNA, 22 bp, Artificial Sequence
  chemically synthesized
tcacaaaaatacttcgagttac

SEQ ID NO: 136240 - DNA, 22 bp, Artificial Sequence
  chemically synthesized
cgagttacttttcattataatt

SEQ ID NO: 136241 - DNA, 22 bp, Artificial Sequence
  chemically synthesized
gagttacttttcattataattc

SEQ ID NO: 136242 - DNA, 22 bp, Artificial Sequence
  chemically synthesized
cttttcattataattcctgact

SEQ ID NO: 136243 - DNA, 22 bp, Artificial Sequence
  chemically synthesized
ttcattataattcctgactaca

SEQ ID NO: 136244 - DNA, 22 bp, Artificial Sequence
  chemically synthesized
tcattataattcctgactacac

SEQ ID NO: 136245 - DNA, 22 bp, Artificial Sequence
  chemically synthesized
cattataattcctgactacaca

SEQ ID NO: 136246 - DNA, 22 bp, Artificial Sequence
  chemically synthesized
attataattcctgactacacat

SEQ ID NO: 136247 - DNA, 22 bp, Artificial Sequence
  chemically synthesized
taattcctgactacacatgaag

SEQ ID NO: 136248 - DNA, 22 bp, Artificial Sequence
  chemically synthesized
ctgactacacatgaagagactg

SEQ ID NO: 136249 - DNA, 22 bp, Artificial Sequence
  chemically synthesized
actacacatgaagagactgaca

SEQ ID NO: 136250 - DNA, 22 bp, Artificial Sequence
  chemically synthesized
cacatgaagagactgacacgta

SEQ ID NO: 136251 - DNA, 22 bp, Artificial Sequence
  chemically synthesized
acacgtaggtgccttacttagg

SEQ ID NO: 136252 - DNA, 22 bp, Artificial Sequence
  chemically synthesized
acttaggtaggttaagtaattt

SEQ ID NO: 136253 - DNA, 22 bp, Artificial Sequence
  chemically synthesized
cttaggtaggttaagtaattta

SEQ ID NO: 136254 - DNA, 22 bp, Artificial Sequence
  chemically synthesized
aggtaggttaagtaatttatcc

SEQ ID NO: 136255 - DNA, 22 bp, Artificial Sequence
  chemically synthesized
ggtaggttaagtaatttatcca

SEQ ID NO: 136256 - DNA, 22 bp, Artificial Sequence
  chemically synthesized
agtaatttatccaaaaccacac

SEQ ID NO: 136257 - DNA, 22 bp, Artificial Sequence
  chemically synthesized
atccaaaaccacacaatgtaga

SEQ ID NO: 136258 - DNA, 22 bp, Artificial Sequence
  chemically synthesized
tccaaaaccacacaatgtagaa

SEQ ID NO: 136259 - DNA, 22 bp, Artificial Sequence
  chemically synthesized
agctgattcggccatagaaaca

SEQ ID NO: 136260 - DNA, 22 bp, Artificial Sequence
  chemically synthesized
attcggccatagaaacacaata

SEQ ID NO: 136261 - DNA, 22 bp, Artificial Sequence
  chemically synthesized
ggccatagaaacacaatatgtg

SEQ ID NO: 136262 - DNA, 22 bp, Artificial Sequence
  chemically synthesized
ctctccttcctatgctgtcaga

SEQ ID NO: 136263 - DNA, 22 bp, Artificial Sequence
  chemically synthesized
tctccttcctatgctgtcagat

SEQ ID NO: 136264 - DNA, 22 bp, Artificial Sequence
  chemically synthesized
tccttcctatgctgtcagatga

SEQ ID NO: 136265 - DNA, 22 bp, Artificial Sequence
  chemically synthesized
cttcctatgctgtcagatgaat

SEQ ID NO: 136266 - DNA, 22 bp, Artificial Sequence
  chemically synthesized
cctatgctgtcagatgaatact

SEQ ID NO: 136267 - DNA, 22 bp, Artificial Sequence
  chemically synthesized
ctatgctgtcagatgaatactg

SEQ ID NO: 136268 - DNA, 22 bp, Artificial Sequence
  chemically synthesized
tgctgtcagatgaatactgaga

SEQ ID NO: 136269 - DNA, 22 bp, Artificial Sequence
  chemically synthesized
tcagatgaatactgagatagaa

SEQ ID NO: 136270 - DNA, 22 bp, Artificial Sequence
  chemically synthesized
agatagaatatttagttcatct

SEQ ID NO: 136271 - DNA, 22 bp, Artificial Sequence
  chemically synthesized
agttcatctatcacacattaaa

SEQ ID NO: 136272 - DNA, 22 bp, Artificial Sequence
  chemically synthesized
gttcatctatcacacattaaac

SEQ ID NO: 136273 - DNA, 22 bp, Artificial Sequence
  chemically synthesized
atctatcacacattaaacggga

SEQ ID NO: 136274 - DNA, 22 bp, Artificial Sequence
  chemically synthesized
tcacacattaaacgggacttta

SEQ ID NO: 136275 - DNA, 22 bp, Artificial Sequence
  chemically synthesized
aacgggactttacatttctgtc

SEQ ID NO: 136276 - DNA, 22 bp, Artificial Sequence
  chemically synthesized
tacatttctgtctgttgaagat

SEQ ID NO: 136277 - DNA, 22 bp, Artificial Sequence
  chemically synthesized
acatttctgtctgttgaagatt

SEQ ID NO: 136278 - DNA, 22 bp, Artificial Sequence
  chemically synthesized
catttctgtctgttgaagattt

SEQ ID NO: 136279 - DNA, 22 bp, Artificial Sequence
  chemically synthesized
ctgtctgttgaagatttgggtg

SEQ ID NO: 136280 - DNA, 22 bp, Artificial Sequence
  chemically synthesized
tgtctgttgaagatttgggtgt

SEQ ID NO: 136281 - DNA, 22 bp, Artificial Sequence
  chemically synthesized
tctgttgaagatttgggtgtgg

SEQ ID NO: 136282 - DNA, 22 bp, Artificial Sequence
  chemically synthesized
ttgaagatttgggtgtggggat

SEQ ID NO: 136283 - DNA, 22 bp, Artificial Sequence
  chemically synthesized
aagatttgggtgtggggataac

SEQ ID NO: 136284 - DNA, 22 bp, Artificial Sequence
  chemically synthesized
gggtgtggggataactcaaggt

SEQ ID NO: 136285 - DNA, 22 bp, Artificial Sequence
  chemically synthesized
ggtgtggggataactcaaggta

SEQ ID NO: 136286 - DNA, 22 bp, Artificial Sequence
  chemically synthesized
aaggtatcatatccaagggatg

SEQ ID NO: 136287 - DNA, 22 bp, Artificial Sequence
  chemically synthesized
taacagaaagggaaaggatgtt

SEQ ID NO: 136288 - DNA, 22 bp, Artificial Sequence
  chemically synthesized
acagaaagggaaaggatgttgg

SEQ ID NO: 136289 - DNA, 22 bp, Artificial Sequence
  chemically synthesized
gcaaggctatgttcatgaaagt

SEQ ID NO: 136290 - DNA, 22 bp, Artificial Sequence
  chemically synthesized
tgttcatgaaagtatatgtaaa

SEQ ID NO: 136291 - DNA, 22 bp, Artificial Sequence
  chemically synthesized
atgaaagtatatgtaaaatcca

SEQ ID NO: 136292 - DNA, 22 bp, Artificial Sequence
  chemically synthesized
agcttctttctgcatgcattgg

SEQ ID NO: 136293 - DNA, 22 bp, Artificial Sequence
  chemically synthesized
ctttctgcatgcattggcaatg

SEQ ID NO: 136294 - DNA, 22 bp, Artificial Sequence
  chemically synthesized
tttctgcatgcattggcaatgt

SEQ ID NO: 136295 - DNA, 22 bp, Artificial Sequence
  chemically synthesized
tctgcatgcattggcaatgttt

SEQ ID NO: 136296 - DNA, 22 bp, Artificial Sequence
  chemically synthesized
ctgcatgcattggcaatgttta

SEQ ID NO: 136297 - DNA, 22 bp, Artificial Sequence
  chemically synthesized
tgcatgcattggcaatgtttat

SEQ ID NO: 136298 - DNA, 22 bp, Artificial Sequence
  chemically synthesized
catgcattggcaatgtttatga

SEQ ID NO: 136299 - DNA, 22 bp, Artificial Sequence
  chemically synthesized
gcaatgtttatgaataatgtgt

SEQ ID NO: 136300 - DNA, 22 bp, Artificial Sequence
  chemically synthesized
atgaataatgtgtatgtaaaag

SEQ ID NO: 136301 - DNA, 22 bp, Artificial Sequence
  chemically synthesized
tgaataatgtgtatgtaaaagt

SEQ ID NO: 136302 - DNA, 22 bp, Artificial Sequence
  chemically synthesized
tatattcaaaagtgtttcatgt

SEQ ID NO: 136303 - DNA, 22 bp, Artificial Sequence
  chemically synthesized
aaaagtgtttcatgtgcctagg

SEQ ID NO: 136304 - DNA, 22 bp, Artificial Sequence
  chemically synthesized
catgtgcctaggggtgtcaaat

SEQ ID NO: 136305 - DNA, 22 bp, Artificial Sequence
  chemically synthesized
atgtgcctaggggtgtcaaata

SEQ ID NO: 136306 - DNA, 22 bp, Artificial Sequence
  chemically synthesized
ggggtgtcaaatactttgagtt

SEQ ID NO: 136307 - DNA, 22 bp, Artificial Sequence
  chemically synthesized
tgagtttgtaagtatatacttc

SEQ ID NO: 136308 - DNA, 22 bp, Artificial Sequence
  chemically synthesized
gagtttgtaagtatatacttct

SEQ ID NO: 136309 - DNA, 22 bp, Artificial Sequence
  chemically synthesized
agtttgtaagtatatacttctc

SEQ ID NO: 136310 - DNA, 22 bp, Artificial Sequence
  chemically synthesized
gtaagtatatacttctctgtaa

SEQ ID NO: 136311 - DNA, 22 bp, Artificial Sequence
  chemically synthesized
taagtatatacttctctgtaat

SEQ ID NO: 136312 - DNA, 22 bp, Artificial Sequence
  chemically synthesized
ctctgtaatgtgtctgaatatc

SEQ ID NO: 136313 - DNA, 22 bp, Artificial Sequence
  chemically synthesized
tctgtaatgtgtctgaatatct

SEQ ID NO: 136314 - DNA, 22 bp, Artificial Sequence
  chemically synthesized
tgtaatgtgtctgaatatctct

SEQ ID NO: 136315 - DNA, 22 bp, Artificial Sequence
  chemically synthesized
taatgtgtctgaatatctctat

SEQ ID NO: 136316 - DNA, 22 bp, Artificial Sequence
  chemically synthesized
aatatctctatttacttgattc

SEQ ID NO: 136317 - DNA, 22 bp, Artificial Sequence
  chemically synthesized
tatttacttgattctcaataag

SEQ ID NO: 136318 - DNA, 22 bp, Artificial Sequence
  chemically synthesized
tttacttgattctcaataagta

SEQ ID NO: 136319 - DNA, 22 bp, Artificial Sequence
  chemically synthesized
acttgattctcaataagtaggt

SEQ ID NO: 136320 - DNA, 22 bp, Artificial Sequence
  chemically synthesized
cttgattctcaataagtaggta

SEQ ID NO: 136321 - DNA, 22 bp, Artificial Sequence
  chemically synthesized
gattctcaataagtaggtatca

SEQ ID NO: 136322 - DNA, 22 bp, Artificial Sequence
  chemically synthesized
attctcaataagtaggtatcat

SEQ ID NO: 136323 - DNA, 22 bp, Artificial Sequence
  chemically synthesized
tcaataagtaggtatcatagtg

SEQ ID NO: 136324 - DNA, 22 bp, Artificial Sequence
  chemically synthesized
aataagtaggtatcatagtgaa

SEQ ID NO: 136325 - DNA, 22 bp, Artificial Sequence
  chemically synthesized
acaaatgtttgaggaacaattt

SEQ ID NO: 136326 - DNA, 22 bp, Artificial Sequence
  chemically synthesized
gaggaacaatttagtgtttacc

SEQ ID NO: 136327 - DNA, 22 bp, Artificial Sequence
  chemically synthesized
aggaacaatttagtgtttacct

SEQ ID NO: 136328 - DNA, 22 bp, Artificial Sequence
  chemically synthesized
agtgtttacctattcaccaaaa

SEQ ID NO: 136329 - DNA, 22 bp, Artificial Sequence
  chemically synthesized
gtgtttacctattcaccaaaat

SEQ ID NO: 136330 - DNA, 22 bp, Artificial Sequence
  chemically synthesized
acctattcaccaaaatttatta

SEQ ID NO: 136331 - DNA, 22 bp, Artificial Sequence
  chemically synthesized
cctattcaccaaaatttattaa

SEQ ID NO: 136332 - DNA, 22 bp, Artificial Sequence
  chemically synthesized
ttcaccaaaatttattaaatgc

SEQ ID NO: 136333 - DNA, 22 bp, Artificial Sequence
  chemically synthesized
accaaaatttattaaatgccta

SEQ ID NO: 136334 - DNA, 22 bp, Artificial Sequence
  chemically synthesized
attaaatgcctaatctgtatca

SEQ ID NO: 136335 - DNA, 22 bp, Artificial Sequence
  chemically synthesized
ttaaatgcctaatctgtatcag

SEQ ID NO: 136336 - DNA, 22 bp, Artificial Sequence
  chemically synthesized
aatgcctaatctgtatcagata

SEQ ID NO: 136337 - DNA, 22 bp, Artificial Sequence
  chemically synthesized
atctgtatcagatatacaatta

SEQ ID NO: 136338 - DNA, 22 bp, Artificial Sequence
  chemically synthesized
tatcagatatacaattatctgg

SEQ ID NO: 136339 - DNA, 22 bp, Artificial Sequence
  chemically synthesized
tctggcgaaatctgtaattcct

SEQ ID NO: 136340 - DNA, 22 bp, Artificial Sequence
  chemically synthesized
gcgaaatctgtaattcctaatt

SEQ ID NO: 136341 - DNA, 22 bp, Artificial Sequence
  chemically synthesized
taattcctaatttaaacagctg

SEQ ID NO: 136342 - DNA, 22 bp, Artificial Sequence
  chemically synthesized
ctaatttaaacagctgtgtagc

SEQ ID NO: 136343 - DNA, 22 bp, Artificial Sequence
  chemically synthesized
atttaaacagctgtgtagccta

SEQ ID NO: 136344 - DNA, 22 bp, Artificial Sequence
  chemically synthesized
aaacagctgtgtagcctaatta

SEQ ID NO: 136345 - DNA, 22 bp, Artificial Sequence
  chemically synthesized
aacagctgtgtagcctaattag

SEQ ID NO: 136346 - DNA, 22 bp, Artificial Sequence
  chemically synthesized
tgtagcctaattagggataaag

SEQ ID NO: 136347 - DNA, 22 bp, Artificial Sequence
  chemically synthesized
attagggataaaggcatgcaaa

SEQ ID NO: 136348 - DNA, 22 bp, Artificial Sequence
  chemically synthesized
gggataaaggcatgcaaaccca

SEQ ID NO: 136349 - DNA, 22 bp, Artificial Sequence
  chemically synthesized
gtgtaggttgaaatgagctata

SEQ ID NO: 136350 - DNA, 22 bp, Artificial Sequence
  chemically synthesized
tgtaggttgaaatgagctatag

SEQ ID NO: 136351 - DNA, 22 bp, Artificial Sequence
  chemically synthesized
aaatgagctatagaaaaatgca

SEQ ID NO: 136352 - DNA, 22 bp, Artificial Sequence
  chemically synthesized
tagaaaaatgcagtatatttat

SEQ ID NO: 136353 - DNA, 22 bp, Artificial Sequence
  chemically synthesized
atcagaagtctttagggtcatg

SEQ ID NO: 136354 - DNA, 22 bp, Artificial Sequence
  chemically synthesized
tcagaagtctttagggtcatga

SEQ ID NO: 136355 - DNA, 22 bp, Artificial Sequence
  chemically synthesized
tagggtcatgaaaaggaatggt

SEQ ID NO: 136356 - DNA, 22 bp, Artificial Sequence
  chemically synthesized
agggtcatgaaaaggaatggtc

SEQ ID NO: 136357 - DNA, 22 bp, Artificial Sequence
  chemically synthesized
gggtcatgaaaaggaatggtca

SEQ ID NO: 136358 - DNA, 22 bp, Artificial Sequence
  chemically synthesized
acactgccagggactcatatgt

SEQ ID NO: 136359 - DNA, 22 bp, Artificial Sequence
  chemically synthesized
ccagggactcatatgtaagaga

SEQ ID NO: 136360 - DNA, 22 bp, Artificial Sequence
  chemically synthesized
atatgtaagagataactaatgt

SEQ ID NO: 136361 - DNA, 22 bp, Artificial Sequence
  chemically synthesized
atgtgaagtgactttaaaggag

SEQ ID NO: 136362 - DNA, 22 bp, Artificial Sequence
  chemically synthesized
taaaggagaaattagcagaagt

SEQ ID NO: 136363 - DNA, 22 bp, Artificial Sequence
  chemically synthesized
aaaggagaaattagcagaagtt

SEQ ID NO: 136364 - DNA, 22 bp, Artificial Sequence
  chemically synthesized
aaggagaaattagcagaagttt

SEQ ID NO: 136365 - DNA, 22 bp, Artificial Sequence
  chemically synthesized
gcagaagttttctttccatgtc

SEQ ID NO: 136366 - DNA, 22 bp, Artificial Sequence
  chemically synthesized
tctttccatgtctcctcatcat

SEQ ID NO: 136367 - DNA, 22 bp, Artificial Sequence
  chemically synthesized
ctttccatgtctcctcatcatg

SEQ ID NO: 136368 - DNA, 22 bp, Artificial Sequence
  chemically synthesized
tttccatgtctcctcatcatgt

SEQ ID NO: 136369 - DNA, 22 bp, Artificial Sequence
  chemically synthesized
tccatgtctcctcatcatgtta

SEQ ID NO: 136370 - DNA, 22 bp, Artificial Sequence
  chemically synthesized
ccatgtctcctcatcatgttac

SEQ ID NO: 136371 - DNA, 22 bp, Artificial Sequence
  chemically synthesized
catgtctcctcatcatgttaca

SEQ ID NO: 136372 - DNA, 22 bp, Artificial Sequence
  chemically synthesized
ctcatcatgttacaataacgga

SEQ ID NO: 136373 - DNA, 22 bp, Artificial Sequence
  chemically synthesized
atcatgttacaataacggaaga

SEQ ID NO: 136374 - DNA, 22 bp, Artificial Sequence
  chemically synthesized
caataacggaagagattaaaac

SEQ ID NO: 136375 - DNA, 22 bp, Artificial Sequence
  chemically synthesized
aaacaacaaatacatttagaca

SEQ ID NO: 136376 - DNA, 22 bp, Artificial Sequence
  chemically synthesized
agacagcaatgtttatcctggt

SEQ ID NO: 136377 - DNA, 22 bp, Artificial Sequence
  chemically synthesized
gacagcaatgtttatcctggtt

SEQ ID NO: 136378 - DNA, 22 bp, Artificial Sequence
  chemically synthesized
atcctggttagatgttttaatc

SEQ ID NO: 136379 - DNA, 22 bp, Artificial Sequence
  chemically synthesized
tcctggttagatgttttaatct

SEQ ID NO: 136380 - DNA, 22 bp, Artificial Sequence
  chemically synthesized
gttagatgttttaatctaaatc

SEQ ID NO: 136381 - DNA, 22 bp, Artificial Sequence
  chemically synthesized
gatgttttaatctaaatctatc

SEQ ID NO: 136382 - DNA, 22 bp, Artificial Sequence
  chemically synthesized
taatctaaatctatcttggagt

SEQ ID NO: 136383 - DNA, 22 bp, Artificial Sequence
  chemically synthesized
aatctaaatctatcttggagtg

SEQ ID NO: 136384 - DNA, 22 bp, Artificial Sequence
  chemically synthesized
atctaaatctatcttggagtgt

SEQ ID NO: 136385 - DNA, 22 bp, Artificial Sequence
  chemically synthesized
aatctatcttggagtgttaaaa

SEQ ID NO: 136386 - DNA, 22 bp, Artificial Sequence
  chemically synthesized
tcttggagtgttaaaatgcatt

SEQ ID NO: 136387 - DNA, 22 bp, Artificial Sequence
  chemically synthesized
ggagtgttaaaatgcatttgct

SEQ ID NO: 136388 - DNA, 22 bp, Artificial Sequence
  chemically synthesized
gagtgttaaaatgcatttgctc

SEQ ID NO: 136389 - DNA, 22 bp, Artificial Sequence
  chemically synthesized
aaatgcatttgctcacctactt

SEQ ID NO: 136390 - DNA, 22 bp, Artificial Sequence
  chemically synthesized
gctcacctactttaaaatataa

SEQ ID NO: 136391 - DNA, 22 bp, Artificial Sequence
  chemically synthesized
ctcacctactttaaaatataaa

SEQ ID NO: 136392 - DNA, 22 bp, Artificial Sequence
  chemically synthesized
acctactttaaaatataaatga

SEQ ID NO: 136393 - DNA, 22 bp, Artificial Sequence
  chemically synthesized
ctttaaaatataaatgaaggta

SEQ ID NO: 136394 - DNA, 22 bp, Artificial Sequence
  chemically synthesized
taaaatataaatgaaggtagga

SEQ ID NO: 136395 - DNA, 22 bp, Artificial Sequence
  chemically synthesized
aaaatataaatgaaggtaggaa

SEQ ID NO: 136396 - DNA, 22 bp, Artificial Sequence
  chemically synthesized
aaatataaatgaaggtaggaac

SEQ ID NO: 136397 - DNA, 22 bp, Artificial Sequence
  chemically synthesized
tagatacaaaaagttggagaaa

SEQ ID NO: 136398 - DNA, 22 bp, Artificial Sequence
  chemically synthesized
gagaaaaaaagacaataaagat

SEQ ID NO: 136399 - DNA, 22 bp, Artificial Sequence
  chemically synthesized
ttaatccttgatagaaaatgag

SEQ ID NO: 136400 - DNA, 22 bp, Artificial Sequence
  chemically synthesized
atccttgatagaaaatgagaag

SEQ ID NO: 136401 - DNA, 22 bp, Artificial Sequence
  chemically synthesized
gatagaaaatgagaagagataa

SEQ ID NO: 136402 - DNA, 22 bp, Artificial Sequence
  chemically synthesized
atagaaaatgagaagagataaa

SEQ ID NO: 136403 - DNA, 22 bp, Artificial Sequence
  chemically synthesized
gtttacataaagaaaataagat

SEQ ID NO: 136404 - DNA, 22 bp, Artificial Sequence
  chemically synthesized
acataaagaaaataagatggat

SEQ ID NO: 136405 - DNA, 22 bp, Artificial Sequence
  chemically synthesized
cataaagaaaataagatggata

SEQ ID NO: 136406 - DNA, 22 bp, Artificial Sequence
  chemically synthesized
ataaaagtgataatttgagaaa

SEQ ID NO: 136407 - DNA, 22 bp, Artificial Sequence
  chemically synthesized
taaaagtgataatttgagaaaa

SEQ ID NO: 136408 - DNA, 22 bp, Artificial Sequence
  chemically synthesized
gagaaaaaaaatactccatatt

SEQ ID NO: 136409 - DNA, 22 bp, Artificial Sequence
  chemically synthesized
agaaaaaaaatactccatattc

SEQ ID NO: 136410 - DNA, 22 bp, Artificial Sequence
  chemically synthesized
catattctgagtttcttcacat

SEQ ID NO: 136411 - DNA, 22 bp, Artificial Sequence
  chemically synthesized
tgagtttcttcacataaaataa

SEQ ID NO: 136412 - DNA, 22 bp, Artificial Sequence
  chemically synthesized
agtttcttcacataaaataata

SEQ ID NO: 136413 - DNA, 22 bp, Artificial Sequence
  chemically synthesized
cttcacataaaataatacaaat

SEQ ID NO: 136414 - DNA, 22 bp, Artificial Sequence
  chemically synthesized
ttcacataaaataatacaaatc

SEQ ID NO: 136415 - DNA, 22 bp, Artificial Sequence
  chemically synthesized
cacataaaataatacaaatctg

SEQ ID NO: 136416 - DNA, 22 bp, Artificial Sequence
  chemically synthesized
acataaaataatacaaatctgc

SEQ ID NO: 136417 - DNA, 22 bp, Artificial Sequence
  chemically synthesized
ctgtggtaagttacaaagagat

SEQ ID NO: 136418 - DNA, 22 bp, Artificial Sequence
  chemically synthesized
tggtaagttacaaagagataga

SEQ ID NO: 136419 - DNA, 22 bp, Artificial Sequence
  chemically synthesized
caaagagatagattttttatca

SEQ ID NO: 136420 - DNA, 22 bp, Artificial Sequence
  chemically synthesized
tttatcattatataaaagatat

SEQ ID NO: 136421 - DNA, 22 bp, Artificial Sequence
  chemically synthesized
ttatcattatataaaagatatt

SEQ ID NO: 136422 - DNA, 22 bp, Artificial Sequence
  chemically synthesized
tatcattatataaaagatattt

SEQ ID NO: 136423 - DNA, 22 bp, Artificial Sequence
  chemically synthesized
atcattatataaaagatatttt

SEQ ID NO: 136424 - DNA, 22 bp, Artificial Sequence
  chemically synthesized
tcattatataaaagatatttta

SEQ ID NO: 136425 - DNA, 22 bp, Artificial Sequence
  chemically synthesized
tataaaagatattttaaacaga

SEQ ID NO: 136426 - DNA, 22 bp, Artificial Sequence
  chemically synthesized
taaacagagttatacaacaaag

SEQ ID NO: 136427 - DNA, 22 bp, Artificial Sequence
  chemically synthesized
aaacagagttatacaacaaagg

SEQ ID NO: 136428 - DNA, 22 bp, Artificial Sequence
  chemically synthesized
aacagagttatacaacaaagga

SEQ ID NO: 136429 - DNA, 22 bp, Artificial Sequence
  chemically synthesized
tacaacaaaggaacagactatg

SEQ ID NO: 136430 - DNA, 22 bp, Artificial Sequence
  chemically synthesized
tgtcatatattctcacttatca

SEQ ID NO: 136431 - DNA, 22 bp, Artificial Sequence
  chemically synthesized
tcacttatcactataaacatct

SEQ ID NO: 136432 - DNA, 22 bp, Artificial Sequence
  chemically synthesized
acttatcactataaacatctca

SEQ ID NO: 136433 - DNA, 22 bp, Artificial Sequence
  chemically synthesized
atcactataaacatctcagaaa

SEQ ID NO: 136434 - DNA, 22 bp, Artificial Sequence
  chemically synthesized
tcactataaacatctcagaaaa

SEQ ID NO: 136435 - DNA, 22 bp, Artificial Sequence
  chemically synthesized
taaacatctcagaaaaatctgc

SEQ ID NO: 136436 - DNA, 22 bp, Artificial Sequence
  chemically synthesized
agaaaaatctgcaaaatcattt

SEQ ID NO: 136437 - DNA, 22 bp, Artificial Sequence
  chemically synthesized
caaaatcatttcatagcatttt

SEQ ID NO: 136438 - DNA, 22 bp, Artificial Sequence
  chemically synthesized
catagcattttaaatagttagg

SEQ ID NO: 136439 - DNA, 22 bp, Artificial Sequence
  chemically synthesized
atagcattttaaatagttagga

SEQ ID NO: 136440 - DNA, 22 bp, Artificial Sequence
  chemically synthesized
taaatagttaggaataatgtag

SEQ ID NO: 136441 - DNA, 22 bp, Artificial Sequence
  chemically synthesized
aaatagttaggaataatgtaga

SEQ ID NO: 136442 - DNA, 22 bp, Artificial Sequence
  chemically synthesized
aatagttaggaataatgtagaa

SEQ ID NO: 136443 - DNA, 22 bp, Artificial Sequence
  chemically synthesized
ggaataatgtagaaaactgaaa

SEQ ID NO: 136444 - DNA, 22 bp, Artificial Sequence
  chemically synthesized
aaacagttctaagtttcccaca

SEQ ID NO: 136445 - DNA, 22 bp, Artificial Sequence
  chemically synthesized
taagtttcccacaaacttagag

SEQ ID NO: 136446 - DNA, 22 bp, Artificial Sequence
  chemically synthesized
agtttcccacaaacttagagtc

SEQ ID NO: 136447 - DNA, 22 bp, Artificial Sequence
  chemically synthesized
cccacaaacttagagtctcaaa

SEQ ID NO: 136448 - DNA, 22 bp, Artificial Sequence
  chemically synthesized
ccacaaacttagagtctcaaat

SEQ ID NO: 136449 - DNA, 22 bp, Artificial Sequence
  chemically synthesized
agagtctcaaatgttgcattac

SEQ ID NO: 136450 - DNA, 22 bp, Artificial Sequence
  chemically synthesized
gagtctcaaatgttgcattacc

SEQ ID NO: 136451 - DNA, 22 bp, Artificial Sequence
  chemically synthesized
aaatgttgcattacctaactta

SEQ ID NO: 136452 - DNA, 22 bp, Artificial Sequence
  chemically synthesized
cattacctaacttacctgcaaa

SEQ ID NO: 136453 - DNA, 22 bp, Artificial Sequence
  chemically synthesized
cctaacttacctgcaaatattt

SEQ ID NO: 136454 - DNA, 22 bp, Artificial Sequence
  chemically synthesized
acttacctgcaaatattttata

SEQ ID NO: 136455 - DNA, 22 bp, Artificial Sequence
  chemically synthesized
acctgcaaatattttatacaaa

SEQ ID NO: 136456 - DNA, 22 bp, Artificial Sequence
  chemically synthesized
cctgcaaatattttatacaaat

SEQ ID NO: 136457 - DNA, 22 bp, Artificial Sequence
  chemically synthesized
caaatattttatacaaatttgc

SEQ ID NO: 136458 - DNA, 22 bp, Artificial Sequence
  chemically synthesized
tatacaaatttgcacatgctac

SEQ ID NO: 136459 - DNA, 22 bp, Artificial Sequence
  chemically synthesized
atacaaatttgcacatgctact

SEQ ID NO: 136460 - DNA, 22 bp, Artificial Sequence
  chemically synthesized
tacaaatttgcacatgctactc

SEQ ID NO: 136461 - DNA, 22 bp, Artificial Sequence
  chemically synthesized
gcacatgctactctagtcaaaa

SEQ ID NO: 136462 - DNA, 22 bp, Artificial Sequence
  chemically synthesized
cacatgctactctagtcaaaaa

SEQ ID NO: 136463 - DNA, 22 bp, Artificial Sequence
  chemically synthesized
ctctagtcaaaaatatatgtac

SEQ ID NO: 136464 - DNA, 22 bp, Artificial Sequence
  chemically synthesized
tagtcaaaaatatatgtacatt

SEQ ID NO: 136465 - DNA, 22 bp, Artificial Sequence
  chemically synthesized
gtcaaaaatatatgtacattat

SEQ ID NO: 136466 - DNA, 22 bp, Artificial Sequence
  chemically synthesized
tgggtattttctgtgtgtaact

SEQ ID NO: 136467 - DNA, 22 bp, Artificial Sequence
  chemically synthesized
tctgtgtgtaacttggttctag

SEQ ID NO: 136468 - DNA, 22 bp, Artificial Sequence
  chemically synthesized
ctgtgtgtaacttggttctagt

SEQ ID NO: 136469 - DNA, 22 bp, Artificial Sequence
  chemically synthesized
tgtgtgtaacttggttctagtt

SEQ ID NO: 136470 - DNA, 22 bp, Artificial Sequence
  chemically synthesized
tgtgtaacttggttctagttgc

SEQ ID NO: 136471 - DNA, 22 bp, Artificial Sequence
  chemically synthesized
ggttctagttgcttctttcaga

SEQ ID NO: 136472 - DNA, 22 bp, Artificial Sequence
  chemically synthesized
gttctagttgcttctttcagaa

SEQ ID NO: 136473 - DNA, 22 bp, Artificial Sequence
  chemically synthesized
tagttgcttctttcagaaatag

SEQ ID NO: 136474 - DNA, 22 bp, Artificial Sequence
  chemically synthesized
gttgcttctttcagaaatagcc

SEQ ID NO: 136475 - DNA, 22 bp, Artificial Sequence
  chemically synthesized
cttctttcagaaatagcctcta

SEQ ID NO: 136476 - DNA, 22 bp, Artificial Sequence
  chemically synthesized
ctttcagaaatagcctctattt

SEQ ID NO: 136477 - DNA, 22 bp, Artificial Sequence
  chemically synthesized
tttcagaaatagcctctatttt

SEQ ID NO: 136478 - DNA, 22 bp, Artificial Sequence
  chemically synthesized
tcagaaatagcctctatttttg

SEQ ID NO: 136479 - DNA, 22 bp, Artificial Sequence
  chemically synthesized
cagaaatagcctctatttttga

SEQ ID NO: 136480 - DNA, 22 bp, Artificial Sequence
  chemically synthesized
agaaatagcctctatttttgat

SEQ ID NO: 136481 - DNA, 22 bp, Artificial Sequence
  chemically synthesized
tatttttgatttacctgataaa

SEQ ID NO: 136482 - DNA, 22 bp, Artificial Sequence
  chemically synthesized
tttttgatttacctgataaaat

SEQ ID NO: 136483 - DNA, 22 bp, Artificial Sequence
  chemically synthesized
ttgatttacctgataaaatcac

SEQ ID NO: 136484 - DNA, 22 bp, Artificial Sequence
  chemically synthesized
tgatttacctgataaaatcaca

SEQ ID NO: 136485 - DNA, 22 bp, Artificial Sequence
  chemically synthesized
gatttacctgataaaatcacat

SEQ ID NO: 136486 - DNA, 22 bp, Artificial Sequence
  chemically synthesized
atttacctgataaaatcacatt

SEQ ID NO: 136487 - DNA, 22 bp, Artificial Sequence
  chemically synthesized
acctgataaaatcacattcctc

SEQ ID NO: 136488 - DNA, 22 bp, Artificial Sequence
  chemically synthesized
cctgataaaatcacattcctct

SEQ ID NO: 136489 - DNA, 22 bp, Artificial Sequence
  chemically synthesized
ataaaatcacattcctctccaa

SEQ ID NO: 136490 - DNA, 22 bp, Artificial Sequence
  chemically synthesized
ctctccaaagccttctaaatac

SEQ ID NO: 136491 - DNA, 22 bp, Artificial Sequence
  chemically synthesized
tccaaagccttctaaatacttc

SEQ ID NO: 136492 - DNA, 22 bp, Artificial Sequence
  chemically synthesized
caaagccttctaaatacttcca

SEQ ID NO: 136493 - DNA, 22 bp, Artificial Sequence
  chemically synthesized
ctaaatacttccagactaacta

SEQ ID NO: 136494 - DNA, 22 bp, Artificial Sequence
  chemically synthesized
taaatacttccagactaactac

SEQ ID NO: 136495 - DNA, 22 bp, Artificial Sequence
  chemically synthesized
aatacttccagactaactactt

SEQ ID NO: 136496 - DNA, 22 bp, Artificial Sequence
  chemically synthesized
ccagactaactactttttagta

SEQ ID NO: 136497 - DNA, 22 bp, Artificial Sequence
  chemically synthesized
cagactaactactttttagtac

SEQ ID NO: 136498 - DNA, 22 bp, Artificial Sequence
  chemically synthesized
actactttttagtacatctaag

SEQ ID NO: 136499 - DNA, 22 bp, Artificial Sequence
  chemically synthesized
ctttttagtacatctaagaaga

SEQ ID NO: 136500 - DNA, 22 bp, Artificial Sequence
  chemically synthesized
tttagtacatctaagaagaaaa

SEQ ID NO: 136501 - DNA, 22 bp, Artificial Sequence
  chemically synthesized
ttagtacatctaagaagaaaag

SEQ ID NO: 136502 - DNA, 22 bp, Artificial Sequence
  chemically synthesized
tagtacatctaagaagaaaaga

SEQ ID NO: 136503 - DNA, 22 bp, Artificial Sequence
  chemically synthesized
agtacatctaagaagaaaagag

SEQ ID NO: 136504 - DNA, 22 bp, Artificial Sequence
  chemically synthesized
gtacatctaagaagaaaagagt

SEQ ID NO: 136505 - DNA, 22 bp, Artificial Sequence
  chemically synthesized
agaagaaaagagttttgtctct

SEQ ID NO: 136506 - DNA, 22 bp, Artificial Sequence
  chemically synthesized
tgtctcttatccacctctgagt

SEQ ID NO: 136507 - DNA, 22 bp, Artificial Sequence
  chemically synthesized
gtctcttatccacctctgagtc

SEQ ID NO: 136508 - DNA, 22 bp, Artificial Sequence
  chemically synthesized
tctcttatccacctctgagtca

SEQ ID NO: 136509 - DNA, 22 bp, Artificial Sequence
  chemically synthesized
ttatccacctctgagtcaaaaa

SEQ ID NO: 136510 - DNA, 22 bp, Artificial Sequence
  chemically synthesized
atccacctctgagtcaaaaagc

SEQ ID NO: 136511 - DNA, 22 bp, Artificial Sequence
  chemically synthesized
tccacctctgagtcaaaaagca

SEQ ID NO: 136512 - DNA, 22 bp, Artificial Sequence
  chemically synthesized
tgagtcaaaaagcagcatgtcc

SEQ ID NO: 136513 - DNA, 22 bp, Artificial Sequence
  chemically synthesized
agtcaaaaagcagcatgtccat

SEQ ID NO: 136514 - DNA, 22 bp, Artificial Sequence
  chemically synthesized
gtacatagttcccacagcccca

SEQ ID NO: 136515 - DNA, 22 bp, Artificial Sequence
  chemically synthesized
ccacagccccacttagctctgg

SEQ ID NO: 136516 - DNA, 22 bp, Artificial Sequence
  chemically synthesized
agctctggattggagttctact

SEQ ID NO: 136517 - DNA, 22 bp, Artificial Sequence
  chemically synthesized
gctctggattggagttctactt

SEQ ID NO: 136518 - DNA, 22 bp, Artificial Sequence
  chemically synthesized
tggattggagttctacttggca

SEQ ID NO: 136519 - DNA, 22 bp, Artificial Sequence
  chemically synthesized
gattggagttctacttggcatt

SEQ ID NO: 136520 - DNA, 22 bp, Artificial Sequence
  chemically synthesized
gagttctacttggcattgtttg

SEQ ID NO: 136521 - DNA, 22 bp, Artificial Sequence
  chemically synthesized
tacttggcattgtttgcaacta

SEQ ID NO: 136522 - DNA, 22 bp, Artificial Sequence
  chemically synthesized
cttggcattgtttgcaactaca

SEQ ID NO: 136523 - DNA, 22 bp, Artificial Sequence
  chemically synthesized
ggcattgtttgcaactacatgg

SEQ ID NO: 136524 - DNA, 22 bp, Artificial Sequence
  chemically synthesized
gcattgtttgcaactacatgga

SEQ ID NO: 136525 - DNA, 22 bp, Artificial Sequence
  chemically synthesized
tttgcaactacatggacgtaaa

SEQ ID NO: 136526 - DNA, 22 bp, Artificial Sequence
  chemically synthesized
gcaactacatggacgtaaaatg

SEQ ID NO: 136527 - DNA, 22 bp, Artificial Sequence
  chemically synthesized
caactacatggacgtaaaatgc

SEQ ID NO: 136528 - DNA, 22 bp, Artificial Sequence
  chemically synthesized
catggacgtaaaatgcatggat

SEQ ID NO: 136529 - DNA, 22 bp, Artificial Sequence
  chemically synthesized
tcttgaaaaaatgtttctgcca

SEQ ID NO: 136530 - DNA, 22 bp, Artificial Sequence
  chemically synthesized
ttgaaaaaatgtttctgccatg

SEQ ID NO: 136531 - DNA, 22 bp, Artificial Sequence
  chemically synthesized
gaaaaaatgtttctgccatgat

SEQ ID NO: 136532 - DNA, 22 bp, Artificial Sequence
  chemically synthesized
aaaaaatgtttctgccatgatg

SEQ ID NO: 136533 - DNA, 22 bp, Artificial Sequence
  chemically synthesized
ctgccatgatgttctctgaaag

SEQ ID NO: 136534 - DNA, 22 bp, Artificial Sequence
  chemically synthesized
tgccatgatgttctctgaaaga

SEQ ID NO: 136535 - DNA, 22 bp, Artificial Sequence
  chemically synthesized
ccatgatgttctctgaaagaga

SEQ ID NO: 136536 - DNA, 22 bp, Artificial Sequence
  chemically synthesized
tctgaaagagactaaccttccc

SEQ ID NO: 136537 - DNA, 22 bp, Artificial Sequence
  chemically synthesized
tgaaagagactaaccttccctc

SEQ ID NO: 136538 - DNA, 22 bp, Artificial Sequence
  chemically synthesized
aaagagactaaccttccctcgc

SEQ ID NO: 136539 - DNA, 22 bp, Artificial Sequence
  chemically synthesized
accttccctcgctttgcagaga

SEQ ID NO: 136540 - DNA, 22 bp, Artificial Sequence
  chemically synthesized
ccctcgctttgcagagaaagac

SEQ ID NO: 136541 - DNA, 22 bp, Artificial Sequence
  chemically synthesized
cctcgctttgcagagaaagact

SEQ ID NO: 136542 - DNA, 22 bp, Artificial Sequence
  chemically synthesized
gctttgcagagaaagactcgtg

SEQ ID NO: 136543 - DNA, 22 bp, Artificial Sequence
  chemically synthesized
tgcagagaaagactcgtgtaat

SEQ ID NO: 136544 - DNA, 22 bp, Artificial Sequence
  chemically synthesized
gcagagaaagactcgtgtaatc

SEQ ID NO: 136545 - DNA, 22 bp, Artificial Sequence
  chemically synthesized
cagagaaagactcgtgtaatcc

SEQ ID NO: 136546 - DNA, 22 bp, Artificial Sequence
  chemically synthesized
gtgtaatccttgacaatgtcat

SEQ ID NO: 136547 - DNA, 22 bp, Artificial Sequence
  chemically synthesized
gacaatgtcatctcatctattt

SEQ ID NO: 136548 - DNA, 22 bp, Artificial Sequence
  chemically synthesized
acaatgtcatctcatctattta

SEQ ID NO: 136549 - DNA, 22 bp, Artificial Sequence
  chemically synthesized
atctatttattcccatgtctac

SEQ ID NO: 136550 - DNA, 22 bp, Artificial Sequence
  chemically synthesized
tttattcccatgtctacccata

SEQ ID NO: 136551 - DNA, 22 bp, Artificial Sequence
  chemically synthesized
attcccatgtctacccatatgt

SEQ ID NO: 136552 - DNA, 22 bp, Artificial Sequence
  chemically synthesized
ttcccatgtctacccatatgtg

SEQ ID NO: 136553 - DNA, 22 bp, Artificial Sequence
  chemically synthesized
ccatgtctacccatatgtgacc

SEQ ID NO: 136554 - DNA, 22 bp, Artificial Sequence
  chemically synthesized
cccatatgtgaccttcatgtct

SEQ ID NO: 136555 - DNA, 22 bp, Artificial Sequence
  chemically synthesized
catgtctttgctctaagcccct

SEQ ID NO: 136556 - DNA, 22 bp, Artificial Sequence
  chemically synthesized
atgtctttgctctaagccccta

SEQ ID NO: 136557 - DNA, 22 bp, Artificial Sequence
  chemically synthesized
tgctctaagcccctacatcctc

SEQ ID NO: 136558 - DNA, 22 bp, Artificial Sequence
  chemically synthesized
gctctaagcccctacatcctca

SEQ ID NO: 136559 - DNA, 22 bp, Artificial Sequence
  chemically synthesized
ctctaagcccctacatcctcaa

SEQ ID NO: 136560 - DNA, 22 bp, Artificial Sequence
  chemically synthesized
taagcccctacatcctcaatct

SEQ ID NO: 136561 - DNA, 22 bp, Artificial Sequence
  chemically synthesized
agcccctacatcctcaatctac

SEQ ID NO: 136562 - DNA, 22 bp, Artificial Sequence
  chemically synthesized
catcctcaatctacacactagg

SEQ ID NO: 136563 - DNA, 22 bp, Artificial Sequence
  chemically synthesized
aatctacacactaggatagtat

SEQ ID NO: 136564 - DNA, 22 bp, Artificial Sequence
  chemically synthesized
cacactaggatagtataaaagt

SEQ ID NO: 136565 - DNA, 22 bp, Artificial Sequence
  chemically synthesized
ggatagtataaaagtaatagta

SEQ ID NO: 136566 - DNA, 22 bp, Artificial Sequence
  chemically synthesized
tggcttatactatacacaagac

SEQ ID NO: 136567 - DNA, 22 bp, Artificial Sequence
  chemically synthesized
atactatacacaagacactgtt

SEQ ID NO: 136568 - DNA, 22 bp, Artificial Sequence
  chemically synthesized
tactatacacaagacactgttg

SEQ ID NO: 136569 - DNA, 22 bp, Artificial Sequence
  chemically synthesized
tacacaagacactgttgatata

SEQ ID NO: 136570 - DNA, 22 bp, Artificial Sequence
  chemically synthesized
ttgatatattatttcatttagt

SEQ ID NO: 136571 - DNA, 22 bp, Artificial Sequence
  chemically synthesized
atatattatttcatttagtatt

SEQ ID NO: 136572 - DNA, 22 bp, Artificial Sequence
  chemically synthesized
tttcatttagtattcacagtaa

SEQ ID NO: 136573 - DNA, 22 bp, Artificial Sequence
  chemically synthesized
catttagtattcacagtaactc

SEQ ID NO: 136574 - DNA, 22 bp, Artificial Sequence
  chemically synthesized
atttagtattcacagtaactct

SEQ ID NO: 136575 - DNA, 22 bp, Artificial Sequence
  chemically synthesized
agtattcacagtaactctgtgc

SEQ ID NO: 136576 - DNA, 22 bp, Artificial Sequence
  chemically synthesized
gtattcacagtaactctgtgcc

SEQ ID NO: 136577 - DNA, 22 bp, Artificial Sequence
  chemically synthesized
acagtaactctgtgcctcaagt

SEQ ID NO: 136578 - DNA, 22 bp, Artificial Sequence
  chemically synthesized
tgtgcctcaagtactattgtaa

SEQ ID NO: 136579 - DNA, 22 bp, Artificial Sequence
  chemically synthesized
tgcctcaagtactattgtaata

SEQ ID NO: 136580 - DNA, 22 bp, Artificial Sequence
  chemically synthesized
aagtactattgtaatacccttt

SEQ ID NO: 136581 - DNA, 22 bp, Artificial Sequence
  chemically synthesized
ttgtaataccctttaagaggag

SEQ ID NO: 136582 - DNA, 22 bp, Artificial Sequence
  chemically synthesized
taataccctttaagaggaggaa

SEQ ID NO: 136583 - DNA, 22 bp, Artificial Sequence
  chemically synthesized
taagaggaggaaactgaggcac

SEQ ID NO: 136584 - DNA, 22 bp, Artificial Sequence
  chemically synthesized
aagaggaggaaactgaggcaca

SEQ ID NO: 136585 - DNA, 22 bp, Artificial Sequence
  chemically synthesized
agaggaggaaactgaggcacag

SEQ ID NO: 136586 - DNA, 22 bp, Artificial Sequence
  chemically synthesized
aggcacagggccctaaagtaat

SEQ ID NO: 136587 - DNA, 22 bp, Artificial Sequence
  chemically synthesized
aagtaatattccaagatgaagt

SEQ ID NO: 136588 - DNA, 22 bp, Artificial Sequence
  chemically synthesized
caagatgaagtggctactaact

SEQ ID NO: 136589 - DNA, 22 bp, Artificial Sequence
  chemically synthesized
ctaactgacagagggcataatt

SEQ ID NO: 136590 - DNA, 22 bp, Artificial Sequence
  chemically synthesized
actgacagagggcataattcaa

SEQ ID NO: 136591 - DNA, 22 bp, Artificial Sequence
  chemically synthesized
acagagggcataattcaactca

SEQ ID NO: 136592 - DNA, 22 bp, Artificial Sequence
  chemically synthesized
aactcatgatatttggctctag

SEQ ID NO: 136593 - DNA, 22 bp, Artificial Sequence
  chemically synthesized
atgatatttggctctagaatac

SEQ ID NO: 136594 - DNA, 22 bp, Artificial Sequence
  chemically synthesized
ggctctagaatacatgctctga

SEQ ID NO: 136595 - DNA, 22 bp, Artificial Sequence
  chemically synthesized
gctctagaatacatgctctgaa

SEQ ID NO: 136596 - DNA, 22 bp, Artificial Sequence
  chemically synthesized
tagaatacatgctctgaatcat

SEQ ID NO: 136597 - DNA, 22 bp, Artificial Sequence
  chemically synthesized
gaatacatgctctgaatcatta

SEQ ID NO: 136598 - DNA, 22 bp, Artificial Sequence
  chemically synthesized
tgaatcattatacaataataat

SEQ ID NO: 136599 - DNA, 22 bp, Artificial Sequence
  chemically synthesized
aatcattatacaataataattc

SEQ ID NO: 136600 - DNA, 22 bp, Artificial Sequence
  chemically synthesized
tacaataataattcatgaggaa

SEQ ID NO: 136601 - DNA, 22 bp, Artificial Sequence
  chemically synthesized
atgaggaaacattttttaaagc

SEQ ID NO: 136602 - DNA, 22 bp, Artificial Sequence
  chemically synthesized
tttaaagcctaagttatttgct

SEQ ID NO: 136603 - DNA, 22 bp, Artificial Sequence
  chemically synthesized
ttaaagcctaagttatttgctc

SEQ ID NO: 136604 - DNA, 22 bp, Artificial Sequence
  chemically synthesized
taaagcctaagttatttgctct

SEQ ID NO: 136605 - DNA, 22 bp, Artificial Sequence
  chemically synthesized
aaagcctaagttatttgctctg

SEQ ID NO: 136606 - DNA, 22 bp, Artificial Sequence
  chemically synthesized
aagcctaagttatttgctctga

SEQ ID NO: 136607 - DNA, 22 bp, Artificial Sequence
  chemically synthesized
agttatttgctctgaaataaga

SEQ ID NO: 136608 - DNA, 22 bp, Artificial Sequence
  chemically synthesized
tttgctctgaaataagacataa

SEQ ID NO: 136609 - DNA, 22 bp, Artificial Sequence
  chemically synthesized
gctctgaaataagacataattt

SEQ ID NO: 136610 - DNA, 22 bp, Artificial Sequence
  chemically synthesized
ctctgaaataagacataatttg

SEQ ID NO: 136611 - DNA, 22 bp, Artificial Sequence
  chemically synthesized
tgaaataagacataatttgggg

SEQ ID NO: 136612 - DNA, 22 bp, Artificial Sequence
  chemically synthesized
aaataagacataatttggggtg

SEQ ID NO: 136613 - DNA, 22 bp, Artificial Sequence
  chemically synthesized
ggggtgagaaagcttagattcc

SEQ ID NO: 136614 - DNA, 22 bp, Artificial Sequence
  chemically synthesized
gggtgagaaagcttagattcca

SEQ ID NO: 136615 - DNA, 22 bp, Artificial Sequence
  chemically synthesized
agattccatgaagtattacagc

SEQ ID NO: 136616 - DNA, 22 bp, Artificial Sequence
  chemically synthesized
gattccatgaagtattacagca

SEQ ID NO: 136617 - DNA, 22 bp, Artificial Sequence
  chemically synthesized
catgaagtattacagcatttgg

SEQ ID NO: 136618 - DNA, 22 bp, Artificial Sequence
  chemically synthesized
cagcatttggtagtctttttgc

SEQ ID NO: 136619 - DNA, 22 bp, Artificial Sequence
  chemically synthesized
ggtagtctttttgcactccagg

SEQ ID NO: 136620 - DNA, 22 bp, Artificial Sequence
  chemically synthesized
gtagtctttttgcactccaggt

SEQ ID NO: 136621 - DNA, 22 bp, Artificial Sequence
  chemically synthesized
tttgcactccaggtcttatttt

SEQ ID NO: 136622 - DNA, 22 bp, Artificial Sequence
  chemically synthesized
ttgcactccaggtcttattttt

SEQ ID NO: 136623 - DNA, 22 bp, Artificial Sequence
  chemically synthesized
tgcactccaggtcttattttta

SEQ ID NO: 136624 - DNA, 22 bp, Artificial Sequence
  chemically synthesized
gcactccaggtcttatttttac

SEQ ID NO: 136625 - DNA, 22 bp, Artificial Sequence
  chemically synthesized
cactccaggtcttatttttact

SEQ ID NO: 136626 - DNA, 22 bp, Artificial Sequence
  chemically synthesized
caggtcttatttttactgctta

SEQ ID NO: 136627 - DNA, 22 bp, Artificial Sequence
  chemically synthesized
atttttactgcttaaacataat

SEQ ID NO: 136628 - DNA, 22 bp, Artificial Sequence
  chemically synthesized
tttttactgcttaaacataata

SEQ ID NO: 136629 - DNA, 22 bp, Artificial Sequence
  chemically synthesized
ttactgcttaaacataataaaa

SEQ ID NO: 136630 - DNA, 22 bp, Artificial Sequence
  chemically synthesized
tactgcttaaacataataaaac

SEQ ID NO: 136631 - DNA, 22 bp, Artificial Sequence
  chemically synthesized
actgcttaaacataataaaaca

SEQ ID NO: 136632 - DNA, 22 bp, Artificial Sequence
  chemically synthesized
ctgcttaaacataataaaacat

SEQ ID NO: 136633 - DNA, 22 bp, Artificial Sequence
  chemically synthesized
cttaaacataataaaacatatg

SEQ ID NO: 136634 - DNA, 22 bp, Artificial Sequence
  chemically synthesized
aaacataataaaacatatggtt

SEQ ID NO: 136635 - DNA, 22 bp, Artificial Sequence
  chemically synthesized
aacataataaaacatatggttc

SEQ ID NO: 136636 - DNA, 22 bp, Artificial Sequence
  chemically synthesized
agtatgcctttgattttacaat

SEQ ID NO: 136637 - DNA, 22 bp, Artificial Sequence
  chemically synthesized
tgattttacaataatattcctg

SEQ ID NO: 136638 - DNA, 22 bp, Artificial Sequence
  chemically synthesized
gattttacaataatattcctgt

SEQ ID NO: 136639 - DNA, 22 bp, Artificial Sequence
  chemically synthesized
attttacaataatattcctgtt

SEQ ID NO: 136640 - DNA, 22 bp, Artificial Sequence
  chemically synthesized
tacaataatattcctgttattt

SEQ ID NO: 136641 - DNA, 22 bp, Artificial Sequence
  chemically synthesized
acaataatattcctgttatttt

SEQ ID NO: 136642 - DNA, 22 bp, Artificial Sequence
  chemically synthesized
caataatattcctgttattttt

SEQ ID NO: 136643 - DNA, 22 bp, Artificial Sequence
  chemically synthesized
ctgttatttttggaagcacagg

SEQ ID NO: 136644 - DNA, 22 bp, Artificial Sequence
  chemically synthesized
ttatttttggaagcacagggtg

SEQ ID NO: 136645 - DNA, 22 bp, Artificial Sequence
  chemically synthesized
tttttggaagcacagggtgtgg

SEQ ID NO: 136646 - DNA, 22 bp, Artificial Sequence
  chemically synthesized
ttggaagcacagggtgtgggat

SEQ ID NO: 136647 - DNA, 22 bp, Artificial Sequence
  chemically synthesized
tggaagcacagggtgtgggata

SEQ ID NO: 136648 - DNA, 22 bp, Artificial Sequence
  chemically synthesized
ggaagcacagggtgtgggataa

SEQ ID NO: 136649 - DNA, 22 bp, Artificial Sequence
  chemically synthesized
gaagcacagggtgtgggataat

SEQ ID NO: 136650 - DNA, 22 bp, Artificial Sequence
  chemically synthesized
attactagtgattagtattgag

SEQ ID NO: 136651 - DNA, 22 bp, Artificial Sequence
  chemically synthesized
ctagtgattagtattgagaggt

SEQ ID NO: 136652 - DNA, 22 bp, Artificial Sequence
  chemically synthesized
gtgattagtattgagaggtgac

SEQ ID NO: 136653 - DNA, 22 bp, Artificial Sequence
  chemically synthesized
gtattgagaggtgacagcgtgc

SEQ ID NO: 136654 - DNA, 22 bp, Artificial Sequence
  chemically synthesized
agaggtgacagcgtgctggcag

SEQ ID NO: 136655 - DNA, 22 bp, Artificial Sequence
  chemically synthesized
gcagtcctcacagccctcgctc

SEQ ID NO: 136656 - DNA, 22 bp, Artificial Sequence
  chemically synthesized
acagccctcgctcgctcttggc

SEQ ID NO: 136657 - DNA, 22 bp, Artificial Sequence
  chemically synthesized
gctcgctcttggcgcctcctct

SEQ ID NO: 136658 - DNA, 22 bp, Artificial Sequence
  chemically synthesized
gctcttggcgcctcctctgcct

SEQ ID NO: 136659 - DNA, 22 bp, Artificial Sequence
  chemically synthesized
ttggcgcctcctctgcctgggc

SEQ ID NO: 136660 - DNA, 22 bp, Artificial Sequence
  chemically synthesized
ggcgcctcctctgcctgggctc

SEQ ID NO: 136661 - DNA, 22 bp, Artificial Sequence
  chemically synthesized
gcgcctcctctgcctgggctcc

SEQ ID NO: 136662 - DNA, 22 bp, Artificial Sequence
  chemically synthesized
ctctgcctgggctcccacattg

SEQ ID NO: 136663 - DNA, 22 bp, Artificial Sequence
  chemically synthesized
tgcctgggctcccacattggtg

SEQ ID NO: 136664 - DNA, 22 bp, Artificial Sequence
  chemically synthesized
cctgggctcccacattggtggc

SEQ ID NO: 136665 - DNA, 22 bp, Artificial Sequence
  chemically synthesized
ggctcccacattggtggcactt

SEQ ID NO: 136666 - DNA, 22 bp, Artificial Sequence
  chemically synthesized
ccacattggtggcacttgagga

SEQ ID NO: 136667 - DNA, 22 bp, Artificial Sequence
  chemically synthesized
gtggcacttgaggagcccttca

SEQ ID NO: 136668 - DNA, 22 bp, Artificial Sequence
  chemically synthesized
gaggagcccttcagccggccgc

SEQ ID NO: 136669 - DNA, 22 bp, Artificial Sequence
  chemically synthesized
aggagcccttcagccggccgct

SEQ ID NO: 136670 - DNA, 22 bp, Artificial Sequence
  chemically synthesized
cagccggccgctgcactgtggg

SEQ ID NO: 136671 - DNA, 22 bp, Artificial Sequence
  chemically synthesized
agccggccgctgcactgtggga

SEQ ID NO: 136672 - DNA, 22 bp, Artificial Sequence
  chemically synthesized
cactgtgggagcccttttctgg

SEQ ID NO: 136673 - DNA, 22 bp, Artificial Sequence
  chemically synthesized
tgggagcccttttctgggctgg

SEQ ID NO: 136674 - DNA, 22 bp, Artificial Sequence
  chemically synthesized
ttctgggctggccaaggccaga

SEQ ID NO: 136675 - DNA, 22 bp, Artificial Sequence
  chemically synthesized
tctgggctggccaaggccagag

SEQ ID NO: 136676 - DNA, 22 bp, Artificial Sequence
  chemically synthesized
ctgggctggccaaggccagagc

SEQ ID NO: 136677 - DNA, 22 bp, Artificial Sequence
  chemically synthesized
tgggctggccaaggccagagcc

SEQ ID NO: 136678 - DNA, 22 bp, Artificial Sequence
  chemically synthesized
ggctggccaaggccagagccgg

SEQ ID NO: 136679 - DNA, 22 bp, Artificial Sequence
  chemically synthesized
gccaaggccagagccggctccc

SEQ ID NO: 136680 - DNA, 22 bp, Artificial Sequence
  chemically synthesized
cctcagcttgccaggaggtgtg

SEQ ID NO: 136681 - DNA, 22 bp, Artificial Sequence
  chemically synthesized
agcttgccaggaggtgtggagg

SEQ ID NO: 136682 - DNA, 22 bp, Artificial Sequence
  chemically synthesized
gccaggaggtgtggagggacag

SEQ ID NO: 136683 - DNA, 22 bp, Artificial Sequence
  chemically synthesized
ccaggaggtgtggagggacaga

SEQ ID NO: 136684 - DNA, 22 bp, Artificial Sequence
  chemically synthesized
tgcgccgtgcttgagggagttc

SEQ ID NO: 136685 - DNA, 22 bp, Artificial Sequence
  chemically synthesized
gagggagttccgggtgggcatg

SEQ ID NO: 136686 - DNA, 22 bp, Artificial Sequence
  chemically synthesized
agggagttccgggtgggcatgg

SEQ ID NO: 136687 - DNA, 22 bp, Artificial Sequence
  chemically synthesized
cgggtgggcatgggctccgagg

SEQ ID NO: 136688 - DNA, 22 bp, Artificial Sequence
  chemically synthesized
cgaggaccccgcactcggagcc

SEQ ID NO: 136689 - DNA, 22 bp, Artificial Sequence
  chemically synthesized
ggagccgccagccggccccacc

SEQ ID NO: 136690 - DNA, 22 bp, Artificial Sequence
  chemically synthesized
agcacctgggccagcagctgct

SEQ ID NO: 136691 - DNA, 22 bp, Artificial Sequence
  chemically synthesized
gcacctgggccagcagctgctg

SEQ ID NO: 136692 - DNA, 22 bp, Artificial Sequence
  chemically synthesized
ggccagcagctgctgtgctcaa

SEQ ID NO: 136693 - DNA, 22 bp, Artificial Sequence
  chemically synthesized
ctgtgctcaattcctcgccggg

SEQ ID NO: 136694 - DNA, 22 bp, Artificial Sequence
  chemically synthesized
tgctcaattcctcgccgggcct

SEQ ID NO: 136695 - DNA, 22 bp, Artificial Sequence
  chemically synthesized
aattcctcgccgggccttagct

SEQ ID NO: 136696 - DNA, 22 bp, Artificial Sequence
  chemically synthesized
ctcgccgggccttagctgcctt

SEQ ID NO: 136697 - DNA, 22 bp, Artificial Sequence
  chemically synthesized
gccgggccttagctgccttcct

SEQ ID NO: 136698 - DNA, 22 bp, Artificial Sequence
  chemically synthesized
agctgccttcctgcggggcagg

SEQ ID NO: 136699 - DNA, 22 bp, Artificial Sequence
  chemically synthesized
gctgccttcctgcggggcaggg

SEQ ID NO: 136700 - DNA, 22 bp, Artificial Sequence
  chemically synthesized
ccttcctgcggggcagggctcg

SEQ ID NO: 136701 - DNA, 22 bp, Artificial Sequence
  chemically synthesized
cctgcggggcagggctcgggac

SEQ ID NO: 136702 - DNA, 22 bp, Artificial Sequence
  chemically synthesized
ctgcggggcagggctcgggacc

SEQ ID NO: 136703 - DNA, 22 bp, Artificial Sequence
  chemically synthesized
cggggcagggctcgggacctgc

SEQ ID NO: 136704 - DNA, 22 bp, Artificial Sequence
  chemically synthesized
gggacctgcagcgcgccatgcc

SEQ ID NO: 136705 - DNA, 22 bp, Artificial Sequence
  chemically synthesized
cagcgcgccatgcctgagcctc

SEQ ID NO: 136706 - DNA, 22 bp, Artificial Sequence
  chemically synthesized
agcctccccaccttcatgggct

SEQ ID NO: 136707 - DNA, 22 bp, Artificial Sequence
  chemically synthesized
cccaccttcatgggctcctgtg

SEQ ID NO: 136708 - DNA, 22 bp, Artificial Sequence
  chemically synthesized
catgggctcctgtgcggcccga

SEQ ID NO: 136709 - DNA, 22 bp, Artificial Sequence
  chemically synthesized
atgggctcctgtgcggcccgag

SEQ ID NO: 136710 - DNA, 22 bp, Artificial Sequence
  chemically synthesized
ctgtgcggcccgagcctcgccg

SEQ ID NO: 136711 - DNA, 22 bp, Artificial Sequence
  chemically synthesized
tgcggcccgagcctcgccgacg

SEQ ID NO: 136712 - DNA, 22 bp, Artificial Sequence
  chemically synthesized
gccgacgagcgccgccccctgc

SEQ ID NO: 136713 - DNA, 22 bp, Artificial Sequence
  chemically synthesized
ctccagggcacccagtcccatc

SEQ ID NO: 136714 - DNA, 22 bp, Artificial Sequence
  chemically synthesized
cagggcacccagtcccatcgac

SEQ ID NO: 136715 - DNA, 22 bp, Artificial Sequence
  chemically synthesized
aagagtgcgggcgcacggcagg

SEQ ID NO: 136716 - DNA, 22 bp, Artificial Sequence
  chemically synthesized
gcaggcagctccccctgcagcc

SEQ ID NO: 136717 - DNA, 22 bp, Artificial Sequence
  chemically synthesized
cccctgcagcccaggtgcggga

SEQ ID NO: 136718 - DNA, 22 bp, Artificial Sequence
  chemically synthesized
cagcccaggtgcgggatccact

SEQ ID NO: 136719 - DNA, 22 bp, Artificial Sequence
  chemically synthesized
ggtgaagccggctaggctcctg

SEQ ID NO: 136720 - DNA, 22 bp, Artificial Sequence
  chemically synthesized
ggctcctgagtttgctggggat

SEQ ID NO: 136721 - DNA, 22 bp, Artificial Sequence
  chemically synthesized
ctgagtttgctggggatgcgaa

SEQ ID NO: 136722 - DNA, 22 bp, Artificial Sequence
  chemically synthesized
agtttgctggggatgcgaagaa

SEQ ID NO: 136723 - DNA, 22 bp, Artificial Sequence
  chemically synthesized
gctggggatgcgaagaaccctt

SEQ ID NO: 136724 - DNA, 22 bp, Artificial Sequence
  chemically synthesized
ctggggatgcgaagaaccctta

SEQ ID NO: 136725 - DNA, 22 bp, Artificial Sequence
  chemically synthesized
gggatgcgaagaacccttatgt

SEQ ID NO: 136726 - DNA, 22 bp, Artificial Sequence
  chemically synthesized
atgtctagataagggattgtaa

SEQ ID NO: 136727 - DNA, 22 bp, Artificial Sequence
  chemically synthesized
tgtctagataagggattgtaaa

SEQ ID NO: 136728 - DNA, 22 bp, Artificial Sequence
  chemically synthesized
gataagggattgtaaatacacc

SEQ ID NO: 136729 - DNA, 22 bp, Artificial Sequence
  chemically synthesized
taaatacaccaattggcactct

SEQ ID NO: 136730 - DNA, 22 bp, Artificial Sequence
  chemically synthesized
gcactctgtatctagctcaagg

SEQ ID NO: 136731 - DNA, 22 bp, Artificial Sequence
  chemically synthesized
tgtatctagctcaaggtttgta

SEQ ID NO: 136732 - DNA, 22 bp, Artificial Sequence
  chemically synthesized
tatctagctcaaggtttgtaaa

SEQ ID NO: 136733 - DNA, 22 bp, Artificial Sequence
  chemically synthesized
gctcaaggtttgtaaacacacc

SEQ ID NO: 136734 - DNA, 22 bp, Artificial Sequence
  chemically synthesized
aaggtttgtaaacacaccaatc

SEQ ID NO: 136735 - DNA, 22 bp, Artificial Sequence
  chemically synthesized
gtaaacacaccaatcagcaccc

SEQ ID NO: 136736 - DNA, 22 bp, Artificial Sequence
  chemically synthesized
taaacacaccaatcagcaccct

SEQ ID NO: 136737 - DNA, 22 bp, Artificial Sequence
  chemically synthesized
tgtctagctcagggtttgtgaa

SEQ ID NO: 136738 - DNA, 22 bp, Artificial Sequence
  chemically synthesized
gctcagggtttgtgaatgcacc

SEQ ID NO: 136739 - DNA, 22 bp, Artificial Sequence
  chemically synthesized
agggtttgtgaatgcaccaatc

SEQ ID NO: 136740 - DNA, 22 bp, Artificial Sequence
  chemically synthesized
gtgaatgcaccaatcaacactc

SEQ ID NO: 136741 - DNA, 22 bp, Artificial Sequence
  chemically synthesized
tgaatgcaccaatcaacactct

SEQ ID NO: 136742 - DNA, 22 bp, Artificial Sequence
  chemically synthesized
tatctagctactctggtggggc

SEQ ID NO: 136743 - DNA, 22 bp, Artificial Sequence
  chemically synthesized
tctagctactctggtggggcct

SEQ ID NO: 136744 - DNA, 22 bp, Artificial Sequence
  chemically synthesized
gctactctggtggggccttgga

SEQ ID NO: 136745 - DNA, 22 bp, Artificial Sequence
  chemically synthesized
ctctggtggggccttggagaac

SEQ ID NO: 136746 - DNA, 22 bp, Artificial Sequence
  chemically synthesized
tggtggggccttggagaacctt

SEQ ID NO: 136747 - DNA, 22 bp, Artificial Sequence
  chemically synthesized
gtggggccttggagaaccttta

SEQ ID NO: 136748 - DNA, 22 bp, Artificial Sequence
  chemically synthesized
ggagaacctttatgtctagctc

SEQ ID NO: 136749 - DNA, 22 bp, Artificial Sequence
  chemically synthesized
gagaacctttatgtctagctca

SEQ ID NO: 136750 - DNA, 22 bp, Artificial Sequence
  chemically synthesized
tatgtctagctcagggattgta

SEQ ID NO: 136751 - DNA, 22 bp, Artificial Sequence
  chemically synthesized
atgtctagctcagggattgtaa

SEQ ID NO: 136752 - DNA, 22 bp, Artificial Sequence
  chemically synthesized
tgtctagctcagggattgtaaa

SEQ ID NO: 136753 - DNA, 22 bp, Artificial Sequence
  chemically synthesized
gctcagggattgtaaatacacc

SEQ ID NO: 136754 - DNA, 22 bp, Artificial Sequence
  chemically synthesized
agggattgtaaatacaccaatc

SEQ ID NO: 136755 - DNA, 22 bp, Artificial Sequence
  chemically synthesized
taaatacaccaatcggcagtct

SEQ ID NO: 136756 - DNA, 22 bp, Artificial Sequence
  chemically synthesized
tatctagctcaaggtttgtaaa

SEQ ID NO: 136757 - DNA, 22 bp, Artificial Sequence
  chemically synthesized
gctcaaggtttgtaaacacacc

SEQ ID NO: 136758 - DNA, 22 bp, Artificial Sequence
  chemically synthesized
aaggtttgtaaacacaccaatc

SEQ ID NO: 136759 - DNA, 22 bp, Artificial Sequence
  chemically synthesized
gtaaacacaccaatcagcaccc

SEQ ID NO: 136760 - DNA, 22 bp, Artificial Sequence
  chemically synthesized
taaacacaccaatcagcaccct

SEQ ID NO: 136761 - DNA, 22 bp, Artificial Sequence
  chemically synthesized
tgtctagctcagggtttgtgaa

SEQ ID NO: 136762 - DNA, 22 bp, Artificial Sequence
  chemically synthesized
gctcagggtttgtgaatgcacc

SEQ ID NO: 136763 - DNA, 22 bp, Artificial Sequence
  chemically synthesized
agggtttgtgaatgcaccaatc

SEQ ID NO: 136764 - DNA, 22 bp, Artificial Sequence
  chemically synthesized
gtgaatgcaccaatcaacactc

SEQ ID NO: 136765 - DNA, 22 bp, Artificial Sequence
  chemically synthesized
tgaatgcaccaatcaacactct

SEQ ID NO: 136766 - DNA, 22 bp, Artificial Sequence
  chemically synthesized
tgtatctagctactctggtggg

SEQ ID NO: 136767 - DNA, 22 bp, Artificial Sequence
  chemically synthesized
tatctagctactctggtgggga

SEQ ID NO: 136768 - DNA, 22 bp, Artificial Sequence
  chemically synthesized
gctactctggtggggacgtgga

SEQ ID NO: 136769 - DNA, 22 bp, Artificial Sequence
  chemically synthesized
ctctggtggggacgtggagaac

SEQ ID NO: 136770 - DNA, 22 bp, Artificial Sequence
  chemically synthesized
tggtggggacgtggagaacctt

SEQ ID NO: 136771 - DNA, 22 bp, Artificial Sequence
  chemically synthesized
gtggggacgtggagaaccttta

SEQ ID NO: 136772 - DNA, 22 bp, Artificial Sequence
  chemically synthesized
tatgtctagctcagggattgta

SEQ ID NO: 136773 - DNA, 22 bp, Artificial Sequence
  chemically synthesized
atgtctagctcagggattgtaa

SEQ ID NO: 136774 - DNA, 22 bp, Artificial Sequence
  chemically synthesized
tgtctagctcagggattgtaaa

SEQ ID NO: 136775 - DNA, 22 bp, Artificial Sequence
  chemically synthesized
gctcagggattgtaaatacacc

SEQ ID NO: 136776 - DNA, 22 bp, Artificial Sequence
  chemically synthesized
agggattgtaaatacaccactc

SEQ ID NO: 136777 - DNA, 22 bp, Artificial Sequence
  chemically synthesized
taaatacaccactcggcagtct

SEQ ID NO: 136778 - DNA, 22 bp, Artificial Sequence
  chemically synthesized
ggcagtctgtatctagctcaag

SEQ ID NO: 136779 - DNA, 22 bp, Artificial Sequence
  chemically synthesized
tatctagctcaaggtttgtaaa

SEQ ID NO: 136780 - DNA, 22 bp, Artificial Sequence
  chemically synthesized
gctcaaggtttgtaaacacacc

SEQ ID NO: 136781 - DNA, 22 bp, Artificial Sequence
  chemically synthesized
aaggtttgtaaacacaccaatc

SEQ ID NO: 136782 - DNA, 22 bp, Artificial Sequence
  chemically synthesized
gtaaacacaccaatcagcaccc

SEQ ID NO: 136783 - DNA, 22 bp, Artificial Sequence
  chemically synthesized
taaacacaccaatcagcaccct

SEQ ID NO: 136784 - DNA, 22 bp, Artificial Sequence
  chemically synthesized
tgtctagctcagggtttgtgaa

SEQ ID NO: 136785 - DNA, 22 bp, Artificial Sequence
  chemically synthesized
gctcagggtttgtgaatgcacc

SEQ ID NO: 136786 - DNA, 22 bp, Artificial Sequence
  chemically synthesized
agggtttgtgaatgcaccaatc

SEQ ID NO: 136787 - DNA, 22 bp, Artificial Sequence
  chemically synthesized
gtgaatgcaccaatcaacactc

SEQ ID NO: 136788 - DNA, 22 bp, Artificial Sequence
  chemically synthesized
tgaatgcaccaatcaacactct

SEQ ID NO: 136789 - DNA, 22 bp, Artificial Sequence
  chemically synthesized
tgtatctagctactctggtggg

SEQ ID NO: 136790 - DNA, 22 bp, Artificial Sequence
  chemically synthesized
tatctagctactctggtgggga

SEQ ID NO: 136791 - DNA, 22 bp, Artificial Sequence
  chemically synthesized
gctactctggtggggacttgga

SEQ ID NO: 136792 - DNA, 22 bp, Artificial Sequence
  chemically synthesized
ctctggtggggacttggagaac

SEQ ID NO: 136793 - DNA, 22 bp, Artificial Sequence
  chemically synthesized
tggtggggacttggagaacctt

SEQ ID NO: 136794 - DNA, 22 bp, Artificial Sequence
  chemically synthesized
gtggggacttggagaacctttg

SEQ ID NO: 136795 - DNA, 22 bp, Artificial Sequence
  chemically synthesized
ggagaacctttgtgtggacact

SEQ ID NO: 136796 - DNA, 22 bp, Artificial Sequence
  chemically synthesized
gagaacctttgtgtggacactc

SEQ ID NO: 136797 - DNA, 22 bp, Artificial Sequence
  chemically synthesized
tgtgtggacactctgtatctag

SEQ ID NO: 136798 - DNA, 22 bp, Artificial Sequence
  chemically synthesized
gtgtggacactctgtatctagc

SEQ ID NO: 136799 - DNA, 22 bp, Artificial Sequence
  chemically synthesized
tgtggacactctgtatctagct

SEQ ID NO: 136800 - DNA, 22 bp, Artificial Sequence
  chemically synthesized
tgtatctagctaatctggtggg

SEQ ID NO: 136801 - DNA, 22 bp, Artificial Sequence
  chemically synthesized
tatctagctaatctggtgggga

SEQ ID NO: 136802 - DNA, 22 bp, Artificial Sequence
  chemically synthesized
gctaatctggtggggacgtgga

SEQ ID NO: 136803 - DNA, 22 bp, Artificial Sequence
  chemically synthesized
atctggtggggacgtggagaac

SEQ ID NO: 136804 - DNA, 22 bp, Artificial Sequence
  chemically synthesized
gtggggacgtggagaacctttg

SEQ ID NO: 136805 - DNA, 22 bp, Artificial Sequence
  chemically synthesized
tgtgtctagctcatggattgta

SEQ ID NO: 136806 - DNA, 22 bp, Artificial Sequence
  chemically synthesized
gtgtctagctcatggattgtaa

SEQ ID NO: 136807 - DNA, 22 bp, Artificial Sequence
  chemically synthesized
tgtctagctcatggattgtaaa

SEQ ID NO: 136808 - DNA, 22 bp, Artificial Sequence
  chemically synthesized
gctcatggattgtaaatgcacc

SEQ ID NO: 136809 - DNA, 22 bp, Artificial Sequence
  chemically synthesized
atggattgtaaatgcaccaatc

SEQ ID NO: 136810 - DNA, 22 bp, Artificial Sequence
  chemically synthesized
taaatgcaccaatcagtgccct

SEQ ID NO: 136811 - DNA, 22 bp, Artificial Sequence
  chemically synthesized
tcaaaacagaccactgggctct

SEQ ID NO: 136812 - DNA, 22 bp, Artificial Sequence
  chemically synthesized
ggctctaccaatcagcaggatg

SEQ ID NO: 136813 - DNA, 22 bp, Artificial Sequence
  chemically synthesized
taccaatcagcaggatgtgggt

SEQ ID NO: 136814 - DNA, 22 bp, Artificial Sequence
  chemically synthesized
ccaatcagcaggatgtgggtgg

SEQ ID NO: 136815 - DNA, 22 bp, Artificial Sequence
  chemically synthesized
cccgagccagcagtggcaaccc

SEQ ID NO: 136816 - DNA, 22 bp, Artificial Sequence
  chemically synthesized
gggtccccttccacactgtgga

SEQ ID NO: 136817 - DNA, 22 bp, Artificial Sequence
  chemically synthesized
ccacactgtggaagctttgttc

SEQ ID NO: 136818 - DNA, 22 bp, Artificial Sequence
  chemically synthesized
cacactgtggaagctttgttct

SEQ ID NO: 136819 - DNA, 22 bp, Artificial Sequence
  chemically synthesized
tggaagctttgttctttcgctc

SEQ ID NO: 136820 - DNA, 22 bp, Artificial Sequence
  chemically synthesized
tgttctttcgctctttgcaata

SEQ ID NO: 136821 - DNA, 22 bp, Artificial Sequence
  chemically synthesized
gttctttcgctctttgcaataa

SEQ ID NO: 136822 - DNA, 22 bp, Artificial Sequence
  chemically synthesized
ttctttcgctctttgcaataaa

SEQ ID NO: 136823 - DNA, 22 bp, Artificial Sequence
  chemically synthesized
tttcgctctttgcaataaatct

SEQ ID NO: 136824 - DNA, 22 bp, Artificial Sequence
  chemically synthesized
tcgctctttgcaataaatcttg

SEQ ID NO: 136825 - DNA, 22 bp, Artificial Sequence
  chemically synthesized
cgctctttgcaataaatcttgc

SEQ ID NO: 136826 - DNA, 22 bp, Artificial Sequence
  chemically synthesized
gctctttgcaataaatcttgct

SEQ ID NO: 136827 - DNA, 22 bp, Artificial Sequence
  chemically synthesized
tttgcaataaatcttgctgctg

SEQ ID NO: 136828 - DNA, 22 bp, Artificial Sequence
  chemically synthesized
tgcaataaatcttgctgctgct

SEQ ID NO: 136829 - DNA, 22 bp, Artificial Sequence
  chemically synthesized
gcaataaatcttgctgctgctc

SEQ ID NO: 136830 - DNA, 22 bp, Artificial Sequence
  chemically synthesized
caataaatcttgctgctgctca

SEQ ID NO: 136831 - DNA, 22 bp, Artificial Sequence
  chemically synthesized
gctgctgctcactgtttgggtc

SEQ ID NO: 136832 - DNA, 22 bp, Artificial Sequence
  chemically synthesized
ctgctgctcactgtttgggtct

SEQ ID NO: 136833 - DNA, 22 bp, Artificial Sequence
  chemically synthesized
ctgctcactgtttgggtctaca

SEQ ID NO: 136834 - DNA, 22 bp, Artificial Sequence
  chemically synthesized
ctcactgtttgggtctacactg

SEQ ID NO: 136835 - DNA, 22 bp, Artificial Sequence
  chemically synthesized
actgtttgggtctacactgcct

SEQ ID NO: 136836 - DNA, 22 bp, Artificial Sequence
  chemically synthesized
tttgggtctacactgcctttat

SEQ ID NO: 136837 - DNA, 22 bp, Artificial Sequence
  chemically synthesized
gggtctacactgcctttatgag

SEQ ID NO: 136838 - DNA, 22 bp, Artificial Sequence
  chemically synthesized
ggtctacactgcctttatgagc

SEQ ID NO: 136839 - DNA, 22 bp, Artificial Sequence
  chemically synthesized
cactgcctttatgagctgtaac

SEQ ID NO: 136840 - DNA, 22 bp, Artificial Sequence
  chemically synthesized
cctttatgagctgtaacgctca

SEQ ID NO: 136841 - DNA, 22 bp, Artificial Sequence
  chemically synthesized
tatgagctgtaacgctcaccgc

SEQ ID NO: 136842 - DNA, 22 bp, Artificial Sequence
  chemically synthesized
atgagctgtaacgctcaccgcg

SEQ ID NO: 136843 - DNA, 22 bp, Artificial Sequence
  chemically synthesized
tgagctgtaacgctcaccgcga

SEQ ID NO: 136844 - DNA, 22 bp, Artificial Sequence
  chemically synthesized
taacgctcaccgcgaaggtctg

SEQ ID NO: 136845 - DNA, 22 bp, Artificial Sequence
  chemically synthesized
accgcgaaggtctgcagcttca

SEQ ID NO: 136846 - DNA, 22 bp, Artificial Sequence
  chemically synthesized
cagcttcactcttgaagccagc

SEQ ID NO: 136847 - DNA, 22 bp, Artificial Sequence
  chemically synthesized
cactcttgaagccagcgagacc

SEQ ID NO: 136848 - DNA, 22 bp, Artificial Sequence
  chemically synthesized
actcttgaagccagcgagacca

SEQ ID NO: 136849 - DNA, 22 bp, Artificial Sequence
  chemically synthesized
ttgaagccagcgagaccacgaa

SEQ ID NO: 136850 - DNA, 22 bp, Artificial Sequence
  chemically synthesized
gaagccagcgagaccacgaacc

SEQ ID NO: 136851 - DNA, 22 bp, Artificial Sequence
  chemically synthesized
aagccagcgagaccacgaaccc

SEQ ID NO: 136852 - DNA, 22 bp, Artificial Sequence
  chemically synthesized
cagaggcgccgccttaagagct

SEQ ID NO: 136853 - DNA, 22 bp, Artificial Sequence
  chemically synthesized
aagagctggaacgttcactgtg

SEQ ID NO: 136854 - DNA, 22 bp, Artificial Sequence
  chemically synthesized
agagctggaacgttcactgtga

SEQ ID NO: 136855 - DNA, 22 bp, Artificial Sequence
  chemically synthesized
gaacgttcactgtgaaggtctg

SEQ ID NO: 136856 - DNA, 22 bp, Artificial Sequence
  chemically synthesized
actgtgaaggtctgcagcttca

SEQ ID NO: 136857 - DNA, 22 bp, Artificial Sequence
  chemically synthesized
tgaaggtctgcagcttcactcc

SEQ ID NO: 136858 - DNA, 22 bp, Artificial Sequence
  chemically synthesized
cagcttcactcctgagccagcg

SEQ ID NO: 136859 - DNA, 22 bp, Artificial Sequence
  chemically synthesized
cactcctgagccagcgagacca

SEQ ID NO: 136860 - DNA, 22 bp, Artificial Sequence
  chemically synthesized
actcctgagccagcgagaccac

SEQ ID NO: 136861 - DNA, 22 bp, Artificial Sequence
  chemically synthesized
ctgagccagcgagaccacgaac

SEQ ID NO: 136862 - DNA, 22 bp, Artificial Sequence
  chemically synthesized
agccagcgagaccacgaaccca

SEQ ID NO: 136863 - DNA, 22 bp, Artificial Sequence
  chemically synthesized
cgaacacatccaaacatcagaa

SEQ ID NO: 136864 - DNA, 22 bp, Artificial Sequence
  chemically synthesized
cacacacgcagcctttaagaac

SEQ ID NO: 136865 - DNA, 22 bp, Artificial Sequence
  chemically synthesized
taagaactgtaacactcaccac

SEQ ID NO: 136866 - DNA, 22 bp, Artificial Sequence
  chemically synthesized
aagaactgtaacactcaccacg

SEQ ID NO: 136867 - DNA, 22 bp, Artificial Sequence
  chemically synthesized
agaactgtaacactcaccacga

SEQ ID NO: 136868 - DNA, 22 bp, Artificial Sequence
  chemically synthesized
taacactcaccacgagggtccc

SEQ ID NO: 136869 - DNA, 22 bp, Artificial Sequence
  chemically synthesized
accacgagggtccccggcttca

SEQ ID NO: 136870 - DNA, 22 bp, Artificial Sequence
  chemically synthesized
cattcttgaagtcagtgaaacc

SEQ ID NO: 136871 - DNA, 22 bp, Artificial Sequence
  chemically synthesized
attcttgaagtcagtgaaacca

SEQ ID NO: 136872 - DNA, 22 bp, Artificial Sequence
  chemically synthesized
ttgaagtcagtgaaaccaagaa

SEQ ID NO: 136873 - DNA, 22 bp, Artificial Sequence
  chemically synthesized
gaagtcagtgaaaccaagaacc

SEQ ID NO: 136874 - DNA, 22 bp, Artificial Sequence
  chemically synthesized
aagtcagtgaaaccaagaaccc

SEQ ID NO: 136875 - DNA, 22 bp, Artificial Sequence
  chemically synthesized
cggacacagtatgtcagaaaca

SEQ ID NO: 136876 - DNA, 22 bp, Artificial Sequence
  chemically synthesized
aatcaatatacttctcaacaat

SEQ ID NO: 136877 - DNA, 22 bp, Artificial Sequence
  chemically synthesized
ctcaacaatttccaacagccct

SEQ ID NO: 136878 - DNA, 22 bp, Artificial Sequence
  chemically synthesized
tcaacaatttccaacagccctt

SEQ ID NO: 136879 - DNA, 22 bp, Artificial Sequence
  chemically synthesized
aacaatttccaacagcccttgc

SEQ ID NO: 136880 - DNA, 22 bp, Artificial Sequence
  chemically synthesized
ccaacagcccttgcaattaact

SEQ ID NO: 136881 - DNA, 22 bp, Artificial Sequence
  chemically synthesized
caacagcccttgcaattaactt

SEQ ID NO: 136882 - DNA, 22 bp, Artificial Sequence
  chemically synthesized
gcaattaacttggccatgtgac

SEQ ID NO: 136883 - DNA, 22 bp, Artificial Sequence
  chemically synthesized
caattaacttggccatgtgact

SEQ ID NO: 136884 - DNA, 22 bp, Artificial Sequence
  chemically synthesized
acttggccatgtgactggttgt

SEQ ID NO: 136885 - DNA, 22 bp, Artificial Sequence
  chemically synthesized
ggccatgtgactggttgtgact

SEQ ID NO: 136886 - DNA, 22 bp, Artificial Sequence
  chemically synthesized
gccatgtgactggttgtgacta

SEQ ID NO: 136887 - DNA, 22 bp, Artificial Sequence
  chemically synthesized
gttgtgactaaaataatgtgga

SEQ ID NO: 136888 - DNA, 22 bp, Artificial Sequence
  chemically synthesized
tgactaaaataatgtggagata

SEQ ID NO: 136889 - DNA, 22 bp, Artificial Sequence
  chemically synthesized
aaataatgtggagataataatg

SEQ ID NO: 136890 - DNA, 22 bp, Artificial Sequence
  chemically synthesized
ctccctaaggcagagtgccctt

SEQ ID NO: 136891 - DNA, 22 bp, Artificial Sequence
  chemically synthesized
cctaaggcagagtgcccttcta

SEQ ID NO: 136892 - DNA, 22 bp, Artificial Sequence
  chemically synthesized
aggcagagtgcccttctatcat

SEQ ID NO: 136893 - DNA, 22 bp, Artificial Sequence
  chemically synthesized
ctatcattctctttcccttcct

SEQ ID NO: 136894 - DNA, 22 bp, Artificial Sequence
  chemically synthesized
tatcattctctttcccttcctc

SEQ ID NO: 136895 - DNA, 22 bp, Artificial Sequence
  chemically synthesized
tcattctctttcccttcctcta

SEQ ID NO: 136896 - DNA, 22 bp, Artificial Sequence
  chemically synthesized
tctttcccttcctctatgtggc

SEQ ID NO: 136897 - DNA, 22 bp, Artificial Sequence
  chemically synthesized
tttcccttcctctatgtggcag

SEQ ID NO: 136898 - DNA, 22 bp, Artificial Sequence
  chemically synthesized
tcccttcctctatgtggcagaa

SEQ ID NO: 136899 - DNA, 22 bp, Artificial Sequence
  chemically synthesized
cccttcctctatgtggcagaaa

SEQ ID NO: 136900 - DNA, 22 bp, Artificial Sequence
  chemically synthesized
ccttcctctatgtggcagaaag

SEQ ID NO: 136901 - DNA, 22 bp, Artificial Sequence
  chemically synthesized
cctctatgtggcagaaagtaaa

SEQ ID NO: 136902 - DNA, 22 bp, Artificial Sequence
  chemically synthesized
ctctatgtggcagaaagtaaaa

SEQ ID NO: 136903 - DNA, 22 bp, Artificial Sequence
  chemically synthesized
tatgtggcagaaagtaaaagat

SEQ ID NO: 136904 - DNA, 22 bp, Artificial Sequence
  chemically synthesized
tgtggcagaaagtaaaagattc

SEQ ID NO: 136905 - DNA, 22 bp, Artificial Sequence
  chemically synthesized
tgaaatgataaagtcaatcaca

SEQ ID NO: 136906 - DNA, 22 bp, Artificial Sequence
  chemically synthesized
aaatgataaagtcaatcacagg

SEQ ID NO: 136907 - DNA, 22 bp, Artificial Sequence
  chemically synthesized
gactcctggcccactgcttgga

SEQ ID NO: 136908 - DNA, 22 bp, Artificial Sequence
  chemically synthesized
ctggcccactgcttggaggaga

SEQ ID NO: 136909 - DNA, 22 bp, Artificial Sequence
  chemically synthesized
gcccactgcttggaggagagca

SEQ ID NO: 136910 - DNA, 22 bp, Artificial Sequence
  chemically synthesized
cttggaggagagcactcaggac

SEQ ID NO: 136911 - DNA, 22 bp, Artificial Sequence
  chemically synthesized
ggaggagagcactcaggaccat

SEQ ID NO: 136912 - DNA, 22 bp, Artificial Sequence
  chemically synthesized
gaggagagcactcaggaccatg

SEQ ID NO: 136913 - DNA, 22 bp, Artificial Sequence
  chemically synthesized
aggaccatgaacatctgactgt

SEQ ID NO: 136914 - DNA, 22 bp, Artificial Sequence
  chemically synthesized
actgtgacgtagcaataaagaa

SEQ ID NO: 136915 - DNA, 22 bp, Artificial Sequence
  chemically synthesized
tgacgtagcaataaagaaaccc

SEQ ID NO: 136916 - DNA, 22 bp, Artificial Sequence
  chemically synthesized
catatgaaactgcttaaaatta

SEQ ID NO: 136917 - DNA, 22 bp, Artificial Sequence
  chemically synthesized
atatgaaactgcttaaaattaa

SEQ ID NO: 136918 - DNA, 22 bp, Artificial Sequence
  chemically synthesized
cttaaaattaatggcacaagtc

SEQ ID NO: 136919 - DNA, 22 bp, Artificial Sequence
  chemically synthesized
aaaattaatggcacaagtcatg

SEQ ID NO: 136920 - DNA, 22 bp, Artificial Sequence
  chemically synthesized
aaattaatggcacaagtcatgt

SEQ ID NO: 136921 - DNA, 22 bp, Artificial Sequence
  chemically synthesized
atggcacaagtcatgtttttga

SEQ ID NO: 136922 - DNA, 22 bp, Artificial Sequence
  chemically synthesized
ttgatgttgcacatttgtcttt

SEQ ID NO: 136923 - DNA, 22 bp, Artificial Sequence
  chemically synthesized
tgatgttgcacatttgtcttta

SEQ ID NO: 136924 - DNA, 22 bp, Artificial Sequence
  chemically synthesized
gatgttgcacatttgtctttat

SEQ ID NO: 136925 - DNA, 22 bp, Artificial Sequence
  chemically synthesized
atgttgcacatttgtctttatt

SEQ ID NO: 136926 - DNA, 22 bp, Artificial Sequence
  chemically synthesized
cacatttgtctttatttgtggc

SEQ ID NO: 136927 - DNA, 22 bp, Artificial Sequence
  chemically synthesized
gtctttatttgtggcttgtttt

SEQ ID NO: 136928 - DNA, 22 bp, Artificial Sequence
  chemically synthesized
tctttatttgtggcttgttttg

SEQ ID NO: 136929 - DNA, 22 bp, Artificial Sequence
  chemically synthesized
tatttgtggcttgttttgcttc

SEQ ID NO: 136930 - DNA, 22 bp, Artificial Sequence
  chemically synthesized
atttgtggcttgttttgcttcc

SEQ ID NO: 136931 - DNA, 22 bp, Artificial Sequence
  chemically synthesized
tttgtggcttgttttgcttcca

SEQ ID NO: 136932 - DNA, 22 bp, Artificial Sequence
  chemically synthesized
gtggcttgttttgcttccacat

SEQ ID NO: 136933 - DNA, 22 bp, Artificial Sequence
  chemically synthesized
tggcttgttttgcttccacatc

SEQ ID NO: 136934 - DNA, 22 bp, Artificial Sequence
  chemically synthesized
gttttgcttccacatcaatcca

SEQ ID NO: 136935 - DNA, 22 bp, Artificial Sequence
  chemically synthesized
ttttgcttccacatcaatccac

SEQ ID NO: 136936 - DNA, 22 bp, Artificial Sequence
  chemically synthesized
tgcttccacatcaatccactca

SEQ ID NO: 136937 - DNA, 22 bp, Artificial Sequence
  chemically synthesized
gcttccacatcaatccactcaa

SEQ ID NO: 136938 - DNA, 22 bp, Artificial Sequence
  chemically synthesized
cttccacatcaatccactcaag

SEQ ID NO: 136939 - DNA, 22 bp, Artificial Sequence
  chemically synthesized
ccacatcaatccactcaaggcc

SEQ ID NO: 136940 - DNA, 22 bp, Artificial Sequence
  chemically synthesized
cacatcaatccactcaaggcct

SEQ ID NO: 136941 - DNA, 22 bp, Artificial Sequence
  chemically synthesized
aaggcctacattctgctataat

SEQ ID NO: 136942 - DNA, 22 bp, Artificial Sequence
  chemically synthesized
cattctgctataatgcaatttc

SEQ ID NO: 136943 - DNA, 22 bp, Artificial Sequence
  chemically synthesized
tgctataatgcaatttcaagtt

SEQ ID NO: 136944 - DNA, 22 bp, Artificial Sequence
  chemically synthesized
ctataatgcaatttcaagttct

SEQ ID NO: 136945 - DNA, 22 bp, Artificial Sequence
  chemically synthesized
taatgcaatttcaagttcttta

SEQ ID NO: 136946 - DNA, 22 bp, Artificial Sequence
  chemically synthesized
caagttctttacaggccgagaa

SEQ ID NO: 136947 - DNA, 22 bp, Artificial Sequence
  chemically synthesized
aagttctttacaggccgagaaa

SEQ ID NO: 136948 - DNA, 22 bp, Artificial Sequence
  chemically synthesized
tttacaggccgagaaaaatgaa

SEQ ID NO: 136949 - DNA, 22 bp, Artificial Sequence
  chemically synthesized
tacaggccgagaaaaatgaatc

SEQ ID NO: 136950 - DNA, 22 bp, Artificial Sequence
  chemically synthesized
acaggccgagaaaaatgaatct

SEQ ID NO: 136951 - DNA, 22 bp, Artificial Sequence
  chemically synthesized
caggccgagaaaaatgaatctg

SEQ ID NO: 136952 - DNA, 22 bp, Artificial Sequence
  chemically synthesized
aattcctgacctccaaaagtga

SEQ ID NO: 136953 - DNA, 22 bp, Artificial Sequence
  chemically synthesized
ctgacctccaaaagtgatcaag

SEQ ID NO: 136954 - DNA, 22 bp, Artificial Sequence
  chemically synthesized
acctccaaaagtgatcaagata

SEQ ID NO: 136955 - DNA, 22 bp, Artificial Sequence
  chemically synthesized
caaaagtgatcaagatattttt

SEQ ID NO: 136956 - DNA, 22 bp, Artificial Sequence
  chemically synthesized
ttagttcaggctccaaaatttt

SEQ ID NO: 136957 - DNA, 22 bp, Artificial Sequence
  chemically synthesized
tagttcaggctccaaaattttc

SEQ ID NO: 136958 - DNA, 22 bp, Artificial Sequence
  chemically synthesized
agttcaggctccaaaattttct

SEQ ID NO: 136959 - DNA, 22 bp, Artificial Sequence
  chemically synthesized
gttcaggctccaaaattttctc

SEQ ID NO: 136960 - DNA, 22 bp, Artificial Sequence
  chemically synthesized
aggctccaaaattttctcattt

SEQ ID NO: 136961 - DNA, 22 bp, Artificial Sequence
  chemically synthesized
caaaattttctcattttcatag

SEQ ID NO: 136962 - DNA, 22 bp, Artificial Sequence
  chemically synthesized
tctcattttcataggttttcct

SEQ ID NO: 136963 - DNA, 22 bp, Artificial Sequence
  chemically synthesized
ctcattttcataggttttcctc

SEQ ID NO: 136964 - DNA, 22 bp, Artificial Sequence
  chemically synthesized
tcattttcataggttttcctcg

SEQ ID NO: 136965 - DNA, 22 bp, Artificial Sequence
  chemically synthesized
attttcataggttttcctcgat

SEQ ID NO: 136966 - DNA, 22 bp, Artificial Sequence
  chemically synthesized
tcataggttttcctcgattgat

SEQ ID NO: 136967 - DNA, 22 bp, Artificial Sequence
  chemically synthesized
cataggttttcctcgattgatc

SEQ ID NO: 136968 - DNA, 22 bp, Artificial Sequence
  chemically synthesized
ataggttttcctcgattgatca

SEQ ID NO: 136969 - DNA, 22 bp, Artificial Sequence
  chemically synthesized
tcctcgattgatcattattcat

SEQ ID NO: 136970 - DNA, 22 bp, Artificial Sequence
  chemically synthesized
cctcgattgatcattattcatg

SEQ ID NO: 136971 - DNA, 22 bp, Artificial Sequence
  chemically synthesized
ctcgattgatcattattcatga

SEQ ID NO: 136972 - DNA, 22 bp, Artificial Sequence
  chemically synthesized
gattgatcattattcatgattt

SEQ ID NO: 136973 - DNA, 22 bp, Artificial Sequence
  chemically synthesized
atcattattcatgatttgcaag

SEQ ID NO: 136974 - DNA, 22 bp, Artificial Sequence
  chemically synthesized
ttcatgatttgcaaggaatcat

SEQ ID NO: 136975 - DNA, 22 bp, Artificial Sequence
  chemically synthesized
atgatttgcaaggaatcattca

SEQ ID NO: 136976 - DNA, 22 bp, Artificial Sequence
  chemically synthesized
gcaaggaatcattcaatgtttt

SEQ ID NO: 136977 - DNA, 22 bp, Artificial Sequence
  chemically synthesized
caaggaatcattcaatgttttc

SEQ ID NO: 136978 - DNA, 22 bp, Artificial Sequence
  chemically synthesized
aatgttttctaaatctattact

SEQ ID NO: 136979 - DNA, 22 bp, Artificial Sequence
  chemically synthesized
tctaaatctattactgcatcct

SEQ ID NO: 136980 - DNA, 22 bp, Artificial Sequence
  chemically synthesized
ctaaatctattactgcatcctg

SEQ ID NO: 136981 - DNA, 22 bp, Artificial Sequence
  chemically synthesized
taaatctattactgcatcctga

SEQ ID NO: 136982 - DNA, 22 bp, Artificial Sequence
  chemically synthesized
aatctattactgcatcctgaca

SEQ ID NO: 136983 - DNA, 22 bp, Artificial Sequence
  chemically synthesized
ttactgcatcctgacacatatg

SEQ ID NO: 136984 - DNA, 22 bp, Artificial Sequence
  chemically synthesized
ctgcatcctgacacatatgaca

SEQ ID NO: 136985 - DNA, 22 bp, Artificial Sequence
  chemically synthesized
catcctgacacatatgacattt

SEQ ID NO: 136986 - DNA, 22 bp, Artificial Sequence
  chemically synthesized
acacatatgacattttaactat

SEQ ID NO: 136987 - DNA, 22 bp, Artificial Sequence
  chemically synthesized
taactatgttccagatttttga

SEQ ID NO: 136988 - DNA, 22 bp, Artificial Sequence
  chemically synthesized
aactatgttccagatttttgaa

SEQ ID NO: 136989 - DNA, 22 bp, Artificial Sequence
  chemically synthesized
actatgttccagatttttgaat

SEQ ID NO: 136990 - DNA, 22 bp, Artificial Sequence
  chemically synthesized
tgttccagatttttgaatgaag

SEQ ID NO: 136991 - DNA, 22 bp, Artificial Sequence
  chemically synthesized
cagatttttgaatgaagagtgt

SEQ ID NO: 136992 - DNA, 22 bp, Artificial Sequence
  chemically synthesized
ttgaatgaagagtgtaaatttt

SEQ ID NO: 136993 - DNA, 22 bp, Artificial Sequence
  chemically synthesized
tgaatgaagagtgtaaatttta

SEQ ID NO: 136994 - DNA, 22 bp, Artificial Sequence
  chemically synthesized
gaatgaagagtgtaaattttaa

SEQ ID NO: 136995 - DNA, 22 bp, Artificial Sequence
  chemically synthesized
aatgaagagtgtaaattttaaa

SEQ ID NO: 136996 - DNA, 22 bp, Artificial Sequence
  chemically synthesized
taaatgttttcaccacaaaaaa

SEQ ID NO: 136997 - DNA, 22 bp, Artificial Sequence
  chemically synthesized
aaatgttttcaccacaaaaaat

SEQ ID NO: 136998 - DNA, 22 bp, Artificial Sequence
  chemically synthesized
aatgttttcaccacaaaaaata

SEQ ID NO: 136999 - DNA, 22 bp, Artificial Sequence
  chemically synthesized
tcaccacaaaaaataagtatgt

SEQ ID NO: 137000 - DNA, 22 bp, Artificial Sequence
  chemically synthesized
caccacaaaaaataagtatgtg

SEQ ID NO: 137001 - DNA, 22 bp, Artificial Sequence
  chemically synthesized
accacaaaaaataagtatgtga

SEQ ID NO: 137002 - DNA, 22 bp, Artificial Sequence
  chemically synthesized
gttaattagccttatttaacca

SEQ ID NO: 137003 - DNA, 22 bp, Artificial Sequence
  chemically synthesized
ttaattagccttatttaaccat

SEQ ID NO: 137004 - DNA, 22 bp, Artificial Sequence
  chemically synthesized
attagccttatttaaccattta

SEQ ID NO: 137005 - DNA, 22 bp, Artificial Sequence
  chemically synthesized
gccttatttaaccatttaatat

SEQ ID NO: 137006 - DNA, 22 bp, Artificial Sequence
  chemically synthesized
atttaaccatttaatattgtac

SEQ ID NO: 137007 - DNA, 22 bp, Artificial Sequence
  chemically synthesized
tttaaccatttaatattgtaca

SEQ ID NO: 137008 - DNA, 22 bp, Artificial Sequence
  chemically synthesized
aaccatttaatattgtacacgt

SEQ ID NO: 137009 - DNA, 22 bp, Artificial Sequence
  chemically synthesized
accatttaatattgtacacgta

SEQ ID NO: 137010 - DNA, 22 bp, Artificial Sequence
  chemically synthesized
aatattgtacacgtacaccaaa

SEQ ID NO: 137011 - DNA, 22 bp, Artificial Sequence
  chemically synthesized
atattgtacacgtacaccaaag

SEQ ID NO: 137012 - DNA, 22 bp, Artificial Sequence
  chemically synthesized
tacacgtacaccaaagcatcat

SEQ ID NO: 137013 - DNA, 22 bp, Artificial Sequence
  chemically synthesized
taccccatgaatacacacaatt

SEQ ID NO: 137014 - DNA, 22 bp, Artificial Sequence
  chemically synthesized
ttatttgtcaatttaaaatgaa

SEQ ID NO: 137015 - DNA, 22 bp, Artificial Sequence
  chemically synthesized
tttgtcaatttaaaatgaaata

SEQ ID NO: 137016 - DNA, 22 bp, Artificial Sequence
  chemically synthesized
gtcaatttaaaatgaaataata

SEQ ID NO: 137017 - DNA, 22 bp, Artificial Sequence
  chemically synthesized
tcaatttaaaatgaaataataa

SEQ ID NO: 137018 - DNA, 22 bp, Artificial Sequence
  chemically synthesized
aaaatgaaataataaaaaataa

SEQ ID NO: 137019 - DNA, 22 bp, Artificial Sequence
  chemically synthesized
aaatgaaataataaaaaataac

SEQ ID NO: 137020 - DNA, 22 bp, Artificial Sequence
  chemically synthesized
gcctctgcattgcctttaccgg

SEQ ID NO: 137021 - DNA, 22 bp, Artificial Sequence
  chemically synthesized
tgcattgcctttaccggtcatc

SEQ ID NO: 137022 - DNA, 22 bp, Artificial Sequence
  chemically synthesized
cattgcctttaccggtcatcct

SEQ ID NO: 137023 - DNA, 22 bp, Artificial Sequence
  chemically synthesized
cctttaccggtcatcctcacgg

SEQ ID NO: 137024 - DNA, 22 bp, Artificial Sequence
  chemically synthesized
taccggtcatcctcacggtgac

SEQ ID NO: 137025 - DNA, 22 bp, Artificial Sequence
  chemically synthesized
accggtcatcctcacggtgact

SEQ ID NO: 137026 - DNA, 22 bp, Artificial Sequence
  chemically synthesized
ccggtcatcctcacggtgacta

SEQ ID NO: 137027 - DNA, 22 bp, Artificial Sequence
  chemically synthesized
acggtgactaacgcaaaaaacg

SEQ ID NO: 137028 - DNA, 22 bp, Artificial Sequence
  chemically synthesized
acgcaaaaaacgttctatttca

SEQ ID NO: 137029 - DNA, 22 bp, Artificial Sequence
  chemically synthesized
tatttcatccttacaaacatcc

SEQ ID NO: 137030 - DNA, 22 bp, Artificial Sequence
  chemically synthesized
tttcatccttacaaacatccct

SEQ ID NO: 137031 - DNA, 22 bp, Artificial Sequence
  chemically synthesized
catccttacaaacatccctatc

SEQ ID NO: 137032 - DNA, 22 bp, Artificial Sequence
  chemically synthesized
atccttacaaacatccctatct

SEQ ID NO: 137033 - DNA, 22 bp, Artificial Sequence
  chemically synthesized
acaaacatccctatctttgatg

SEQ ID NO: 137034 - DNA, 22 bp, Artificial Sequence
  chemically synthesized
caaacatccctatctttgatgc

SEQ ID NO: 137035 - DNA, 22 bp, Artificial Sequence
  chemically synthesized
tctttgatgcctctttgtctag

SEQ ID NO: 137036 - DNA, 22 bp, Artificial Sequence
  chemically synthesized
tgatgcctctttgtctagatct

SEQ ID NO: 137037 - DNA, 22 bp, Artificial Sequence
  chemically synthesized
gatgcctctttgtctagatctc

SEQ ID NO: 137038 - DNA, 22 bp, Artificial Sequence
  chemically synthesized
atgcctctttgtctagatctct

SEQ ID NO: 137039 - DNA, 22 bp, Artificial Sequence
  chemically synthesized
tttgtctagatctctatcccct

SEQ ID NO: 137040 - DNA, 22 bp, Artificial Sequence
  chemically synthesized
tgtctagatctctatcccctcc

SEQ ID NO: 137041 - DNA, 22 bp, Artificial Sequence
  chemically synthesized
gtctagatctctatcccctcct

SEQ ID NO: 137042 - DNA, 22 bp, Artificial Sequence
  chemically synthesized
tctagatctctatcccctcctg

SEQ ID NO: 137043 - DNA, 22 bp, Artificial Sequence
  chemically synthesized
gatctctatcccctcctgtttt

SEQ ID NO: 137044 - DNA, 22 bp, Artificial Sequence
  chemically synthesized
tatcccctcctgttttctctac

SEQ ID NO: 137045 - DNA, 22 bp, Artificial Sequence
  chemically synthesized
tcccctcctgttttctctacgt

SEQ ID NO: 137046 - DNA, 22 bp, Artificial Sequence
  chemically synthesized
ctgttttctctacgttatttat

SEQ ID NO: 137047 - DNA, 22 bp, Artificial Sequence
  chemically synthesized
ttttctctacgttatttatatg

SEQ ID NO: 137048 - DNA, 22 bp, Artificial Sequence
  chemically synthesized
tctctacgttatttatatgggt

SEQ ID NO: 137049 - DNA, 22 bp, Artificial Sequence
  chemically synthesized
ctctacgttatttatatgggta

SEQ ID NO: 137050 - DNA, 22 bp, Artificial Sequence
  chemically synthesized
tctacgttatttatatgggtat

SEQ ID NO: 137051 - DNA, 22 bp, Artificial Sequence
  chemically synthesized
tacgttatttatatgggtatca

SEQ ID NO: 137052 - DNA, 22 bp, Artificial Sequence
  chemically synthesized
cgttatttatatgggtatcatc

SEQ ID NO: 137053 - DNA, 22 bp, Artificial Sequence
  chemically synthesized
tttatatgggtatcatcaccat

SEQ ID NO: 137054 - DNA, 22 bp, Artificial Sequence
  chemically synthesized
atatgggtatcatcaccatcct

SEQ ID NO: 137055 - DNA, 22 bp, Artificial Sequence
  chemically synthesized
tatgggtatcatcaccatcctg

SEQ ID NO: 137056 - DNA, 22 bp, Artificial Sequence
  chemically synthesized
gacaacatcaggacagatatcc

SEQ ID NO: 137057 - DNA, 22 bp, Artificial Sequence
  chemically synthesized
accaagccaatgttcctctcta

SEQ ID NO: 137058 - DNA, 22 bp, Artificial Sequence
  chemically synthesized
ctctctatgttggctcaaatgt

SEQ ID NO: 137059 - DNA, 22 bp, Artificial Sequence
  chemically synthesized
tctatgttggctcaaatgtcct

SEQ ID NO: 137060 - DNA, 22 bp, Artificial Sequence
  chemically synthesized
tatgttggctcaaatgtccttg

SEQ ID NO: 137061 - DNA, 22 bp, Artificial Sequence
  chemically synthesized
tgttggctcaaatgtccttgaa

SEQ ID NO: 137062 - DNA, 22 bp, Artificial Sequence
  chemically synthesized
gctcaaatgtccttgaactttc

SEQ ID NO: 137063 - DNA, 22 bp, Artificial Sequence
  chemically synthesized
aaatgtccttgaactttccttt

SEQ ID NO: 137064 - DNA, 22 bp, Artificial Sequence
  chemically synthesized
gaactttcctttcaccaccctt

SEQ ID NO: 137065 - DNA, 22 bp, Artificial Sequence
  chemically synthesized
aactttcctttcaccacccttt

SEQ ID NO: 137066 - DNA, 22 bp, Artificial Sequence
  chemically synthesized
tcctttcaccaccctttccaca

SEQ ID NO: 137067 - DNA, 22 bp, Artificial Sequence
  chemically synthesized
cctttcaccaccctttccacag

SEQ ID NO: 137068 - DNA, 22 bp, Artificial Sequence
  chemically synthesized
ctttcaccaccctttccacagt

SEQ ID NO: 137069 - DNA, 22 bp, Artificial Sequence
  chemically synthesized
tcaccaccctttccacagtcaa

SEQ ID NO: 137070 - DNA, 22 bp, Artificial Sequence
  chemically synthesized
caccaccctttccacagtcaaa

SEQ ID NO: 137071 - DNA, 22 bp, Artificial Sequence
  chemically synthesized
accaccctttccacagtcaaaa

SEQ ID NO: 137072 - DNA, 22 bp, Artificial Sequence
  chemically synthesized
tccacagtcaaaaggatattgt

SEQ ID NO: 137073 - DNA, 22 bp, Artificial Sequence
  chemically synthesized
ccacagtcaaaaggatattgta

SEQ ID NO: 137074 - DNA, 22 bp, Artificial Sequence
  chemically synthesized
cacagtcaaaaggatattgtag

SEQ ID NO: 137075 - DNA, 22 bp, Artificial Sequence
  chemically synthesized
tagtttaatgcctcagagttca

SEQ ID NO: 137076 - DNA, 22 bp, Artificial Sequence
  chemically synthesized
aatgcctcagagttcagctttt

SEQ ID NO: 137077 - DNA, 22 bp, Artificial Sequence
  chemically synthesized
atgcctcagagttcagctttta

SEQ ID NO: 137078 - DNA, 22 bp, Artificial Sequence
  chemically synthesized
agagttcagcttttaagcttct

SEQ ID NO: 137079 - DNA, 22 bp, Artificial Sequence
  chemically synthesized
agcttttaagcttctgacaaat

SEQ ID NO: 137080 - DNA, 22 bp, Artificial Sequence
  chemically synthesized
ttaagcttctgacaaattattc

SEQ ID NO: 137081 - DNA, 22 bp, Artificial Sequence
  chemically synthesized
taagcttctgacaaattattct

SEQ ID NO: 137082 - DNA, 22 bp, Artificial Sequence
  chemically synthesized
aagcttctgacaaattattctt

SEQ ID NO: 137083 - DNA, 22 bp, Artificial Sequence
  chemically synthesized
agcttctgacaaattattcttc

SEQ ID NO: 137084 - DNA, 22 bp, Artificial Sequence
  chemically synthesized
ctgacaaattattcttcctctt

SEQ ID NO: 137085 - DNA, 22 bp, Artificial Sequence
  chemically synthesized
tgacaaattattcttcctcttt

SEQ ID NO: 137086 - DNA, 22 bp, Artificial Sequence
  chemically synthesized
acaaattattcttcctctttag

SEQ ID NO: 137087 - DNA, 22 bp, Artificial Sequence
  chemically synthesized
ttcttcctctttaggttctcct

SEQ ID NO: 137088 - DNA, 22 bp, Artificial Sequence
  chemically synthesized
ttcctctttaggttctccttta

SEQ ID NO: 137089 - DNA, 22 bp, Artificial Sequence
  chemically synthesized
cctctttaggttctcctttatg

SEQ ID NO: 137090 - DNA, 22 bp, Artificial Sequence
  chemically synthesized
ctctttaggttctcctttatgg

SEQ ID NO: 137091 - DNA, 22 bp, Artificial Sequence
  chemically synthesized
tttaggttctcctttatggaat

SEQ ID NO: 137092 - DNA, 22 bp, Artificial Sequence
  chemically synthesized
taggttctcctttatggaatct

SEQ ID NO: 137093 - DNA, 22 bp, Artificial Sequence
  chemically synthesized
aggttctcctttatggaatctt

SEQ ID NO: 137094 - DNA, 22 bp, Artificial Sequence
  chemically synthesized
ggttctcctttatggaatcttc

SEQ ID NO: 137095 - DNA, 22 bp, Artificial Sequence
  chemically synthesized
tcctttatggaatcttctgtac

SEQ ID NO: 137096 - DNA, 22 bp, Artificial Sequence
  chemically synthesized
ctttatggaatcttctgtactg

SEQ ID NO: 137097 - DNA, 22 bp, Artificial Sequence
  chemically synthesized
tatggaatcttctgtactgatg

SEQ ID NO: 137098 - DNA, 22 bp, Artificial Sequence
  chemically synthesized
atggaatcttctgtactgatgg

SEQ ID NO: 137099 - DNA, 22 bp, Artificial Sequence
  chemically synthesized
tggaatcttctgtactgatggc

SEQ ID NO: 137100 - DNA, 22 bp, Artificial Sequence
  chemically synthesized
ctgtactgatggccatgtcctt

SEQ ID NO: 137101 - DNA, 22 bp, Artificial Sequence
  chemically synthesized
tgtactgatggccatgtccttt

SEQ ID NO: 137102 - DNA, 22 bp, Artificial Sequence
  chemically synthesized
tactgatggccatgtcctttaa

SEQ ID NO: 137103 - DNA, 22 bp, Artificial Sequence
  chemically synthesized
atggccatgtcctttaactact

SEQ ID NO: 137104 - DNA, 22 bp, Artificial Sequence
  chemically synthesized
taactactatgtagatatctgc

SEQ ID NO: 137105 - DNA, 22 bp, Artificial Sequence
  chemically synthesized
aactactatgtagatatctgct

SEQ ID NO: 137106 - DNA, 22 bp, Artificial Sequence
  chemically synthesized
actactatgtagatatctgcta

SEQ ID NO: 137107 - DNA, 22 bp, Artificial Sequence
  chemically synthesized
ctatgtagatatctgctactac

SEQ ID NO: 137108 - DNA, 22 bp, Artificial Sequence
  chemically synthesized
tgtagatatctgctactacctg

SEQ ID NO: 137109 - DNA, 22 bp, Artificial Sequence
  chemically synthesized
ctactacctgtattatgcctct

SEQ ID NO: 137110 - DNA, 22 bp, Artificial Sequence
  chemically synthesized
ctacctgtattatgcctctacc

SEQ ID NO: 137111 - DNA, 22 bp, Artificial Sequence
  chemically synthesized
cctgtattatgcctctaccttt

SEQ ID NO: 137112 - DNA, 22 bp, Artificial Sequence
  chemically synthesized
tattatgcctctacctttatta

SEQ ID NO: 137113 - DNA, 22 bp, Artificial Sequence
  chemically synthesized
tgcctctacctttattagcaga

SEQ ID NO: 137114 - DNA, 22 bp, Artificial Sequence
  chemically synthesized
tacctttattagcagagttatc

SEQ ID NO: 137115 - DNA, 22 bp, Artificial Sequence
  chemically synthesized
cctttattagcagagttatctg

SEQ ID NO: 137116 - DNA, 22 bp, Artificial Sequence
  chemically synthesized
tattagcagagttatctgtact

SEQ ID NO: 137117 - DNA, 22 bp, Artificial Sequence
  chemically synthesized
attagcagagttatctgtactg

SEQ ID NO: 137118 - DNA, 22 bp, Artificial Sequence
  chemically synthesized
ttagcagagttatctgtactgt

SEQ ID NO: 137119 - DNA, 22 bp, Artificial Sequence
  chemically synthesized
gcagagttatctgtactgttgg

SEQ ID NO: 137120 - DNA, 22 bp, Artificial Sequence
  chemically synthesized
tctgtactgttggcatgacaat

SEQ ID NO: 137121 - DNA, 22 bp, Artificial Sequence
  chemically synthesized
tactgttggcatgacaatcatt

SEQ ID NO: 137122 - DNA, 22 bp, Artificial Sequence
  chemically synthesized
ttggcatgacaatcatttgtta

SEQ ID NO: 137123 - DNA, 22 bp, Artificial Sequence
  chemically synthesized
gcatgacaatcatttgttaata

SEQ ID NO: 137124 - DNA, 22 bp, Artificial Sequence
  chemically synthesized
gttaatatgacttgcctttcct

SEQ ID NO: 137125 - DNA, 22 bp, Artificial Sequence
  chemically synthesized
ttaatatgacttgcctttcctt

SEQ ID NO: 137126 - DNA, 22 bp, Artificial Sequence
  chemically synthesized
atatgacttgcctttccttttt

SEQ ID NO: 137127 - DNA, 22 bp, Artificial Sequence
  chemically synthesized
gcctttcctttttctgctattc

SEQ ID NO: 137128 - DNA, 22 bp, Artificial Sequence
  chemically synthesized
cctttcctttttctgctattct

SEQ ID NO: 137129 - DNA, 22 bp, Artificial Sequence
  chemically synthesized
tcctttttctgctattcttgat

SEQ ID NO: 137130 - DNA, 22 bp, Artificial Sequence
  chemically synthesized
cctttttctgctattcttgatc

SEQ ID NO: 137131 - DNA, 22 bp, Artificial Sequence
  chemically synthesized
ctttttctgctattcttgatca

SEQ ID NO: 137132 - DNA, 22 bp, Artificial Sequence
  chemically synthesized
tttctgctattcttgatcaaat

SEQ ID NO: 137133 - DNA, 22 bp, Artificial Sequence
  chemically synthesized
ttctgctattcttgatcaaatg

SEQ ID NO: 137134 - DNA, 22 bp, Artificial Sequence
  chemically synthesized
tctgctattcttgatcaaatgg

SEQ ID NO: 137135 - DNA, 22 bp, Artificial Sequence
  chemically synthesized
ctgctattcttgatcaaatggc

SEQ ID NO: 137136 - DNA, 22 bp, Artificial Sequence
  chemically synthesized
tgctattcttgatcaaatggct

SEQ ID NO: 137137 - DNA, 22 bp, Artificial Sequence
  chemically synthesized
ctattcttgatcaaatggctcc

SEQ ID NO: 137138 - DNA, 22 bp, Artificial Sequence
  chemically synthesized
ttcttgatcaaatggctcctct

SEQ ID NO: 137139 - DNA, 22 bp, Artificial Sequence
  chemically synthesized
ttgatcaaatggctcctctttc

SEQ ID NO: 137140 - DNA, 22 bp, Artificial Sequence
  chemically synthesized
gatcaaatggctcctctttctt

SEQ ID NO: 137141 - DNA, 22 bp, Artificial Sequence
  chemically synthesized
atcaaatggctcctctttcttg

SEQ ID NO: 137142 - DNA, 22 bp, Artificial Sequence
  chemically synthesized
ctctttcttgctcctctcattt

SEQ ID NO: 137143 - DNA, 22 bp, Artificial Sequence
  chemically synthesized
tttcttgctcctctcatttctc

SEQ ID NO: 137144 - DNA, 22 bp, Artificial Sequence
  chemically synthesized
tcttgctcctctcatttctcct

SEQ ID NO: 137145 - DNA, 22 bp, Artificial Sequence
  chemically synthesized
cttgctcctctcatttctcctg

SEQ ID NO: 137146 - DNA, 22 bp, Artificial Sequence
  chemically synthesized
ttgctcctctcatttctcctgc

SEQ ID NO: 137147 - DNA, 22 bp, Artificial Sequence
  chemically synthesized
gctcctctcatttctcctgcct

SEQ ID NO: 137148 - DNA, 22 bp, Artificial Sequence
  chemically synthesized
ctcctctcatttctcctgcctt

SEQ ID NO: 137149 - DNA, 22 bp, Artificial Sequence
  chemically synthesized
ctctcatttctcctgccttcac

SEQ ID NO: 137150 - DNA, 22 bp, Artificial Sequence
  chemically synthesized
tcatttctcctgccttcacttg

SEQ ID NO: 137151 - DNA, 22 bp, Artificial Sequence
  chemically synthesized
atttctcctgccttcacttgga

SEQ ID NO: 137152 - DNA, 22 bp, Artificial Sequence
  chemically synthesized
ctcctgccttcacttggacgtg

SEQ ID NO: 137153 - DNA, 22 bp, Artificial Sequence
  chemically synthesized
tcctgccttcacttggacgtgc

SEQ ID NO: 137154 - DNA, 22 bp, Artificial Sequence
  chemically synthesized
ctgccttcacttggacgtgctt

SEQ ID NO: 137155 - DNA, 22 bp, Artificial Sequence
  chemically synthesized
ccttcacttggacgtgcttcac

SEQ ID NO: 137156 - DNA, 22 bp, Artificial Sequence
  chemically synthesized
cacttggacgtgcttcacgtag

SEQ ID NO: 137157 - DNA, 22 bp, Artificial Sequence
  chemically synthesized
acttggacgtgcttcacgtagt

SEQ ID NO: 137158 - DNA, 22 bp, Artificial Sequence
  chemically synthesized
ggacgtgcttcacgtagtctgt

SEQ ID NO: 137159 - DNA, 22 bp, Artificial Sequence
  chemically synthesized
gacgtgcttcacgtagtctgtg

SEQ ID NO: 137160 - DNA, 22 bp, Artificial Sequence
  chemically synthesized
cacgtagtctgtgcttatgact

SEQ ID NO: 137161 - DNA, 22 bp, Artificial Sequence
  chemically synthesized
acgtagtctgtgcttatgactg

SEQ ID NO: 137162 - DNA, 22 bp, Artificial Sequence
  chemically synthesized
tgcttatgactggattaaaaat

SEQ ID NO: 137163 - DNA, 22 bp, Artificial Sequence
  chemically synthesized
atgactggattaaaaattgata

SEQ ID NO: 137164 - DNA, 22 bp, Artificial Sequence
  chemically synthesized
tgactggattaaaaattgatat

SEQ ID NO: 137165 - DNA, 22 bp, Artificial Sequence
  chemically synthesized
gattaaaaattgatatggactt

SEQ ID NO: 137166 - DNA, 22 bp, Artificial Sequence
  chemically synthesized
aaaattgatatggacttatcct

SEQ ID NO: 137167 - DNA, 22 bp, Artificial Sequence
  chemically synthesized
atatggacttatcctaatgttg

SEQ ID NO: 137168 - DNA, 22 bp, Artificial Sequence
  chemically synthesized
atcctaatgttgttcgtcataa

SEQ ID NO: 137169 - DNA, 22 bp, Artificial Sequence
  chemically synthesized
tcctaatgttgttcgtcataat

SEQ ID NO: 137170 - DNA, 22 bp, Artificial Sequence
  chemically synthesized
atgttgttcgtcataatatggg

SEQ ID NO: 137171 - DNA, 22 bp, Artificial Sequence
  chemically synthesized
ttcgtcataatatgggttttat

SEQ ID NO: 137172 - DNA, 22 bp, Artificial Sequence
  chemically synthesized
gtcataatatgggttttatggt

SEQ ID NO: 137173 - DNA, 22 bp, Artificial Sequence
  chemically synthesized
tatggtccattattatttccta

SEQ ID NO: 137174 - DNA, 22 bp, Artificial Sequence
  chemically synthesized
atggtccattattatttcctat

SEQ ID NO: 137175 - DNA, 22 bp, Artificial Sequence
  chemically synthesized
tggtccattattatttcctatg

SEQ ID NO: 137176 - DNA, 22 bp, Artificial Sequence
  chemically synthesized
ttatttcctatgcattgatctg

SEQ ID NO: 137177 - DNA, 22 bp, Artificial Sequence
  chemically synthesized
tttcctatgcattgatctggag

SEQ ID NO: 137178 - DNA, 22 bp, Artificial Sequence
  chemically synthesized
cctatgcattgatctggagaag

SEQ ID NO: 137179 - DNA, 22 bp, Artificial Sequence
  chemically synthesized
ctatgcattgatctggagaagg

SEQ ID NO: 137180 - DNA, 22 bp, Artificial Sequence
  chemically synthesized
tgcattgatctggagaaggctt

SEQ ID NO: 137181 - DNA, 22 bp, Artificial Sequence
  chemically synthesized
atctggagaaggcttcaatcct

SEQ ID NO: 137182 - DNA, 22 bp, Artificial Sequence
  chemically synthesized
gagaaggcttcaatccttttac

SEQ ID NO: 137183 - DNA, 22 bp, Artificial Sequence
  chemically synthesized
caatccttttactctttgtgga

SEQ ID NO: 137184 - DNA, 22 bp, Artificial Sequence
  chemically synthesized
aatccttttactctttgtggaa

SEQ ID NO: 137185 - DNA, 22 bp, Artificial Sequence
  chemically synthesized
ttactctttgtggaaaatatct

SEQ ID NO: 137186 - DNA, 22 bp, Artificial Sequence
  chemically synthesized
tactctttgtggaaaatatctg

SEQ ID NO: 137187 - DNA, 22 bp, Artificial Sequence
  chemically synthesized
actctttgtggaaaatatctgt

SEQ ID NO: 137188 - DNA, 22 bp, Artificial Sequence
  chemically synthesized
ctctttgtggaaaatatctgta

SEQ ID NO: 137189 - DNA, 22 bp, Artificial Sequence
  chemically synthesized
tttgtggaaaatatctgtaaac

SEQ ID NO: 137190 - DNA, 22 bp, Artificial Sequence
  chemically synthesized
tgtggaaaatatctgtaaacct

SEQ ID NO: 137191 - DNA, 22 bp, Artificial Sequence
  chemically synthesized
gtggaaaatatctgtaaacctt

SEQ ID NO: 137192 - DNA, 22 bp, Artificial Sequence
  chemically synthesized
tggaaaatatctgtaaaccttc

SEQ ID NO: 137193 - DNA, 22 bp, Artificial Sequence
  chemically synthesized
taaaccttctggttcactctgc

SEQ ID NO: 137194 - DNA, 22 bp, Artificial Sequence
  chemically synthesized
ctggttcactctgctatagcaa

SEQ ID NO: 137195 - DNA, 22 bp, Artificial Sequence
  chemically synthesized
tggttcactctgctatagcaat

SEQ ID NO: 137196 - DNA, 22 bp, Artificial Sequence
  chemically synthesized
gttcactctgctatagcaattt

SEQ ID NO: 137197 - DNA, 22 bp, Artificial Sequence
  chemically synthesized
actctgctatagcaatttcagt

SEQ ID NO: 137198 - DNA, 22 bp, Artificial Sequence
  chemically synthesized
tgctatagcaatttcagtttag

SEQ ID NO: 137199 - DNA, 22 bp, Artificial Sequence
  chemically synthesized
ctatagcaatttcagtttaggc

SEQ ID NO: 137200 - DNA, 22 bp, Artificial Sequence
  chemically synthesized
tagcaatttcagtttaggctag

SEQ ID NO: 137201 - DNA, 22 bp, Artificial Sequence
  chemically synthesized
cagtttaggctagtaagcatga

SEQ ID NO: 137202 - DNA, 22 bp, Artificial Sequence
  chemically synthesized
agtttaggctagtaagcatgag

SEQ ID NO: 137203 - DNA, 22 bp, Artificial Sequence
  chemically synthesized
aggctagtaagcatgaggatgc

SEQ ID NO: 137204 - DNA, 22 bp, Artificial Sequence
  chemically synthesized
ggctagtaagcatgaggatgcc

SEQ ID NO: 137205 - DNA, 22 bp, Artificial Sequence
  chemically synthesized
gtaagcatgaggatgcctcctt

SEQ ID NO: 137206 - DNA, 22 bp, Artificial Sequence
  chemically synthesized
cttctctgatttttcccacagt

SEQ ID NO: 137207 - DNA, 22 bp, Artificial Sequence
  chemically synthesized
ctctgatttttcccacagtctg

SEQ ID NO: 137208 - DNA, 22 bp, Artificial Sequence
  chemically synthesized
tctgatttttcccacagtctgt

SEQ ID NO: 137209 - DNA, 22 bp, Artificial Sequence
  chemically synthesized
tgatttttcccacagtctgttg

SEQ ID NO: 137210 - DNA, 22 bp, Artificial Sequence
  chemically synthesized
atttttcccacagtctgttggt

SEQ ID NO: 137211 - DNA, 22 bp, Artificial Sequence
  chemically synthesized
ttcccacagtctgttggtcaca

SEQ ID NO: 137212 - DNA, 22 bp, Artificial Sequence
  chemically synthesized
tcccacagtctgttggtcacag

SEQ ID NO: 137213 - DNA, 22 bp, Artificial Sequence
  chemically synthesized
cccacagtctgttggtcacaga

SEQ ID NO: 137214 - DNA, 22 bp, Artificial Sequence
  chemically synthesized
ccacagtctgttggtcacagaa

SEQ ID NO: 137215 - DNA, 22 bp, Artificial Sequence
  chemically synthesized
ttggtcacagaataacctgagt

SEQ ID NO: 137216 - DNA, 22 bp, Artificial Sequence
  chemically synthesized
gtcacagaataacctgagtgat

SEQ ID NO: 137217 - DNA, 22 bp, Artificial Sequence
  chemically synthesized
agtgattactgatgaaagagtg

SEQ ID NO: 137218 - DNA, 22 bp, Artificial Sequence
  chemically synthesized
ctgatgaaagagtgagaatgtt

SEQ ID NO: 137219 - DNA, 22 bp, Artificial Sequence
  chemically synthesized
atgaaagagtgagaatgttatt

SEQ ID NO: 137220 - DNA, 22 bp, Artificial Sequence
  chemically synthesized
ttgatagtcacaatgacaaaaa

SEQ ID NO: 137221 - DNA, 22 bp, Artificial Sequence
  chemically synthesized
atagtcacaatgacaaaaaaca

SEQ ID NO: 137222 - DNA, 22 bp, Artificial Sequence
  chemically synthesized
cagtcaaaatgtttctcttttt

SEQ ID NO: 137223 - DNA, 22 bp, Artificial Sequence
  chemically synthesized
ctctttttattagtggattata

SEQ ID NO: 137224 - DNA, 22 bp, Artificial Sequence
  chemically synthesized
tctttttattagtggattatat

SEQ ID NO: 137225 - DNA, 22 bp, Artificial Sequence
  chemically synthesized
tttttattagtggattatattt

SEQ ID NO: 137226 - DNA, 22 bp, Artificial Sequence
  chemically synthesized
tttattagtggattatatttcc

SEQ ID NO: 137227 - DNA, 22 bp, Artificial Sequence
  chemically synthesized
ttattagtggattatatttcct

SEQ ID NO: 137228 - DNA, 22 bp, Artificial Sequence
  chemically synthesized
tattagtggattatatttcctg

SEQ ID NO: 137229 - DNA, 22 bp, Artificial Sequence
  chemically synthesized
attagtggattatatttcctga

SEQ ID NO: 137230 - DNA, 22 bp, Artificial Sequence
  chemically synthesized
ttagtggattatatttcctgac

SEQ ID NO: 137231 - DNA, 22 bp, Artificial Sequence
  chemically synthesized
gtggattatatttcctgaccta

SEQ ID NO: 137232 - DNA, 22 bp, Artificial Sequence
  chemically synthesized
tatttcctgacctatatctggc

SEQ ID NO: 137233 - DNA, 22 bp, Artificial Sequence
  chemically synthesized
cctgacctatatctggcaggac

SEQ ID NO: 137234 - DNA, 22 bp, Artificial Sequence
  chemically synthesized
ctgacctatatctggcaggact

SEQ ID NO: 137235 - DNA, 22 bp, Artificial Sequence
  chemically synthesized
acctatatctggcaggactctt

SEQ ID NO: 137236 - DNA, 22 bp, Artificial Sequence
  chemically synthesized
tatctggcaggactctttagag

SEQ ID NO: 137237 - DNA, 22 bp, Artificial Sequence
  chemically synthesized
gcaggactctttagagaggtag

SEQ ID NO: 137238 - DNA, 22 bp, Artificial Sequence
  chemically synthesized
tttagagaggtagctgaagctg

SEQ ID NO: 137239 - DNA, 22 bp, Artificial Sequence
  chemically synthesized
tagagaggtagctgaagctgct

SEQ ID NO: 137240 - DNA, 22 bp, Artificial Sequence
  chemically synthesized
agagaggtagctgaagctgctg

SEQ ID NO: 137241 - DNA, 22 bp, Artificial Sequence
  chemically synthesized
gagaggtagctgaagctgctgt

SEQ ID NO: 137242 - DNA, 22 bp, Artificial Sequence
  chemically synthesized
aagctgctgttatgaccactag

SEQ ID NO: 137243 - DNA, 22 bp, Artificial Sequence
  chemically synthesized
ctgttatgaccactagagggaa

SEQ ID NO: 137244 - DNA, 22 bp, Artificial Sequence
  chemically synthesized
ttatgaccactagagggaagaa

SEQ ID NO: 137245 - DNA, 22 bp, Artificial Sequence
  chemically synthesized
tgaccactagagggaagaagat

SEQ ID NO: 137246 - DNA, 22 bp, Artificial Sequence
  chemically synthesized
gagggaagaagatacctgtgga

SEQ ID NO: 137247 - DNA, 22 bp, Artificial Sequence
  chemically synthesized
tggagctaatggtccaagatgg

SEQ ID NO: 137248 - DNA, 22 bp, Artificial Sequence
  chemically synthesized
atggtccaagatggtggagccc

SEQ ID NO: 137249 - DNA, 22 bp, Artificial Sequence
  chemically synthesized
ttaaggagcccttttgattgaa

SEQ ID NO: 137250 - DNA, 22 bp, Artificial Sequence
  chemically synthesized
aggagcccttttgattgaaggt

SEQ ID NO: 137251 - DNA, 22 bp, Artificial Sequence
  chemically synthesized
ttgattgaaggtgggtgccccc

SEQ ID NO: 137252 - DNA, 22 bp, Artificial Sequence
  chemically synthesized
tgattgaaggtgggtgccccca

SEQ ID NO: 137253 - DNA, 22 bp, Artificial Sequence
  chemically synthesized
gattgaaggtgggtgcccccac

SEQ ID NO: 137254 - DNA, 22 bp, Artificial Sequence
  chemically synthesized
attgaaggtgggtgcccccacc

SEQ ID NO: 137255 - DNA, 22 bp, Artificial Sequence
  chemically synthesized
aaggtgggtgcccccaccttac

SEQ ID NO: 137256 - DNA, 22 bp, Artificial Sequence
  chemically synthesized
acagggacaggacatctggata

SEQ ID NO: 137257 - DNA, 22 bp, Artificial Sequence
  chemically synthesized
cagggacaggacatctggatac

SEQ ID NO: 137258 - DNA, 22 bp, Artificial Sequence
  chemically synthesized
gatactcctcccagtttctcca

SEQ ID NO: 137259 - DNA, 22 bp, Artificial Sequence
  chemically synthesized
ctcccagtttctccagtttccc

SEQ ID NO: 137260 - DNA, 22 bp, Artificial Sequence
  chemically synthesized
ccagtttctccagtttcccttt

SEQ ID NO: 137261 - DNA, 22 bp, Artificial Sequence
  chemically synthesized
ctccagtttccctttttcctaa

SEQ ID NO: 137262 - DNA, 22 bp, Artificial Sequence
  chemically synthesized
tccagtttccctttttcctaat

SEQ ID NO: 137263 - DNA, 22 bp, Artificial Sequence
  chemically synthesized
cagtttccctttttcctaatat

SEQ ID NO: 137264 - DNA, 22 bp, Artificial Sequence
  chemically synthesized
ccctttttcctaatatatctcc

SEQ ID NO: 137265 - DNA, 22 bp, Artificial Sequence
  chemically synthesized
cctttttcctaatatatctcct

SEQ ID NO: 137266 - DNA, 22 bp, Artificial Sequence
  chemically synthesized
tttcctaatatatctcctgata

SEQ ID NO: 137267 - DNA, 22 bp, Artificial Sequence
  chemically synthesized
ttcctaatatatctcctgataa

SEQ ID NO: 137268 - DNA, 22 bp, Artificial Sequence
  chemically synthesized
tcctaatatatctcctgataaa

SEQ ID NO: 137269 - DNA, 22 bp, Artificial Sequence
  chemically synthesized
cctaatatatctcctgataaaa

SEQ ID NO: 137270 - DNA, 22 bp, Artificial Sequence
  chemically synthesized
ctaatatatctcctgataaaat

SEQ ID NO: 137271 - DNA, 22 bp, Artificial Sequence
  chemically synthesized
atatatctcctgataaaatgtc

SEQ ID NO: 137272 - DNA, 22 bp, Artificial Sequence
  chemically synthesized
ctgataaaatgtctatactcac

SEQ ID NO: 137273 - DNA, 22 bp, Artificial Sequence
  chemically synthesized
ataaaatgtctatactcacttc

SEQ ID NO: 137274 - DNA, 22 bp, Artificial Sequence
  chemically synthesized
tactcacttccccatttctaat

SEQ ID NO: 137275 - DNA, 22 bp, Artificial Sequence
  chemically synthesized
acttccccatttctaataataa

SEQ ID NO: 137276 - DNA, 22 bp, Artificial Sequence
  chemically synthesized
ccccatttctaataataaagca

SEQ ID NO: 137277 - DNA, 22 bp, Artificial Sequence
  chemically synthesized
cccatttctaataataaagcaa

SEQ ID NO: 137278 - DNA, 22 bp, Artificial Sequence
  chemically synthesized
ctaataataaagcaaaggctag

SEQ ID NO: 137279 - DNA, 22 bp, Artificial Sequence
  chemically synthesized
taataataaagcaaaggctagt

SEQ ID NO: 137280 - DNA, 22 bp, Artificial Sequence
  chemically synthesized
ataataaagcaaaggctagtta

SEQ ID NO: 137281 - DNA, 22 bp, Artificial Sequence
  chemically synthesized
gttagtaagacatcaccttgca

SEQ ID NO: 137282 - DNA, 22 bp, Artificial Sequence
  chemically synthesized
gtaagacatcaccttgcatttt

SEQ ID NO: 137283 - DNA, 22 bp, Artificial Sequence
  chemically synthesized
gcattttgaaaatgccatagac

SEQ ID NO: 137284 - DNA, 22 bp, Artificial Sequence
  chemically synthesized
cattttgaaaatgccatagact

SEQ ID NO: 137285 - DNA, 22 bp, Artificial Sequence
  chemically synthesized
tgaaaatgccatagactttcaa

SEQ ID NO: 137286 - DNA, 22 bp, Artificial Sequence
  chemically synthesized
gaaaatgccatagactttcaaa

SEQ ID NO: 137287 - DNA, 22 bp, Artificial Sequence
  chemically synthesized
aaaatgccatagactttcaaaa

SEQ ID NO: 137288 - DNA, 22 bp, Artificial Sequence
  chemically synthesized
tcaaaattatttcatacatcgg

SEQ ID NO: 137289 - DNA, 22 bp, Artificial Sequence
  chemically synthesized
caaaattatttcatacatcggt

SEQ ID NO: 137290 - DNA, 22 bp, Artificial Sequence
  chemically synthesized
aaaattatttcatacatcggtc

SEQ ID NO: 137291 - DNA, 22 bp, Artificial Sequence
  chemically synthesized
tttcatacatcggtctttcttt

SEQ ID NO: 137292 - DNA, 22 bp, Artificial Sequence
  chemically synthesized
catacatcggtctttctttatt

SEQ ID NO: 137293 - DNA, 22 bp, Artificial Sequence
  chemically synthesized
atacatcggtctttctttattt

SEQ ID NO: 137294 - DNA, 22 bp, Artificial Sequence
  chemically synthesized
tctttatttcaagagtccagaa

SEQ ID NO: 137295 - DNA, 22 bp, Artificial Sequence
  chemically synthesized
ctttatttcaagagtccagaaa

SEQ ID NO: 137296 - DNA, 22 bp, Artificial Sequence
  chemically synthesized
tttatttcaagagtccagaaat

SEQ ID NO: 137297 - DNA, 22 bp, Artificial Sequence
  chemically synthesized
tatttcaagagtccagaaatgg

SEQ ID NO: 137298 - DNA, 22 bp, Artificial Sequence
  chemically synthesized
atttcaagagtccagaaatggc

SEQ ID NO: 137299 - DNA, 22 bp, Artificial Sequence
  chemically synthesized
tttcaagagtccagaaatggca

SEQ ID NO: 137300 - DNA, 22 bp, Artificial Sequence
  chemically synthesized
caagagtccagaaatggcaaca

SEQ ID NO: 137301 - DNA, 22 bp, Artificial Sequence
  chemically synthesized
aagagtccagaaatggcaacat

SEQ ID NO: 137302 - DNA, 22 bp, Artificial Sequence
  chemically synthesized
cctttgattcaatgtaatggaa

SEQ ID NO: 137303 - DNA, 22 bp, Artificial Sequence
  chemically synthesized
tgattcaatgtaatggaaagag

SEQ ID NO: 137304 - DNA, 22 bp, Artificial Sequence
  chemically synthesized
gattcaatgtaatggaaagagc

SEQ ID NO: 137305 - DNA, 22 bp, Artificial Sequence
  chemically synthesized
attcaatgtaatggaaagagct

SEQ ID NO: 137306 - DNA, 22 bp, Artificial Sequence
  chemically synthesized
aatgtaatggaaagagctcttt

SEQ ID NO: 137307 - DNA, 22 bp, Artificial Sequence
  chemically synthesized
tttcaagagacagagaaaagaa

SEQ ID NO: 137308 - DNA, 22 bp, Artificial Sequence
  chemically synthesized
tcaagagacagagaaaagaata

SEQ ID NO: 137309 - DNA, 22 bp, Artificial Sequence
  chemically synthesized
caagagacagagaaaagaataa

SEQ ID NO: 137310 - DNA, 22 bp, Artificial Sequence
  chemically synthesized
aagagacagagaaaagaataat

SEQ ID NO: 137311 - DNA, 22 bp, Artificial Sequence
  chemically synthesized
aatttctttccccacacctcct

SEQ ID NO: 137312 - DNA, 22 bp, Artificial Sequence
  chemically synthesized
atttctttccccacacctcctt

SEQ ID NO: 137313 - DNA, 22 bp, Artificial Sequence
  chemically synthesized
ctttccccacacctccttccct

SEQ ID NO: 137314 - DNA, 22 bp, Artificial Sequence
  chemically synthesized
tttccccacacctccttccctg

SEQ ID NO: 137315 - DNA, 22 bp, Artificial Sequence
  chemically synthesized
tccccacacctccttccctgtc

SEQ ID NO: 137316 - DNA, 22 bp, Artificial Sequence
  chemically synthesized
ccccacacctccttccctgtct

SEQ ID NO: 137317 - DNA, 22 bp, Artificial Sequence
  chemically synthesized
cccacacctccttccctgtctc

SEQ ID NO: 137318 - DNA, 22 bp, Artificial Sequence
  chemically synthesized
cttccctgtctcttaccctatc

SEQ ID NO: 137319 - DNA, 22 bp, Artificial Sequence
  chemically synthesized
ccctgtctcttaccctatcttc

SEQ ID NO: 137320 - DNA, 22 bp, Artificial Sequence
  chemically synthesized
cctgtctcttaccctatcttcc

SEQ ID NO: 137321 - DNA, 22 bp, Artificial Sequence
  chemically synthesized
tctcttaccctatcttccttcc

SEQ ID NO: 137322 - DNA, 22 bp, Artificial Sequence
  chemically synthesized
ttaccctatcttccttccttct

SEQ ID NO: 137323 - DNA, 22 bp, Artificial Sequence
  chemically synthesized
accctatcttccttccttctac

SEQ ID NO: 137324 - DNA, 22 bp, Artificial Sequence
  chemically synthesized
ccctatcttccttccttctacc

SEQ ID NO: 137325 - DNA, 22 bp, Artificial Sequence
  chemically synthesized
tcttccttccttctaccctccc

SEQ ID NO: 137326 - DNA, 22 bp, Artificial Sequence
  chemically synthesized
ccttccttctaccctccccatt

SEQ ID NO: 137327 - DNA, 22 bp, Artificial Sequence
  chemically synthesized
cttccttctaccctccccattt

SEQ ID NO: 137328 - DNA, 22 bp, Artificial Sequence
  chemically synthesized
ccttctaccctccccatttctc

SEQ ID NO: 137329 - DNA, 22 bp, Artificial Sequence
  chemically synthesized
cttctaccctccccatttctct

SEQ ID NO: 137330 - DNA, 22 bp, Artificial Sequence
  chemically synthesized
ctaccctccccatttctctctc

SEQ ID NO: 137331 - DNA, 22 bp, Artificial Sequence
  chemically synthesized
taccctccccatttctctctct

SEQ ID NO: 137332 - DNA, 22 bp, Artificial Sequence
  chemically synthesized
ccctccccatttctctctctca

SEQ ID NO: 137333 - DNA, 22 bp, Artificial Sequence
  chemically synthesized
cccatttctctctctcatttct

SEQ ID NO: 137334 - DNA, 22 bp, Artificial Sequence
  chemically synthesized
ctctctctcatttctcagaagt

SEQ ID NO: 137335 - DNA, 22 bp, Artificial Sequence
  chemically synthesized
tctctctcatttctcagaagta

SEQ ID NO: 137336 - DNA, 22 bp, Artificial Sequence
  chemically synthesized
tctctcatttctcagaagtata

SEQ ID NO: 137337 - DNA, 22 bp, Artificial Sequence
  chemically synthesized
tctcatttctcagaagtatatt

SEQ ID NO: 137338 - DNA, 22 bp, Artificial Sequence
  chemically synthesized
tcatttctcagaagtatatttt

SEQ ID NO: 137339 - DNA, 22 bp, Artificial Sequence
  chemically synthesized
atttctcagaagtatattttga

SEQ ID NO: 137340 - DNA, 22 bp, Artificial Sequence
  chemically synthesized
ctcagaagtatattttgaaagg

SEQ ID NO: 137341 - DNA, 22 bp, Artificial Sequence
  chemically synthesized
tcagaagtatattttgaaagga

SEQ ID NO: 137342 - DNA, 22 bp, Artificial Sequence
  chemically synthesized
agaagtatattttgaaaggatt

SEQ ID NO: 137343 - DNA, 22 bp, Artificial Sequence
  chemically synthesized
tgaaaggattcatagcagacag

SEQ ID NO: 137344 - DNA, 22 bp, Artificial Sequence
  chemically synthesized
gaaaggattcatagcagacagc

SEQ ID NO: 137345 - DNA, 22 bp, Artificial Sequence
  chemically synthesized
aaaggattcatagcagacagct

SEQ ID NO: 137346 - DNA, 22 bp, Artificial Sequence
  chemically synthesized
atagcagacagctaaggctggt

SEQ ID NO: 137347 - DNA, 22 bp, Artificial Sequence
  chemically synthesized
aggctggttttttctaagtgaa

SEQ ID NO: 137348 - DNA, 22 bp, Artificial Sequence
  chemically synthesized
gttttttctaagtgaagaagtg

SEQ ID NO: 137349 - DNA, 22 bp, Artificial Sequence
  chemically synthesized
tttctaagtgaagaagtgatat

SEQ ID NO: 137350 - DNA, 22 bp, Artificial Sequence
  chemically synthesized
ttctaagtgaagaagtgatatt

SEQ ID NO: 137351 - DNA, 22 bp, Artificial Sequence
  chemically synthesized
tctaagtgaagaagtgatattg

SEQ ID NO: 137352 - DNA, 22 bp, Artificial Sequence
  chemically synthesized
ctaagtgaagaagtgatattga

SEQ ID NO: 137353 - DNA, 22 bp, Artificial Sequence
  chemically synthesized
taagtgaagaagtgatattgag

SEQ ID NO: 137354 - DNA, 22 bp, Artificial Sequence
  chemically synthesized
agtgaagaagtgatattgagaa

SEQ ID NO: 137355 - DNA, 22 bp, Artificial Sequence
  chemically synthesized
agaaggtagggttgcatgagcc

SEQ ID NO: 137356 - DNA, 22 bp, Artificial Sequence
  chemically synthesized
catgagccctttcagtttttta

SEQ ID NO: 137357 - DNA, 22 bp, Artificial Sequence
  chemically synthesized
tcagttttttagtttatataca

SEQ ID NO: 137358 - DNA, 22 bp, Artificial Sequence
  chemically synthesized
cagttttttagtttatatacat

SEQ ID NO: 137359 - DNA, 22 bp, Artificial Sequence
  chemically synthesized
agttttttagtttatatacatc

SEQ ID NO: 137360 - DNA, 22 bp, Artificial Sequence
  chemically synthesized
tttagtttatatacatctgtat

SEQ ID NO: 137361 - DNA, 22 bp, Artificial Sequence
  chemically synthesized
ttagtttatatacatctgtatt

SEQ ID NO: 137362 - DNA, 22 bp, Artificial Sequence
  chemically synthesized
tagtttatatacatctgtattg

SEQ ID NO: 137363 - DNA, 22 bp, Artificial Sequence
  chemically synthesized
agtttatatacatctgtattgt

SEQ ID NO: 137364 - DNA, 22 bp, Artificial Sequence
  chemically synthesized
gtttatatacatctgtattgtt

SEQ ID NO: 137365 - DNA, 22 bp, Artificial Sequence
  chemically synthesized
atatacatctgtattgttagaa

SEQ ID NO: 137366 - DNA, 22 bp, Artificial Sequence
  chemically synthesized
tatacatctgtattgttagaat

SEQ ID NO: 137367 - DNA, 22 bp, Artificial Sequence
  chemically synthesized
tattgttagaatgttttataat

SEQ ID NO: 137368 - DNA, 22 bp, Artificial Sequence
  chemically synthesized
ttagaatgttttataatataaa

SEQ ID NO: 137369 - DNA, 22 bp, Artificial Sequence
  chemically synthesized
gaatgttttataatataaataa

SEQ ID NO: 137370 - DNA, 22 bp, Artificial Sequence
  chemically synthesized
tataatataaataaaattattt

SEQ ID NO: 137371 - DNA, 22 bp, Artificial Sequence
  chemically synthesized
ataatataaataaaattatttc

SEQ ID NO: 137372 - DNA, 22 bp, Artificial Sequence
  chemically synthesized
taatataaataaaattatttct

SEQ ID NO: 137373 - DNA, 22 bp, Artificial Sequence
  chemically synthesized
tttctcagttatatactagcta

SEQ ID NO: 137374 - DNA, 22 bp, Artificial Sequence
  chemically synthesized
ctcagttatatactagctatgt

SEQ ID NO: 137375 - DNA, 22 bp, Artificial Sequence
  chemically synthesized
tcagttatatactagctatgta

SEQ ID NO: 137376 - DNA, 22 bp, Artificial Sequence
  chemically synthesized
agttatatactagctatgtaac

SEQ ID NO: 137377 - DNA, 22 bp, Artificial Sequence
  chemically synthesized
tatactagctatgtaacctgtg

SEQ ID NO: 137378 - DNA, 22 bp, Artificial Sequence
  chemically synthesized
gctatgtaacctgtggatattt

SEQ ID NO: 137379 - DNA, 22 bp, Artificial Sequence
  chemically synthesized
tgtaacctgtggatatttcctt

SEQ ID NO: 137380 - DNA, 22 bp, Artificial Sequence
  chemically synthesized
tggatatttccttaagtattac

SEQ ID NO: 137381 - DNA, 22 bp, Artificial Sequence
  chemically synthesized
ccttaagtattacaagctatac

SEQ ID NO: 137382 - DNA, 22 bp, Artificial Sequence
  chemically synthesized
cttaagtattacaagctatact

SEQ ID NO: 137383 - DNA, 22 bp, Artificial Sequence
  chemically synthesized
aagtattacaagctatacttaa

SEQ ID NO: 137384 - DNA, 22 bp, Artificial Sequence
  chemically synthesized
agtattacaagctatacttaac

SEQ ID NO: 137385 - DNA, 22 bp, Artificial Sequence
  chemically synthesized
caagctatacttaactcacttg

SEQ ID NO: 137386 - DNA, 22 bp, Artificial Sequence
  chemically synthesized
tacttaactcacttggaaaact

SEQ ID NO: 137387 - DNA, 22 bp, Artificial Sequence
  chemically synthesized
aactcacttggaaaactcaaat

SEQ ID NO: 137388 - DNA, 22 bp, Artificial Sequence
  chemically synthesized
actcacttggaaaactcaaata

SEQ ID NO: 137389 - DNA, 22 bp, Artificial Sequence
  chemically synthesized
acttggaaaactcaaataaata

SEQ ID NO: 137390 - DNA, 22 bp, Artificial Sequence
  chemically synthesized
ggaaaactcaaataaatacctg

SEQ ID NO: 137391 - DNA, 22 bp, Artificial Sequence
  chemically synthesized
gaaaactcaaataaatacctgc

SEQ ID NO: 137392 - DNA, 22 bp, Artificial Sequence
  chemically synthesized
aaataaatacctgcttcatagt

SEQ ID NO: 137393 - DNA, 22 bp, Artificial Sequence
  chemically synthesized
cttcatagttattaataaggat

SEQ ID NO: 137394 - DNA, 22 bp, Artificial Sequence
  chemically synthesized
catagttattaataaggattaa

SEQ ID NO: 137395 - DNA, 22 bp, Artificial Sequence
  chemically synthesized
atagttattaataaggattaag

SEQ ID NO: 137396 - DNA, 22 bp, Artificial Sequence
  chemically synthesized
ttaataaggattaagtgagata

SEQ ID NO: 137397 - DNA, 22 bp, Artificial Sequence
  chemically synthesized
ataaggattaagtgagataatg

SEQ ID NO: 137398 - DNA, 22 bp, Artificial Sequence
  chemically synthesized
agtgagataatgcccataagat

SEQ ID NO: 137399 - DNA, 22 bp, Artificial Sequence
  chemically synthesized
ctattaataacagataaataca

SEQ ID NO: 137400 - DNA, 22 bp, Artificial Sequence
  chemically synthesized
ttaataacagataaatacatac

SEQ ID NO: 137401 - DNA, 22 bp, Artificial Sequence
  chemically synthesized
ataacagataaatacatacaca

SEQ ID NO: 137402 - DNA, 22 bp, Artificial Sequence
  chemically synthesized
aaaggattcttactttgtgcta

SEQ ID NO: 137403 - DNA, 22 bp, Artificial Sequence
  chemically synthesized
ttactttgtgctaggaactata

SEQ ID NO: 137404 - DNA, 22 bp, Artificial Sequence
  chemically synthesized
actttgtgctaggaactataat

SEQ ID NO: 137405 - DNA, 22 bp, Artificial Sequence
  chemically synthesized
ctttgtgctaggaactataata

SEQ ID NO: 137406 - DNA, 22 bp, Artificial Sequence
  chemically synthesized
tgtgctaggaactataataagt

SEQ ID NO: 137407 - DNA, 22 bp, Artificial Sequence
  chemically synthesized
gtgctaggaactataataagtt

SEQ ID NO: 137408 - DNA, 22 bp, Artificial Sequence
  chemically synthesized
tgctaggaactataataagttc

SEQ ID NO: 137409 - DNA, 22 bp, Artificial Sequence
  chemically synthesized
ggaactataataagttcattga

SEQ ID NO: 137410 - DNA, 22 bp, Artificial Sequence
  chemically synthesized
taataagttcattgatgcatta

SEQ ID NO: 137411 - DNA, 22 bp, Artificial Sequence
  chemically synthesized
attgatgcattatatcattaag

SEQ ID NO: 137412 - DNA, 22 bp, Artificial Sequence
  chemically synthesized
atgcattatatcattaagttct

SEQ ID NO: 137413 - DNA, 22 bp, Artificial Sequence
  chemically synthesized
tatcattaagttctaatttcaa

SEQ ID NO: 137414 - DNA, 22 bp, Artificial Sequence
  chemically synthesized
agttctaatttcaacactagaa

SEQ ID NO: 137415 - DNA, 22 bp, Artificial Sequence
  chemically synthesized
taatttcaacactagaaggcag

SEQ ID NO: 137416 - DNA, 22 bp, Artificial Sequence
  chemically synthesized
atttcaacactagaaggcaggt

SEQ ID NO: 137417 - DNA, 22 bp, Artificial Sequence
  chemically synthesized
caacactagaaggcaggtatta

SEQ ID NO: 137418 - DNA, 22 bp, Artificial Sequence
  chemically synthesized
aacactagaaggcaggtattat

SEQ ID NO: 137419 - DNA, 22 bp, Artificial Sequence
  chemically synthesized
gaaggcaggtattatctaaatt

SEQ ID NO: 137420 - DNA, 22 bp, Artificial Sequence
  chemically synthesized
tctaaatttcatactggatacc

SEQ ID NO: 137421 - DNA, 22 bp, Artificial Sequence
  chemically synthesized
aatttcatactggatacctcca

SEQ ID NO: 137422 - DNA, 22 bp, Artificial Sequence
  chemically synthesized
catactggatacctccaaactc

SEQ ID NO: 137423 - DNA, 22 bp, Artificial Sequence
  chemically synthesized
atactggatacctccaaactca

SEQ ID NO: 137424 - DNA, 22 bp, Artificial Sequence
  chemically synthesized
gatacctccaaactcataaaga

SEQ ID NO: 137425 - DNA, 22 bp, Artificial Sequence
  chemically synthesized
caaactcataaagataattaaa

SEQ ID NO: 137426 - DNA, 22 bp, Artificial Sequence
  chemically synthesized
ataaagataattaaattgcctt

SEQ ID NO: 137427 - DNA, 22 bp, Artificial Sequence
  chemically synthesized
aattgccttttgtcatatattt

SEQ ID NO: 137428 - DNA, 22 bp, Artificial Sequence
  chemically synthesized
ccttttgtcatatatttattca

SEQ ID NO: 137429 - DNA, 22 bp, Artificial Sequence
  chemically synthesized
ttgtcatatatttattcaaaag

SEQ ID NO: 137430 - DNA, 22 bp, Artificial Sequence
  chemically synthesized
tgtcatatatttattcaaaagg

SEQ ID NO: 137431 - DNA, 22 bp, Artificial Sequence
  chemically synthesized
gtcatatatttattcaaaaggg

SEQ ID NO: 137432 - DNA, 22 bp, Artificial Sequence
  chemically synthesized
tcatatatttattcaaaagggt

SEQ ID NO: 137433 - DNA, 22 bp, Artificial Sequence
  chemically synthesized
attcaaaagggtaaactcaaac

SEQ ID NO: 137434 - DNA, 22 bp, Artificial Sequence
  chemically synthesized
ttcaaaagggtaaactcaaact

SEQ ID NO: 137435 - DNA, 22 bp, Artificial Sequence
  chemically synthesized
aaaagggtaaactcaaactatg

SEQ ID NO: 137436 - DNA, 22 bp, Artificial Sequence
  chemically synthesized
aaactatggcttgtctaatttt

SEQ ID NO: 137437 - DNA, 22 bp, Artificial Sequence
  chemically synthesized
tggcttgtctaattttatatat

SEQ ID NO: 137438 - DNA, 22 bp, Artificial Sequence
  chemically synthesized
gtctaattttatatatcaccct

SEQ ID NO: 137439 - DNA, 22 bp, Artificial Sequence
  chemically synthesized
tctaattttatatatcacccta

SEQ ID NO: 137440 - DNA, 22 bp, Artificial Sequence
  chemically synthesized
attttatatatcaccctactga

SEQ ID NO: 137441 - DNA, 22 bp, Artificial Sequence
  chemically synthesized
tatatatcaccctactgaacat

SEQ ID NO: 137442 - DNA, 22 bp, Artificial Sequence
  chemically synthesized
atatatcaccctactgaacatg

SEQ ID NO: 137443 - DNA, 22 bp, Artificial Sequence
  chemically synthesized
tatatcaccctactgaacatga

SEQ ID NO: 137444 - DNA, 22 bp, Artificial Sequence
  chemically synthesized
ctgaacatgaccctattgtgat

SEQ ID NO: 137445 - DNA, 22 bp, Artificial Sequence
  chemically synthesized
aacatgaccctattgtgatatt

SEQ ID NO: 137446 - DNA, 22 bp, Artificial Sequence
  chemically synthesized
ttgtgatattttataaaattat

SEQ ID NO: 137447 - DNA, 22 bp, Artificial Sequence
  chemically synthesized
tgatattttataaaattattct

SEQ ID NO: 137448 - DNA, 22 bp, Artificial Sequence
  chemically synthesized
tataaaattattctcaagttat

SEQ ID NO: 137449 - DNA, 22 bp, Artificial Sequence
  chemically synthesized
ataaaattattctcaagttatt

SEQ ID NO: 137450 - DNA, 22 bp, Artificial Sequence
  chemically synthesized
taaaattattctcaagttatta

SEQ ID NO: 137451 - DNA, 22 bp, Artificial Sequence
  chemically synthesized
ttctcaagttattatgaggatg

SEQ ID NO: 137452 - DNA, 22 bp, Artificial Sequence
  chemically synthesized
tcaagttattatgaggatgttg

SEQ ID NO: 137453 - DNA, 22 bp, Artificial Sequence
  chemically synthesized
aagttattatgaggatgttgaa

SEQ ID NO: 137454 - DNA, 22 bp, Artificial Sequence
  chemically synthesized
ttatgaggatgttgaaagacag

SEQ ID NO: 137455 - DNA, 22 bp, Artificial Sequence
  chemically synthesized
tgaggatgttgaaagacagaga

SEQ ID NO: 137456 - DNA, 22 bp, Artificial Sequence
  chemically synthesized
aaagacagagaggatggggtgc

SEQ ID NO: 137457 - DNA, 22 bp, Artificial Sequence
  chemically synthesized
tgccccaaatcagcctcacaat

SEQ ID NO: 137458 - DNA, 22 bp, Artificial Sequence
  chemically synthesized
acaattaagctaagcagctaag

SEQ ID NO: 137459 - DNA, 22 bp, Artificial Sequence
  chemically synthesized
agctaagcagctaagagtcttg

SEQ ID NO: 137460 - DNA, 22 bp, Artificial Sequence
  chemically synthesized
agcagctaagagtcttgcaggg

SEQ ID NO: 137461 - DNA, 22 bp, Artificial Sequence
  chemically synthesized
agagtcttgcagggtagtgtag

SEQ ID NO: 137462 - DNA, 22 bp, Artificial Sequence
  chemically synthesized
gcagggtagtgtagggaccaca

SEQ ID NO: 137463 - DNA, 22 bp, Artificial Sequence
  chemically synthesized
cagggtagtgtagggaccacag

SEQ ID NO: 137464 - DNA, 22 bp, Artificial Sequence
  chemically synthesized
agggggcagtagaattatactc

SEQ ID NO: 137465 - DNA, 22 bp, Artificial Sequence
  chemically synthesized
tactcccactttagtttcattt

SEQ ID NO: 137466 - DNA, 22 bp, Artificial Sequence
  chemically synthesized
ccactttagtttcatttcaaac

SEQ ID NO: 137467 - DNA, 22 bp, Artificial Sequence
  chemically synthesized
tagtttcatttcaaacaatcca

SEQ ID NO: 137468 - DNA, 22 bp, Artificial Sequence
  chemically synthesized
agtttcatttcaaacaatccat

SEQ ID NO: 137469 - DNA, 22 bp, Artificial Sequence
  chemically synthesized
gtttcatttcaaacaatccata

SEQ ID NO: 137470 - DNA, 22 bp, Artificial Sequence
  chemically synthesized
catttcaaacaatccatacaca

SEQ ID NO: 137471 - DNA, 22 bp, Artificial Sequence
  chemically synthesized
atttcaaacaatccatacacac

SEQ ID NO: 137472 - DNA, 22 bp, Artificial Sequence
  chemically synthesized
caaacaatccatacacacacag

SEQ ID NO: 137473 - DNA, 22 bp, Artificial Sequence
  chemically synthesized
aaacaatccatacacacacagc

SEQ ID NO: 137474 - DNA, 22 bp, Artificial Sequence
  chemically synthesized
agcacttacaaattatactacg

SEQ ID NO: 137475 - DNA, 22 bp, Artificial Sequence
  chemically synthesized
acaaattatactacgctctata

SEQ ID NO: 137476 - DNA, 22 bp, Artificial Sequence
  chemically synthesized
caaattatactacgctctatac

SEQ ID NO: 137477 - DNA, 22 bp, Artificial Sequence
  chemically synthesized
tactacgctctatactttttgt

SEQ ID NO: 137478 - DNA, 22 bp, Artificial Sequence
  chemically synthesized
cgctctatactttttgtttaaa

SEQ ID NO: 137479 - DNA, 22 bp, Artificial Sequence
  chemically synthesized
tatactttttgtttaaatgtat

SEQ ID NO: 137480 - DNA, 22 bp, Artificial Sequence
  chemically synthesized
tactttttgtttaaatgtataa

SEQ ID NO: 137481 - DNA, 22 bp, Artificial Sequence
  chemically synthesized
tttgtttaaatgtataaataag

SEQ ID NO: 137482 - DNA, 22 bp, Artificial Sequence
  chemically synthesized
ttgtttaaatgtataaataagt

SEQ ID NO: 137483 - DNA, 22 bp, Artificial Sequence
  chemically synthesized
tgtttaaatgtataaataagtg

SEQ ID NO: 137484 - DNA, 22 bp, Artificial Sequence
  chemically synthesized
gtttaaatgtataaataagtgg

SEQ ID NO: 137485 - DNA, 22 bp, Artificial Sequence
  chemically synthesized
tttaaatgtataaataagtgga

SEQ ID NO: 137486 - DNA, 22 bp, Artificial Sequence
  chemically synthesized
aaatgtataaataagtggatga

SEQ ID NO: 137487 - DNA, 22 bp, Artificial Sequence
  chemically synthesized
aatgtataaataagtggatgaa

SEQ ID NO: 137488 - DNA, 22 bp, Artificial Sequence
  chemically synthesized
gccttcatagctgtctccctac

SEQ ID NO: 137489 - DNA, 22 bp, Artificial Sequence
  chemically synthesized
ccttcatagctgtctccctacc

SEQ ID NO: 137490 - DNA, 22 bp, Artificial Sequence
  chemically synthesized
catagctgtctccctaccttgt

SEQ ID NO: 137491 - DNA, 22 bp, Artificial Sequence
  chemically synthesized
atagctgtctccctaccttgtt

SEQ ID NO: 137492 - DNA, 22 bp, Artificial Sequence
  chemically synthesized
tctccctaccttgttcaaaatg

SEQ ID NO: 137493 - DNA, 22 bp, Artificial Sequence
  chemically synthesized
cctaccttgttcaaaatgttcc

SEQ ID NO: 137494 - DNA, 22 bp, Artificial Sequence
  chemically synthesized
ccttgttcaaaatgttcctgtc

SEQ ID NO: 137495 - DNA, 22 bp, Artificial Sequence
  chemically synthesized
gttcaaaatgttcctgtccaga

SEQ ID NO: 137496 - DNA, 22 bp, Artificial Sequence
  chemically synthesized
ttcaaaatgttcctgtccagac

SEQ ID NO: 137497 - DNA, 22 bp, Artificial Sequence
  chemically synthesized
aaaatgttcctgtccagaccaa

SEQ ID NO: 137498 - DNA, 22 bp, Artificial Sequence
  chemically synthesized
ctgtccagaccaaagtaccttg

SEQ ID NO: 137499 - DNA, 22 bp, Artificial Sequence
  chemically synthesized
tccagaccaaagtaccttgcct

SEQ ID NO: 137500 - DNA, 22 bp, Artificial Sequence
  chemically synthesized
gccttcacttaagtaatcaatt

SEQ ID NO: 137501 - DNA, 22 bp, Artificial Sequence
  chemically synthesized
ccttcacttaagtaatcaattc

SEQ ID NO: 137502 - DNA, 22 bp, Artificial Sequence
  chemically synthesized
cacttaagtaatcaattcctag

SEQ ID NO: 137503 - DNA, 22 bp, Artificial Sequence
  chemically synthesized
acttaagtaatcaattcctagg

SEQ ID NO: 137504 - DNA, 22 bp, Artificial Sequence
  chemically synthesized
aagtaatcaattcctaggttat

SEQ ID NO: 137505 - DNA, 22 bp, Artificial Sequence
  chemically synthesized
agtaatcaattcctaggttata

SEQ ID NO: 137506 - DNA, 22 bp, Artificial Sequence
  chemically synthesized
ctaggttatattctgatgtcaa

SEQ ID NO: 137507 - DNA, 22 bp, Artificial Sequence
  chemically synthesized
ggttatattctgatgtcaaagg

SEQ ID NO: 137508 - DNA, 22 bp, Artificial Sequence
  chemically synthesized
tattctgatgtcaaaggaagtc

SEQ ID NO: 137509 - DNA, 22 bp, Artificial Sequence
  chemically synthesized
tgatgtcaaaggaagtcaaaag

SEQ ID NO: 137510 - DNA, 22 bp, Artificial Sequence
  chemically synthesized
atgtcaaaggaagtcaaaagat

SEQ ID NO: 137511 - DNA, 22 bp, Artificial Sequence
  chemically synthesized
ctgacccacaactcatgctttg

SEQ ID NO: 137512 - DNA, 22 bp, Artificial Sequence
  chemically synthesized
tgacccacaactcatgctttgt

SEQ ID NO: 137513 - DNA, 22 bp, Artificial Sequence
  chemically synthesized
acccacaactcatgctttgtag

SEQ ID NO: 137514 - DNA, 22 bp, Artificial Sequence
  chemically synthesized
atgctttgtagatgactagatc

SEQ ID NO: 137515 - DNA, 22 bp, Artificial Sequence
  chemically synthesized
tgtagatgactagatcaaaaaa

SEQ ID NO: 137516 - DNA, 22 bp, Artificial Sequence
  chemically synthesized
gtagatgactagatcaaaaaat

SEQ ID NO: 137517 - DNA, 22 bp, Artificial Sequence
  chemically synthesized
tagatgactagatcaaaaaatt

SEQ ID NO: 137518 - DNA, 22 bp, Artificial Sequence
  chemically synthesized
gatcaaaaaatttcagccatat

SEQ ID NO: 137519 - DNA, 22 bp, Artificial Sequence
  chemically synthesized
cagccatatcttaacagtgagt

SEQ ID NO: 137520 - DNA, 22 bp, Artificial Sequence
  chemically synthesized
agccatatcttaacagtgagtg

SEQ ID NO: 137521 - DNA, 22 bp, Artificial Sequence
  chemically synthesized
aacagtgagtgaacaggaaatc

SEQ ID NO: 137522 - DNA, 22 bp, Artificial Sequence
  chemically synthesized
acagtgagtgaacaggaaatct

SEQ ID NO: 137523 - DNA, 22 bp, Artificial Sequence
  chemically synthesized
ctcttttccctacatctgagat

SEQ ID NO: 137524 - DNA, 22 bp, Artificial Sequence
  chemically synthesized
ttttccctacatctgagatccc

SEQ ID NO: 137525 - DNA, 22 bp, Artificial Sequence
  chemically synthesized
ttccctacatctgagatcccag

SEQ ID NO: 137526 - DNA, 22 bp, Artificial Sequence
  chemically synthesized
tccctacatctgagatcccagc

SEQ ID NO: 137527 - DNA, 22 bp, Artificial Sequence
  chemically synthesized
ccctacatctgagatcccagct

SEQ ID NO: 137528 - DNA, 22 bp, Artificial Sequence
  chemically synthesized
cctacatctgagatcccagctt

SEQ ID NO: 137529 - DNA, 22 bp, Artificial Sequence
  chemically synthesized
catctgagatcccagcttctaa

SEQ ID NO: 137530 - DNA, 22 bp, Artificial Sequence
  chemically synthesized
agatcccagcttctaagacctt

SEQ ID NO: 137531 - DNA, 22 bp, Artificial Sequence
  chemically synthesized
ctaagaccttcaattctcactc

SEQ ID NO: 137532 - DNA, 22 bp, Artificial Sequence
  chemically synthesized
taagaccttcaattctcactct

SEQ ID NO: 137533 - DNA, 22 bp, Artificial Sequence
  chemically synthesized
agaccttcaattctcactcttg

SEQ ID NO: 137534 - DNA, 22 bp, Artificial Sequence
  chemically synthesized
caattctcactcttgatgcaac

SEQ ID NO: 137535 - DNA, 22 bp, Artificial Sequence
  chemically synthesized
aattctcactcttgatgcaaca

SEQ ID NO: 137536 - DNA, 22 bp, Artificial Sequence
  chemically synthesized
tcactcttgatgcaacagacct

SEQ ID NO: 137537 - DNA, 22 bp, Artificial Sequence
  chemically synthesized
actcttgatgcaacagaccttg

SEQ ID NO: 137538 - DNA, 22 bp, Artificial Sequence
  chemically synthesized
ttgatgcaacagaccttggaag

SEQ ID NO: 137539 - DNA, 22 bp, Artificial Sequence
  chemically synthesized
gatgcaacagaccttggaagca

SEQ ID NO: 137540 - DNA, 22 bp, Artificial Sequence
  chemically synthesized
atgcaacagaccttggaagcat

SEQ ID NO: 137541 - DNA, 22 bp, Artificial Sequence
  chemically synthesized
ggaagcatacaggagagctgaa

SEQ ID NO: 137542 - DNA, 22 bp, Artificial Sequence
  chemically synthesized
gaagcatacaggagagctgaac

SEQ ID NO: 137543 - DNA, 22 bp, Artificial Sequence
  chemically synthesized
aacttggtcaacaaaggagaaa

SEQ ID NO: 137544 - DNA, 22 bp, Artificial Sequence
  chemically synthesized
ggtcaacaaaggagaaaagttt

SEQ ID NO: 137545 - DNA, 22 bp, Artificial Sequence
  chemically synthesized
gtcaacaaaggagaaaagtttg

SEQ ID NO: 137546 - DNA, 22 bp, Artificial Sequence
  chemically synthesized
gttggcctccaaaggcacagct

SEQ ID NO: 137547 - DNA, 22 bp, Artificial Sequence
  chemically synthesized
ttggcctccaaaggcacagctc

SEQ ID NO: 137548 - DNA, 22 bp, Artificial Sequence
  chemically synthesized
gcctccaaaggcacagctcaaa

SEQ ID NO: 137549 - DNA, 22 bp, Artificial Sequence
  chemically synthesized
caaaggcacagctcaaactttt

SEQ ID NO: 137550 - DNA, 22 bp, Artificial Sequence
  chemically synthesized
aaacttttcaagccttctctaa

SEQ ID NO: 137551 - DNA, 22 bp, Artificial Sequence
  chemically synthesized
ttcaagccttctctaatcttaa

SEQ ID NO: 137552 - DNA, 22 bp, Artificial Sequence
  chemically synthesized
tcaagccttctctaatcttaaa

SEQ ID NO: 137553 - DNA, 22 bp, Artificial Sequence
  chemically synthesized
caagccttctctaatcttaaag

SEQ ID NO: 137554 - DNA, 22 bp, Artificial Sequence
  chemically synthesized
aagccttctctaatcttaaagg

SEQ ID NO: 137555 - DNA, 22 bp, Artificial Sequence
  chemically synthesized
ctctaatcttaaaggtaaacaa

SEQ ID NO: 137556 - DNA, 22 bp, Artificial Sequence
  chemically synthesized
tctaatcttaaaggtaaacaag

SEQ ID NO: 137557 - DNA, 22 bp, Artificial Sequence
  chemically synthesized
taatcttaaaggtaaacaaggg

SEQ ID NO: 137558 - DNA, 22 bp, Artificial Sequence
  chemically synthesized
atcttaaaggtaaacaagggtc

SEQ ID NO: 137559 - DNA, 22 bp, Artificial Sequence
  chemically synthesized
aaaggtaaacaagggtctcatt

SEQ ID NO: 137560 - DNA, 22 bp, Artificial Sequence
  chemically synthesized
aaggtaaacaagggtctcattt

SEQ ID NO: 137561 - DNA, 22 bp, Artificial Sequence
  chemically synthesized
atttctttgagaacttcaggga

SEQ ID NO: 137562 - DNA, 22 bp, Artificial Sequence
  chemically synthesized
ctttgagaacttcagggaaaat

SEQ ID NO: 137563 - DNA, 22 bp, Artificial Sequence
  chemically synthesized
tttgagaacttcagggaaaata

SEQ ID NO: 137564 - DNA, 22 bp, Artificial Sequence
  chemically synthesized
tgagaacttcagggaaaataga

SEQ ID NO: 137565 - DNA, 22 bp, Artificial Sequence
  chemically synthesized
gagaacttcagggaaaatagac

SEQ ID NO: 137566 - DNA, 22 bp, Artificial Sequence
  chemically synthesized
agaacttcagggaaaatagaca

SEQ ID NO: 137567 - DNA, 22 bp, Artificial Sequence
  chemically synthesized
cagggaaaatagacaaggactt

SEQ ID NO: 137568 - DNA, 22 bp, Artificial Sequence
  chemically synthesized
agggaaaatagacaaggacttg

SEQ ID NO: 137569 - DNA, 22 bp, Artificial Sequence
  chemically synthesized
gcctggtgcttttggtagggga

SEQ ID NO: 137570 - DNA, 22 bp, Artificial Sequence
  chemically synthesized
cctggtgcttttggtaggggag

SEQ ID NO: 137571 - DNA, 22 bp, Artificial Sequence
  chemically synthesized
gtgcttttggtaggggagcttg

SEQ ID NO: 137572 - DNA, 22 bp, Artificial Sequence
  chemically synthesized
ttggtaggggagcttgcacttt

SEQ ID NO: 137573 - DNA, 22 bp, Artificial Sequence
  chemically synthesized
tggtaggggagcttgcactttc

SEQ ID NO: 137574 - DNA, 22 bp, Artificial Sequence
  chemically synthesized
ggtaggggagcttgcactttcc

SEQ ID NO: 137575 - DNA, 22 bp, Artificial Sequence
  chemically synthesized
gtaggggagcttgcactttccc

SEQ ID NO: 137576 - DNA, 22 bp, Artificial Sequence
  chemically synthesized
gcactttccccctttctggagg

SEQ ID NO: 137577 - DNA, 22 bp, Artificial Sequence
  chemically synthesized
cactttccccctttctggagga

SEQ ID NO: 137578 - DNA, 22 bp, Artificial Sequence
  chemically synthesized
tccccctttctggaggaaatat

SEQ ID NO: 137579 - DNA, 22 bp, Artificial Sequence
  chemically synthesized
ccccctttctggaggaaatatt

SEQ ID NO: 137580 - DNA, 22 bp, Artificial Sequence
  chemically synthesized
cccctttctggaggaaatattt

SEQ ID NO: 137581 - DNA, 22 bp, Artificial Sequence
  chemically synthesized
tctggaggaaatatttatcccc

SEQ ID NO: 137582 - DNA, 22 bp, Artificial Sequence
  chemically synthesized
ctggaggaaatatttatcccca

SEQ ID NO: 137583 - DNA, 22 bp, Artificial Sequence
  chemically synthesized
tggaggaaatatttatccccag

SEQ ID NO: 137584 - DNA, 22 bp, Artificial Sequence
  chemically synthesized
gaggaaatatttatccccaggt

SEQ ID NO: 137585 - DNA, 22 bp, Artificial Sequence
  chemically synthesized
atccccaggtagttcccttttt

SEQ ID NO: 137586 - DNA, 22 bp, Artificial Sequence
  chemically synthesized
tccccaggtagttccctttttg

SEQ ID NO: 137587 - DNA, 22 bp, Artificial Sequence
  chemically synthesized
cctttttgcaccagtggttctt

SEQ ID NO: 137588 - DNA, 22 bp, Artificial Sequence
  chemically synthesized
tttgcaccagtggttctttgaa

SEQ ID NO: 137589 - DNA, 22 bp, Artificial Sequence
  chemically synthesized
ttgcaccagtggttctttgaag

SEQ ID NO: 137590 - DNA, 22 bp, Artificial Sequence
  chemically synthesized
tgcaccagtggttctttgaaga

SEQ ID NO: 137591 - DNA, 22 bp, Artificial Sequence
  chemically synthesized
gcaccagtggttctttgaagag

SEQ ID NO: 137592 - DNA, 22 bp, Artificial Sequence
  chemically synthesized
caccagtggttctttgaagaga

SEQ ID NO: 137593 - DNA, 22 bp, Artificial Sequence
  chemically synthesized
tttgaagagacttccacctggg

SEQ ID NO: 137594 - DNA, 22 bp, Artificial Sequence
  chemically synthesized
tgaagagacttccacctgggaa

SEQ ID NO: 137595 - DNA, 22 bp, Artificial Sequence
  chemically synthesized
gaagagacttccacctgggaac

SEQ ID NO: 137596 - DNA, 22 bp, Artificial Sequence
  chemically synthesized
aagagacttccacctgggaaca

SEQ ID NO: 137597 - DNA, 22 bp, Artificial Sequence
  chemically synthesized
ccacctgggaacagttaaacag

SEQ ID NO: 137598 - DNA, 22 bp, Artificial Sequence
  chemically synthesized
cacctgggaacagttaaacagc

SEQ ID NO: 137599 - DNA, 22 bp, Artificial Sequence
  chemically synthesized
ggaacagttaaacagcaactac

SEQ ID NO: 137600 - DNA, 22 bp, Artificial Sequence
  chemically synthesized
aacagcaactacagggccttga

SEQ ID NO: 137601 - DNA, 22 bp, Artificial Sequence
  chemically synthesized
cagggccttgaactgcacactt

SEQ ID NO: 137602 - DNA, 22 bp, Artificial Sequence
  chemically synthesized
gaactgcacactttcagtccgg

SEQ ID NO: 137603 - DNA, 22 bp, Artificial Sequence
  chemically synthesized
aactgcacactttcagtccggt

SEQ ID NO: 137604 - DNA, 22 bp, Artificial Sequence
  chemically synthesized
cacactttcagtccggtcctca

SEQ ID NO: 137605 - DNA, 22 bp, Artificial Sequence
  chemically synthesized
tcagtccggtcctcacagttga

SEQ ID NO: 137606 - DNA, 22 bp, Artificial Sequence
  chemically synthesized
cagtccggtcctcacagttgaa

SEQ ID NO: 137607 - DNA, 22 bp, Artificial Sequence
  chemically synthesized
agtccggtcctcacagttgaaa

SEQ ID NO: 137608 - DNA, 22 bp, Artificial Sequence
  chemically synthesized
acagttgaaaagacctaagctt

SEQ ID NO: 137609 - DNA, 22 bp, Artificial Sequence
  chemically synthesized
aaaagacctaagcttgtgcctg

SEQ ID NO: 137610 - DNA, 22 bp, Artificial Sequence
  chemically synthesized
agcttgtgcctgatttaagcct

SEQ ID NO: 137611 - DNA, 22 bp, Artificial Sequence
  chemically synthesized
gtgcctgatttaagcctttttg

SEQ ID NO: 137612 - DNA, 22 bp, Artificial Sequence
  chemically synthesized
tgcctgatttaagcctttttgg

SEQ ID NO: 137613 - DNA, 22 bp, Artificial Sequence
  chemically synthesized
atttaagcctttttggtcataa

SEQ ID NO: 137614 - DNA, 22 bp, Artificial Sequence
  chemically synthesized
aagcctttttggtcataaaaca

SEQ ID NO: 137615 - DNA, 22 bp, Artificial Sequence
  chemically synthesized
agcctttttggtcataaaacat

SEQ ID NO: 137616 - DNA, 22 bp, Artificial Sequence
  chemically synthesized
tttggtcataaaacattgaatt

SEQ ID NO: 137617 - DNA, 22 bp, Artificial Sequence
  chemically synthesized
ttggtcataaaacattgaattc

SEQ ID NO: 137618 - DNA, 22 bp, Artificial Sequence
  chemically synthesized
tggtcataaaacattgaattct

SEQ ID NO: 137619 - DNA, 22 bp, Artificial Sequence
  chemically synthesized
ggtcataaaacattgaattcta

SEQ ID NO: 137620 - DNA, 22 bp, Artificial Sequence
  chemically synthesized
gtcataaaacattgaattctaa

SEQ ID NO: 137621 - DNA, 22 bp, Artificial Sequence
  chemically synthesized
aattctaatctccctctcaacc

SEQ ID NO: 137622 - DNA, 22 bp, Artificial Sequence
  chemically synthesized
taatctccctctcaaccctaca

SEQ ID NO: 137623 - DNA, 22 bp, Artificial Sequence
  chemically synthesized
atctccctctcaaccctacagt

SEQ ID NO: 137624 - DNA, 22 bp, Artificial Sequence
  chemically synthesized
cctctcaaccctacagtcaccc

SEQ ID NO: 137625 - DNA, 22 bp, Artificial Sequence
  chemically synthesized
tcaaccctacagtcacccattt

SEQ ID NO: 137626 - DNA, 22 bp, Artificial Sequence
  chemically synthesized
aaccctacagtcacccatttgg

SEQ ID NO: 137627 - DNA, 22 bp, Artificial Sequence
  chemically synthesized
cagtcacccatttggtatatta

SEQ ID NO: 137628 - DNA, 22 bp, Artificial Sequence
  chemically synthesized
ggtatattaaagatgtgttgtc

SEQ ID NO: 137629 - DNA, 22 bp, Artificial Sequence
  chemically synthesized
gtatattaaagatgtgttgtct

SEQ ID NO: 137630 - DNA, 22 bp, Artificial Sequence
  chemically synthesized
aagatgtgttgtctactgtcta

SEQ ID NO: 137631 - DNA, 22 bp, Artificial Sequence
  chemically synthesized
tctactgtctagtatccctcaa

SEQ ID NO: 137632 - DNA, 22 bp, Artificial Sequence
  chemically synthesized
ctgtctagtatccctcaagtag

SEQ ID NO: 137633 - DNA, 22 bp, Artificial Sequence
  chemically synthesized
tctagtatccctcaagtagtgt

SEQ ID NO: 137634 - DNA, 22 bp, Artificial Sequence
  chemically synthesized
gtatccctcaagtagtgtcagg

SEQ ID NO: 137635 - DNA, 22 bp, Artificial Sequence
  chemically synthesized
aagtagtgtcaggaattagtca

SEQ ID NO: 137636 - DNA, 22 bp, Artificial Sequence
  chemically synthesized
gtcatttaaatagtctgcaagc

SEQ ID NO: 137637 - DNA, 22 bp, Artificial Sequence
  chemically synthesized
aaatagtctgcaagccaggagt

SEQ ID NO: 137638 - DNA, 22 bp, Artificial Sequence
  chemically synthesized
aatagtctgcaagccaggagtg

SEQ ID NO: 137639 - DNA, 22 bp, Artificial Sequence
  chemically synthesized
caagccaggagtggtggctcat

SEQ ID NO: 137640 - DNA, 22 bp, Artificial Sequence
  chemically synthesized
atgtctgtaattccagcacttg

SEQ ID NO: 137641 - DNA, 22 bp, Artificial Sequence
  chemically synthesized
taattccagcacttgagaggta

SEQ ID NO: 137642 - DNA, 22 bp, Artificial Sequence
  chemically synthesized
cagcacttgagaggtagaagtg

SEQ ID NO: 137643 - DNA, 22 bp, Artificial Sequence
  chemically synthesized
gagaggtagaagtgggaggact

SEQ ID NO: 137644 - DNA, 22 bp, Artificial Sequence
  chemically synthesized
agaggtagaagtgggaggactg

SEQ ID NO: 137645 - DNA, 22 bp, Artificial Sequence
  chemically synthesized
cttgagctcaagagtttgatat

SEQ ID NO: 137646 - DNA, 22 bp, Artificial Sequence
  chemically synthesized
gagctcaagagtttgatattat

SEQ ID NO: 137647 - DNA, 22 bp, Artificial Sequence
  chemically synthesized
agctcaagagtttgatattatc

SEQ ID NO: 137648 - DNA, 22 bp, Artificial Sequence
  chemically synthesized
aagagtttgatattatcctgga

SEQ ID NO: 137649 - DNA, 22 bp, Artificial Sequence
  chemically synthesized
gatattatcctggacaacatag

SEQ ID NO: 137650 - DNA, 22 bp, Artificial Sequence
  chemically synthesized
atattatcctggacaacatagc

SEQ ID NO: 137651 - DNA, 22 bp, Artificial Sequence
  chemically synthesized
tcctggacaacatagcaagacc

SEQ ID NO: 137652 - DNA, 22 bp, Artificial Sequence
  chemically synthesized
gacaacatagcaagacctcgtc

SEQ ID NO: 137653 - DNA, 22 bp, Artificial Sequence
  chemically synthesized
gtctctacttaaaaaaaaaaaa

SEQ ID NO: 137654 - DNA, 22 bp, Artificial Sequence
  chemically synthesized
tacttaaaaaaaaaaaaaaaat

SEQ ID NO: 137655 - DNA, 22 bp, Artificial Sequence
  chemically synthesized
cttaaaaaaaaaaaaaaaatta

SEQ ID NO: 137656 - DNA, 22 bp, Artificial Sequence
  chemically synthesized
aaaaaaaaaaaaaaaattagcc

SEQ ID NO: 137657 - DNA, 22 bp, Artificial Sequence
  chemically synthesized
aaaaaaaaaaaaaaattagcca

SEQ ID NO: 137658 - DNA, 22 bp, Artificial Sequence
  chemically synthesized
gccaggcatgtgatgtacacct

SEQ ID NO: 137659 - DNA, 22 bp, Artificial Sequence
  chemically synthesized
tagtcccagctactcaggaggc

SEQ ID NO: 137660 - DNA, 22 bp, Artificial Sequence
  chemically synthesized
ctcaggaggccgaaatgggagg

SEQ ID NO: 137661 - DNA, 22 bp, Artificial Sequence
  chemically synthesized
aggaggccgaaatgggaggatc

SEQ ID NO: 137662 - DNA, 22 bp, Artificial Sequence
  chemically synthesized
gagctcaggaggtcaaggctgc

SEQ ID NO: 137663 - DNA, 22 bp, Artificial Sequence
  chemically synthesized
agctcaggaggtcaaggctgca

SEQ ID NO: 137664 - DNA, 22 bp, Artificial Sequence
  chemically synthesized
aggaggtcaaggctgcagtgag

SEQ ID NO: 137665 - DNA, 22 bp, Artificial Sequence
  chemically synthesized
cagtgagacatgatcttgccac

SEQ ID NO: 137666 - DNA, 22 bp, Artificial Sequence
  chemically synthesized
gccactgcactccagcctggac

SEQ ID NO: 137667 - DNA, 22 bp, Artificial Sequence
  chemically synthesized
ccactgcactccagcctggaca

SEQ ID NO: 137668 - DNA, 22 bp, Artificial Sequence
  chemically synthesized
cactccagcctggacagcagag

SEQ ID NO: 137669 - DNA, 22 bp, Artificial Sequence
  chemically synthesized
cagcctggacagcagagtgaaa

SEQ ID NO: 137670 - DNA, 22 bp, Artificial Sequence
  chemically synthesized
gacagcagagtgaaaccttgcc

SEQ ID NO: 137671 - DNA, 22 bp, Artificial Sequence
  chemically synthesized
gcctcacgaaacagaatacaaa

SEQ ID NO: 137672 - DNA, 22 bp, Artificial Sequence
  chemically synthesized
cctcacgaaacagaatacaaaa

SEQ ID NO: 137673 - DNA, 22 bp, Artificial Sequence
  chemically synthesized
acgaaacagaatacaaaaacaa

SEQ ID NO: 137674 - DNA, 22 bp, Artificial Sequence
  chemically synthesized
ctccgcaatgcgcttccttgat

SEQ ID NO: 137675 - DNA, 22 bp, Artificial Sequence
  chemically synthesized
cgcaatgcgcttccttgatgct

SEQ ID NO: 137676 - DNA, 22 bp, Artificial Sequence
  chemically synthesized
ccttgatgctctaccacatagg

SEQ ID NO: 137677 - DNA, 22 bp, Artificial Sequence
  chemically synthesized
cttgatgctctaccacataggt

SEQ ID NO: 137678 - DNA, 22 bp, Artificial Sequence
  chemically synthesized
gatgctctaccacataggtctg

SEQ ID NO: 137679 - DNA, 22 bp, Artificial Sequence
  chemically synthesized
atgctctaccacataggtctgg

SEQ ID NO: 137680 - DNA, 22 bp, Artificial Sequence
  chemically synthesized
taccacataggtctgggtactt

SEQ ID NO: 137681 - DNA, 22 bp, Artificial Sequence
  chemically synthesized
ccacataggtctgggtactttg

SEQ ID NO: 137682 - DNA, 22 bp, Artificial Sequence
  chemically synthesized
ggtactttgtacacattatctc

SEQ ID NO: 137683 - DNA, 22 bp, Artificial Sequence
  chemically synthesized
tgtacacattatctcattgctg

SEQ ID NO: 137684 - DNA, 22 bp, Artificial Sequence
  chemically synthesized
gtacacattatctcattgctgt

SEQ ID NO: 137685 - DNA, 22 bp, Artificial Sequence
  chemically synthesized
tacacattatctcattgctgtt

SEQ ID NO: 137686 - DNA, 22 bp, Artificial Sequence
  chemically synthesized
tctcattgctgttcataattgt

SEQ ID NO: 137687 - DNA, 22 bp, Artificial Sequence
  chemically synthesized
attgctgttcataattgttaga

SEQ ID NO: 137688 - DNA, 22 bp, Artificial Sequence
  chemically synthesized
ctgttcataattgttagattaa

SEQ ID NO: 137689 - DNA, 22 bp, Artificial Sequence
  chemically synthesized
ttcataattgttagattaattt

SEQ ID NO: 137690 - DNA, 22 bp, Artificial Sequence
  chemically synthesized
ataattgttagattaattttgt

SEQ ID NO: 137691 - DNA, 22 bp, Artificial Sequence
  chemically synthesized
ttagattaattttgtaatattg

SEQ ID NO: 137692 - DNA, 22 bp, Artificial Sequence
  chemically synthesized
gattaattttgtaatattgata

SEQ ID NO: 137693 - DNA, 22 bp, Artificial Sequence
  chemically synthesized
attttgtaatattgatattatt

SEQ ID NO: 137694 - DNA, 22 bp, Artificial Sequence
  chemically synthesized
tgtaatattgatattattccta

SEQ ID NO: 137695 - DNA, 22 bp, Artificial Sequence
  chemically synthesized
gtaatattgatattattcctag

SEQ ID NO: 137696 - DNA, 22 bp, Artificial Sequence
  chemically synthesized
taatattgatattattcctaga

SEQ ID NO: 137697 - DNA, 22 bp, Artificial Sequence
  chemically synthesized
atattattcctagaaagctgag

SEQ ID NO: 137698 - DNA, 22 bp, Artificial Sequence
  chemically synthesized
ttcctagaaagctgaggcctca

SEQ ID NO: 137699 - DNA, 22 bp, Artificial Sequence
  chemically synthesized
ctagaaagctgaggcctcaaga

SEQ ID NO: 137700 - DNA, 22 bp, Artificial Sequence
  chemically synthesized
gaaagctgaggcctcaagatga

SEQ ID NO: 137701 - DNA, 22 bp, Artificial Sequence
  chemically synthesized
aggcctcaagatgataactttt

SEQ ID NO: 137702 - DNA, 22 bp, Artificial Sequence
  chemically synthesized
aagatgataacttttattttct

SEQ ID NO: 137703 - DNA, 22 bp, Artificial Sequence
  chemically synthesized
ttattttctggacttgtaatag

SEQ ID NO: 137704 - DNA, 22 bp, Artificial Sequence
  chemically synthesized
tattttctggacttgtaatagc

SEQ ID NO: 137705 - DNA, 22 bp, Artificial Sequence
  chemically synthesized
attttctggacttgtaatagct

SEQ ID NO: 137706 - DNA, 22 bp, Artificial Sequence
  chemically synthesized
ttttctggacttgtaatagctt

SEQ ID NO: 137707 - DNA, 22 bp, Artificial Sequence
  chemically synthesized
tctggacttgtaatagctttct

SEQ ID NO: 137708 - DNA, 22 bp, Artificial Sequence
  chemically synthesized
ctggacttgtaatagctttctc

SEQ ID NO: 137709 - DNA, 22 bp, Artificial Sequence
  chemically synthesized
tggacttgtaatagctttctct

SEQ ID NO: 137710 - DNA, 22 bp, Artificial Sequence
  chemically synthesized
gacttgtaatagctttctcttg

SEQ ID NO: 137711 - DNA, 22 bp, Artificial Sequence
  chemically synthesized
gtaatagctttctcttgtattc

SEQ ID NO: 137712 - DNA, 22 bp, Artificial Sequence
  chemically synthesized
taatagctttctcttgtattca

SEQ ID NO: 137713 - DNA, 22 bp, Artificial Sequence
  chemically synthesized
tctcttgtattcaccatgttgt

SEQ ID NO: 137714 - DNA, 22 bp, Artificial Sequence
  chemically synthesized
ctcttgtattcaccatgttgta

SEQ ID NO: 137715 - DNA, 22 bp, Artificial Sequence
  chemically synthesized
tcttgtattcaccatgttgtaa

SEQ ID NO: 137716 - DNA, 22 bp, Artificial Sequence
  chemically synthesized
ttgtattcaccatgttgtaact

SEQ ID NO: 137717 - DNA, 22 bp, Artificial Sequence
  chemically synthesized
gtattcaccatgttgtaacttt

SEQ ID NO: 137718 - DNA, 22 bp, Artificial Sequence
  chemically synthesized
tattcaccatgttgtaactttc

SEQ ID NO: 137719 - DNA, 22 bp, Artificial Sequence
  chemically synthesized
accatgttgtaactttcttaga

SEQ ID NO: 137720 - DNA, 22 bp, Artificial Sequence
  chemically synthesized
taactttcttagagtagtaaca

SEQ ID NO: 137721 - DNA, 22 bp, Artificial Sequence
  chemically synthesized
tcttagagtagtaacaatataa

SEQ ID NO: 137722 - DNA, 22 bp, Artificial Sequence
  chemically synthesized
cttagagtagtaacaatataaa

SEQ ID NO: 137723 - DNA, 22 bp, Artificial Sequence
  chemically synthesized
ttagagtagtaacaatataaag

SEQ ID NO: 137724 - DNA, 22 bp, Artificial Sequence
  chemically synthesized
agagtagtaacaatataaagtt

SEQ ID NO: 137725 - DNA, 22 bp, Artificial Sequence
  chemically synthesized
gagtagtaacaatataaagtta

SEQ ID NO: 137726 - DNA, 22 bp, Artificial Sequence
  chemically synthesized
ttgtgagtttttgcaaacacag

SEQ ID NO: 137727 - DNA, 22 bp, Artificial Sequence
  chemically synthesized
tgagtttttgcaaacacagcaa

SEQ ID NO: 137728 - DNA, 22 bp, Artificial Sequence
  chemically synthesized
ttgcaaacacagcaaacacaac

SEQ ID NO: 137729 - DNA, 22 bp, Artificial Sequence
  chemically synthesized
tgcaaacacagcaaacacaacg

SEQ ID NO: 137730 - DNA, 22 bp, Artificial Sequence
  chemically synthesized
gcaaacacagcaaacacaacga

SEQ ID NO: 137731 - DNA, 22 bp, Artificial Sequence
  chemically synthesized
caaacacagcaaacacaacgac

SEQ ID NO: 137732 - DNA, 22 bp, Artificial Sequence
  chemically synthesized
atgtgaaattgtctattgtcaa

SEQ ID NO: 137733 - DNA, 22 bp, Artificial Sequence
  chemically synthesized
tctattgtcaatttatgggaaa

SEQ ID NO: 137734 - DNA, 22 bp, Artificial Sequence
  chemically synthesized
ttgtcaatttatgggaaaacaa

SEQ ID NO: 137735 - DNA, 22 bp, Artificial Sequence
  chemically synthesized
tcaatttatgggaaaacaagta

SEQ ID NO: 137736 - DNA, 22 bp, Artificial Sequence
  chemically synthesized
atgggaaaacaagtatgtactt

SEQ ID NO: 137737 - DNA, 22 bp, Artificial Sequence
  chemically synthesized
tgggaaaacaagtatgtacttt

SEQ ID NO: 137738 - DNA, 22 bp, Artificial Sequence
  chemically synthesized
tttctactaagccattgaaaca

SEQ ID NO: 137739 - DNA, 22 bp, Artificial Sequence
  chemically synthesized
ttctactaagccattgaaacag

SEQ ID NO: 137740 - DNA, 22 bp, Artificial Sequence
  chemically synthesized
tctactaagccattgaaacagg

SEQ ID NO: 137741 - DNA, 22 bp, Artificial Sequence
  chemically synthesized
ctactaagccattgaaacagga

SEQ ID NO: 137742 - DNA, 22 bp, Artificial Sequence
  chemically synthesized
tactaagccattgaaacaggaa

SEQ ID NO: 137743 - DNA, 22 bp, Artificial Sequence
  chemically synthesized
ctaagccattgaaacaggaata

SEQ ID NO: 137744 - DNA, 22 bp, Artificial Sequence
  chemically synthesized
agccattgaaacaggaataaca

SEQ ID NO: 137745 - DNA, 22 bp, Artificial Sequence
  chemically synthesized
aaacaggaataacagaacaaga

SEQ ID NO: 137746 - DNA, 22 bp, Artificial Sequence
  chemically synthesized
aaagaatacattttccgaaatt

SEQ ID NO: 137747 - DNA, 22 bp, Artificial Sequence
  chemically synthesized
tccgaaattacttgagtattat

SEQ ID NO: 137748 - DNA, 22 bp, Artificial Sequence
  chemically synthesized
ccgaaattacttgagtattata

SEQ ID NO: 137749 - DNA, 22 bp, Artificial Sequence
  chemically synthesized
cgaaattacttgagtattatac

SEQ ID NO: 137750 - DNA, 22 bp, Artificial Sequence
  chemically synthesized
cttgagtattatacaaagacaa

SEQ ID NO: 137751 - DNA, 22 bp, Artificial Sequence
  chemically synthesized
gagtattatacaaagacaagca

SEQ ID NO: 137752 - DNA, 22 bp, Artificial Sequence
  chemically synthesized
agtattatacaaagacaagcac

SEQ ID NO: 137753 - DNA, 22 bp, Artificial Sequence
  chemically synthesized
tacaaagacaagcacgtggacc

SEQ ID NO: 137754 - DNA, 22 bp, Artificial Sequence
  chemically synthesized
ggaggagggttattgtccatga

SEQ ID NO: 137755 - DNA, 22 bp, Artificial Sequence
  chemically synthesized
ttgtccatgactggtgtgtgga

SEQ ID NO: 137756 - DNA, 22 bp, Artificial Sequence
  chemically synthesized
tccatgactggtgtgtggagac

SEQ ID NO: 137757 - DNA, 22 bp, Artificial Sequence
  chemically synthesized
gtgtgtggagacaaatgcaggt

SEQ ID NO: 137758 - DNA, 22 bp, Artificial Sequence
  chemically synthesized
ataatagatgggatggcatcta

SEQ ID NO: 137759 - DNA, 22 bp, Artificial Sequence
  chemically synthesized
taatagatgggatggcatctag

SEQ ID NO: 137760 - DNA, 22 bp, Artificial Sequence
  chemically synthesized
gcgcaatgactttgccatcact

SEQ ID NO: 137761 - DNA, 22 bp, Artificial Sequence
  chemically synthesized
tgccatcacttttagagagctc

SEQ ID NO: 137762 - DNA, 22 bp, Artificial Sequence
  chemically synthesized
gccatcacttttagagagctct

SEQ ID NO: 137763 - DNA, 22 bp, Artificial Sequence
  chemically synthesized
ccatcacttttagagagctctt

SEQ ID NO: 137764 - DNA, 22 bp, Artificial Sequence
  chemically synthesized
ttagagagctcttggggacccc

SEQ ID NO: 137765 - DNA, 22 bp, Artificial Sequence
  chemically synthesized
tagagagctcttggggacccca

SEQ ID NO: 137766 - DNA, 22 bp, Artificial Sequence
  chemically synthesized
agagagctcttggggaccccag

SEQ ID NO: 137767 - DNA, 22 bp, Artificial Sequence
  chemically synthesized
gagagctcttggggaccccagt

SEQ ID NO: 137768 - DNA, 22 bp, Artificial Sequence
  chemically synthesized
ttggggaccccagtacacaaga

SEQ ID NO: 137769 - DNA, 22 bp, Artificial Sequence
  chemically synthesized
ggggaccccagtacacaagagg

SEQ ID NO: 137770 - DNA, 22 bp, Artificial Sequence
  chemically synthesized
gggaccccagtacacaagaggg

SEQ ID NO: 137771 - DNA, 22 bp, Artificial Sequence
  chemically synthesized
attctttttcttagtgtgagaa

SEQ ID NO: 137772 - DNA, 22 bp, Artificial Sequence
  chemically synthesized
tttttcttagtgtgagaataag

SEQ ID NO: 137773 - DNA, 22 bp, Artificial Sequence
  chemically synthesized
tttcttagtgtgagaataagaa

SEQ ID NO: 137774 - DNA, 22 bp, Artificial Sequence
  chemically synthesized
ttcttagtgtgagaataagaat

SEQ ID NO: 137775 - DNA, 22 bp, Artificial Sequence
  chemically synthesized
tcttagtgtgagaataagaata

SEQ ID NO: 137776 - DNA, 22 bp, Artificial Sequence
  chemically synthesized
cttagtgtgagaataagaatag

SEQ ID NO: 137777 - DNA, 22 bp, Artificial Sequence
  chemically synthesized
ttagtgtgagaataagaatagc

SEQ ID NO: 137778 - DNA, 22 bp, Artificial Sequence
  chemically synthesized
agtgtgagaataagaatagcca

SEQ ID NO: 137779 - DNA, 22 bp, Artificial Sequence
  chemically synthesized
gtgtgagaataagaatagccat

SEQ ID NO: 137780 - DNA, 22 bp, Artificial Sequence
  chemically synthesized
agtttatagacaatgagccctt

SEQ ID NO: 137781 - DNA, 22 bp, Artificial Sequence
  chemically synthesized
atagacaatgagcccttttctc

SEQ ID NO: 137782 - DNA, 22 bp, Artificial Sequence
  chemically synthesized
tagacaatgagcccttttctct

SEQ ID NO: 137783 - DNA, 22 bp, Artificial Sequence
  chemically synthesized
ttctctctcccactcagcagct

SEQ ID NO: 137784 - DNA, 22 bp, Artificial Sequence
  chemically synthesized
tctctctcccactcagcagcta

SEQ ID NO: 137785 - DNA, 22 bp, Artificial Sequence
  chemically synthesized
ctctctcccactcagcagctat

SEQ ID NO: 137786 - DNA, 22 bp, Artificial Sequence
  chemically synthesized
tctctcccactcagcagctatg

SEQ ID NO: 137787 - DNA, 22 bp, Artificial Sequence
  chemically synthesized
tctcccactcagcagctatgag

SEQ ID NO: 137788 - DNA, 22 bp, Artificial Sequence
  chemically synthesized
tcccactcagcagctatgagat

SEQ ID NO: 137789 - DNA, 22 bp, Artificial Sequence
  chemically synthesized
ccactcagcagctatgagatgg

SEQ ID NO: 137790 - DNA, 22 bp, Artificial Sequence
  chemically synthesized
agcagctatgagatggcttgcc

SEQ ID NO: 137791 - DNA, 22 bp, Artificial Sequence
  chemically synthesized
tgagatggcttgccctgcctct

SEQ ID NO: 137792 - DNA, 22 bp, Artificial Sequence
  chemically synthesized
gccctgcctctctactaggctg

SEQ ID NO: 137793 - DNA, 22 bp, Artificial Sequence
  chemically synthesized
ccctgcctctctactaggctga

SEQ ID NO: 137794 - DNA, 22 bp, Artificial Sequence
  chemically synthesized
cctctctactaggctgactcac

SEQ ID NO: 137795 - DNA, 22 bp, Artificial Sequence
  chemically synthesized
tctactaggctgactcactcca

SEQ ID NO: 137796 - DNA, 22 bp, Artificial Sequence
  chemically synthesized
tactaggctgactcactccaag

SEQ ID NO: 137797 - DNA, 22 bp, Artificial Sequence
  chemically synthesized
ctaggctgactcactccaaggc

SEQ ID NO: 137798 - DNA, 22 bp, Artificial Sequence
  chemically synthesized
ggctgactcactccaaggccca

SEQ ID NO: 137799 - DNA, 22 bp, Artificial Sequence
  chemically synthesized
actcactccaaggcccagcaat

SEQ ID NO: 137800 - DNA, 22 bp, Artificial Sequence
  chemically synthesized
actccaaggcccagcaatgggc

SEQ ID NO: 137801 - DNA, 22 bp, Artificial Sequence
  chemically synthesized
caaggcccagcaatgggcaggg

SEQ ID NO: 137802 - DNA, 22 bp, Artificial Sequence
  chemically synthesized
tgtcagggctttgatagcacta

SEQ ID NO: 137803 - DNA, 22 bp, Artificial Sequence
  chemically synthesized
tcagggctttgatagcactatc

SEQ ID NO: 137804 - DNA, 22 bp, Artificial Sequence
  chemically synthesized
tgatagcactatctgcagagcc

SEQ ID NO: 137805 - DNA, 22 bp, Artificial Sequence
  chemically synthesized
gatagcactatctgcagagcca

SEQ ID NO: 137806 - DNA, 22 bp, Artificial Sequence
  chemically synthesized
atagcactatctgcagagccag

SEQ ID NO: 137807 - DNA, 22 bp, Artificial Sequence
  chemically synthesized
tctgcagagccagggccgagaa

SEQ ID NO: 137808 - DNA, 22 bp, Artificial Sequence
  chemically synthesized
cagagccagggccgagaagggg

SEQ ID NO: 137809 - DNA, 22 bp, Artificial Sequence
  chemically synthesized
cagagactctccctcccattcc

SEQ ID NO: 137810 - DNA, 22 bp, Artificial Sequence
  chemically synthesized
tccctcccattcccgagcaggg

SEQ ID NO: 137811 - DNA, 22 bp, Artificial Sequence
  chemically synthesized
cctcccattcccgagcagggtt

SEQ ID NO: 137812 - DNA, 22 bp, Artificial Sequence
  chemically synthesized
ccattcccgagcagggtttgct

SEQ ID NO: 137813 - DNA, 22 bp, Artificial Sequence
  chemically synthesized
ccgagcagggtttgcttattta

SEQ ID NO: 137814 - DNA, 22 bp, Artificial Sequence
  chemically synthesized
gcttatttatgcatttaaatga

SEQ ID NO: 137815 - DNA, 22 bp, Artificial Sequence
  chemically synthesized
cttatttatgcatttaaatgat

SEQ ID NO: 137816 - DNA, 22 bp, Artificial Sequence
  chemically synthesized
atttatgcatttaaatgatata

SEQ ID NO: 137817 - DNA, 22 bp, Artificial Sequence
  chemically synthesized
tttatgcatttaaatgatatat

SEQ ID NO: 137818 - DNA, 22 bp, Artificial Sequence
  chemically synthesized
atgcatttaaatgatatattta

SEQ ID NO: 137819 - DNA, 22 bp, Artificial Sequence
  chemically synthesized
tgcatttaaatgatatatttat

SEQ ID NO: 137820 - DNA, 22 bp, Artificial Sequence
  chemically synthesized
aaatgatatatttattttaaaa

SEQ ID NO: 137821 - DNA, 22 bp, Artificial Sequence
  chemically synthesized
aatgatatatttattttaaaag

SEQ ID NO: 137822 - DNA, 22 bp, Artificial Sequence
  chemically synthesized
attttaaaagaaataacaggag

SEQ ID NO: 137823 - DNA, 22 bp, Artificial Sequence
  chemically synthesized
ttttaaaagaaataacaggaga

SEQ ID NO: 137824 - DNA, 22 bp, Artificial Sequence
  chemically synthesized
taaaagaaataacaggagactg

SEQ ID NO: 137825 - DNA, 22 bp, Artificial Sequence
  chemically synthesized
aaaagaaataacaggagactgc

SEQ ID NO: 137826 - DNA, 22 bp, Artificial Sequence
  chemically synthesized
aaagaaataacaggagactgcc

SEQ ID NO: 137827 - DNA, 22 bp, Artificial Sequence
  chemically synthesized
cccagccctggctgtgacatgg

SEQ ID NO: 137828 - DNA, 22 bp, Artificial Sequence
  chemically synthesized
gctgtgacatggaaactatgta

SEQ ID NO: 137829 - DNA, 22 bp, Artificial Sequence
  chemically synthesized
tgacatggaaactatgtagaat

SEQ ID NO: 137830 - DNA, 22 bp, Artificial Sequence
  chemically synthesized
tgtagaatattttgggttccat

SEQ ID NO: 137831 - DNA, 22 bp, Artificial Sequence
  chemically synthesized
tgggttccatttttttttcctt

SEQ ID NO: 137832 - DNA, 22 bp, Artificial Sequence
  chemically synthesized
gggttccatttttttttccttc

SEQ ID NO: 137833 - DNA, 22 bp, Artificial Sequence
  chemically synthesized
ggttccatttttttttccttct

SEQ ID NO: 137834 - DNA, 22 bp, Artificial Sequence
  chemically synthesized
catttttttttccttctttcag

SEQ ID NO: 137835 - DNA, 22 bp, Artificial Sequence
  chemically synthesized
ttttttccttctttcagttaga

SEQ ID NO: 137836 - DNA, 22 bp, Artificial Sequence
  chemically synthesized
tttttccttctttcagttagag

SEQ ID NO: 137837 - DNA, 22 bp, Artificial Sequence
  chemically synthesized
ttttccttctttcagttagagg

SEQ ID NO: 137838 - DNA, 22 bp, Artificial Sequence
  chemically synthesized
tttccttctttcagttagagga

SEQ ID NO: 137839 - DNA, 22 bp, Artificial Sequence
  chemically synthesized
ttccttctttcagttagaggaa

SEQ ID NO: 137840 - DNA, 22 bp, Artificial Sequence
  chemically synthesized
tccttctttcagttagaggaaa

SEQ ID NO: 137841 - DNA, 22 bp, Artificial Sequence
  chemically synthesized
ccttctttcagttagaggaaaa

SEQ ID NO: 137842 - DNA, 22 bp, Artificial Sequence
  chemically synthesized
cttctttcagttagaggaaaag

SEQ ID NO: 137843 - DNA, 22 bp, Artificial Sequence
  chemically synthesized
ctttcagttagaggaaaagggg

SEQ ID NO: 137844 - DNA, 22 bp, Artificial Sequence
  chemically synthesized
tttcagttagaggaaaaggggc

SEQ ID NO: 137845 - DNA, 22 bp, Artificial Sequence
  chemically synthesized
tcagttagaggaaaaggggctc

SEQ ID NO: 137846 - DNA, 22 bp, Artificial Sequence
  chemically synthesized
cagttagaggaaaaggggctca

SEQ ID NO: 137847 - DNA, 22 bp, Artificial Sequence
  chemically synthesized
agttagaggaaaaggggctcac

SEQ ID NO: 137848 - DNA, 22 bp, Artificial Sequence
  chemically synthesized
gaggaaaaggggctcactgcac

SEQ ID NO: 137849 - DNA, 22 bp, Artificial Sequence
  chemically synthesized
actgcacatacactagacagaa

SEQ ID NO: 137850 - DNA, 22 bp, Artificial Sequence
  chemically synthesized
cacatacactagacagaaagtc

SEQ ID NO: 137851 - DNA, 22 bp, Artificial Sequence
  chemically synthesized
gacagaaagtcaggagctttga

SEQ ID NO: 137852 - DNA, 22 bp, Artificial Sequence
  chemically synthesized
tgaatccaagcctgatcatttc

SEQ ID NO: 137853 - DNA, 22 bp, Artificial Sequence
  chemically synthesized
gaatccaagcctgatcatttcc

SEQ ID NO: 137854 - DNA, 22 bp, Artificial Sequence
  chemically synthesized
aatccaagcctgatcatttcca

SEQ ID NO: 137855 - DNA, 22 bp, Artificial Sequence
  chemically synthesized
atcatttccatgtcatactgag

SEQ ID NO: 137856 - DNA, 22 bp, Artificial Sequence
  chemically synthesized
ccatgtcatactgagaaagtcc

SEQ ID NO: 137857 - DNA, 22 bp, Artificial Sequence
  chemically synthesized
catgtcatactgagaaagtccc

SEQ ID NO: 137858 - DNA, 22 bp, Artificial Sequence
  chemically synthesized
agaaagtccccacccttctctg

SEQ ID NO: 137859 - DNA, 22 bp, Artificial Sequence
  chemically synthesized
ctctgagcctcagtttctcttt

SEQ ID NO: 137860 - DNA, 22 bp, Artificial Sequence
  chemically synthesized
tctgagcctcagtttctctttt

SEQ ID NO: 137861 - DNA, 22 bp, Artificial Sequence
  chemically synthesized
tgagcctcagtttctcttttta

SEQ ID NO: 137862 - DNA, 22 bp, Artificial Sequence
  chemically synthesized
agcctcagtttctctttttata

SEQ ID NO: 137863 - DNA, 22 bp, Artificial Sequence
  chemically synthesized
agtttctctttttataagtagg

SEQ ID NO: 137864 - DNA, 22 bp, Artificial Sequence
  chemically synthesized
ctctttttataagtaggagtct

SEQ ID NO: 137865 - DNA, 22 bp, Artificial Sequence
  chemically synthesized
tctttttataagtaggagtctg

SEQ ID NO: 137866 - DNA, 22 bp, Artificial Sequence
  chemically synthesized
tttttataagtaggagtctgga

SEQ ID NO: 137867 - DNA, 22 bp, Artificial Sequence
  chemically synthesized
tttataagtaggagtctggagt

SEQ ID NO: 137868 - DNA, 22 bp, Artificial Sequence
  chemically synthesized
ttataagtaggagtctggagta

SEQ ID NO: 137869 - DNA, 22 bp, Artificial Sequence
  chemically synthesized
tataagtaggagtctggagtaa

SEQ ID NO: 137870 - DNA, 22 bp, Artificial Sequence
  chemically synthesized
ataagtaggagtctggagtaaa

SEQ ID NO: 137871 - DNA, 22 bp, Artificial Sequence
  chemically synthesized
taagtaggagtctggagtaaat

SEQ ID NO: 137872 - DNA, 22 bp, Artificial Sequence
  chemically synthesized
gagtaaatgatttccaatggct

SEQ ID NO: 137873 - DNA, 22 bp, Artificial Sequence
  chemically synthesized
ccaatggctctcatttcaatac

SEQ ID NO: 137874 - DNA, 22 bp, Artificial Sequence
  chemically synthesized
caatggctctcatttcaataca

SEQ ID NO: 137875 - DNA, 22 bp, Artificial Sequence
  chemically synthesized
tcatttcaatacaaaatttccg

SEQ ID NO: 137876 - DNA, 22 bp, Artificial Sequence
  chemically synthesized
atttcaatacaaaatttccgtt

SEQ ID NO: 137877 - DNA, 22 bp, Artificial Sequence
  chemically synthesized
caatacaaaatttccgtttatt

SEQ ID NO: 137878 - DNA, 22 bp, Artificial Sequence
  chemically synthesized
aatacaaaatttccgtttatta

SEQ ID NO: 137879 - DNA, 22 bp, Artificial Sequence
  chemically synthesized
ccgtttattaaatgcatgagct

SEQ ID NO: 137880 - DNA, 22 bp, Artificial Sequence
  chemically synthesized
cgtttattaaatgcatgagctt

SEQ ID NO: 137881 - DNA, 22 bp, Artificial Sequence
  chemically synthesized
attaaatgcatgagcttctgtt

SEQ ID NO: 137882 - DNA, 22 bp, Artificial Sequence
  chemically synthesized
ttaaatgcatgagcttctgtta

SEQ ID NO: 137883 - DNA, 22 bp, Artificial Sequence
  chemically synthesized
aatgcatgagcttctgttactc

SEQ ID NO: 137884 - DNA, 22 bp, Artificial Sequence
  chemically synthesized
ctgttactccaagactgagaag

SEQ ID NO: 137885 - DNA, 22 bp, Artificial Sequence
  chemically synthesized
tgttactccaagactgagaagg

SEQ ID NO: 137886 - DNA, 22 bp, Artificial Sequence
  chemically synthesized
ttactccaagactgagaaggaa

SEQ ID NO: 137887 - DNA, 22 bp, Artificial Sequence
  chemically synthesized
ctccaagactgagaaggaaatt

SEQ ID NO: 137888 - DNA, 22 bp, Artificial Sequence
  chemically synthesized
caagactgagaaggaaattgaa

SEQ ID NO: 137889 - DNA, 22 bp, Artificial Sequence
  chemically synthesized
agaaggaaattgaacctgagac

SEQ ID NO: 137890 - DNA, 22 bp, Artificial Sequence
  chemically synthesized
aacctgagactcattgactggc

SEQ ID NO: 137891 - DNA, 22 bp, Artificial Sequence
  chemically synthesized
agactcattgactggcaagatg

SEQ ID NO: 137892 - DNA, 22 bp, Artificial Sequence
  chemically synthesized
attgactggcaagatgtcccca

SEQ ID NO: 137893 - DNA, 22 bp, Artificial Sequence
  chemically synthesized
actggcaagatgtccccagagg

SEQ ID NO: 137894 - DNA, 22 bp, Artificial Sequence
  chemically synthesized
gcaagatgtccccagaggctct

SEQ ID NO: 137895 - DNA, 22 bp, Artificial Sequence
  chemically synthesized
tcattcagcaataaaattctca

SEQ ID NO: 137896 - DNA, 22 bp, Artificial Sequence
  chemically synthesized
attcagcaataaaattctcacc

SEQ ID NO: 137897 - DNA, 22 bp, Artificial Sequence
  chemically synthesized
agcaataaaattctcaccttca

SEQ ID NO: 137898 - DNA, 22 bp, Artificial Sequence
  chemically synthesized
tcaccttcacccaggcccactg

SEQ ID NO: 137899 - DNA, 22 bp, Artificial Sequence
  chemically synthesized
accttcacccaggcccactgag

SEQ ID NO: 137900 - DNA, 22 bp, Artificial Sequence
  chemically synthesized
cacccaggcccactgagtgtca

SEQ ID NO: 137901 - DNA, 22 bp, Artificial Sequence
  chemically synthesized
acccaggcccactgagtgtcag

SEQ ID NO: 137902 - DNA, 22 bp, Artificial Sequence
  chemically synthesized
agtgtcagatttgcatgcacta

SEQ ID NO: 137903 - DNA, 22 bp, Artificial Sequence
  chemically synthesized
gcatgcactagttcacgtgtgt

SEQ ID NO: 137904 - DNA, 22 bp, Artificial Sequence
  chemically synthesized
catgcactagttcacgtgtgta

SEQ ID NO: 137905 - DNA, 22 bp, Artificial Sequence
  chemically synthesized
gttcacgtgtgtaaaaaggagg

SEQ ID NO: 137906 - DNA, 22 bp, Artificial Sequence
  chemically synthesized
acgtgtgtaaaaaggaggatgc

SEQ ID NO: 137907 - DNA, 22 bp, Artificial Sequence
  chemically synthesized
ctttcctttgtattctcacata

SEQ ID NO: 137908 - DNA, 22 bp, Artificial Sequence
  chemically synthesized
tttcctttgtattctcacatac

SEQ ID NO: 137909 - DNA, 22 bp, Artificial Sequence
  chemically synthesized
tcctttgtattctcacatacct

SEQ ID NO: 137910 - DNA, 22 bp, Artificial Sequence
  chemically synthesized
cctttgtattctcacatacctt

SEQ ID NO: 137911 - DNA, 22 bp, Artificial Sequence
  chemically synthesized
ctttgtattctcacataccttt

SEQ ID NO: 137912 - DNA, 22 bp, Artificial Sequence
  chemically synthesized
tgtattctcacatacctttagg

SEQ ID NO: 137913 - DNA, 22 bp, Artificial Sequence
  chemically synthesized
gtattctcacatacctttagga

SEQ ID NO: 137914 - DNA, 22 bp, Artificial Sequence
  chemically synthesized
tattctcacatacctttaggaa

SEQ ID NO: 137915 - DNA, 22 bp, Artificial Sequence
  chemically synthesized
tcacatacctttaggaaagaac

SEQ ID NO: 137916 - DNA, 22 bp, Artificial Sequence
  chemically synthesized
acatacctttaggaaagaactt

SEQ ID NO: 137917 - DNA, 22 bp, Artificial Sequence
  chemically synthesized
taggaaagaacttagcaccctt

SEQ ID NO: 137918 - DNA, 22 bp, Artificial Sequence
  chemically synthesized
aggaaagaacttagcacccttc

SEQ ID NO: 137919 - DNA, 22 bp, Artificial Sequence
  chemically synthesized
ggaaagaacttagcacccttcc

SEQ ID NO: 137920 - DNA, 22 bp, Artificial Sequence
  chemically synthesized
agcacccttcccacacagccat

SEQ ID NO: 137921 - DNA, 22 bp, Artificial Sequence
  chemically synthesized
gcacccttcccacacagccatc

SEQ ID NO: 137922 - DNA, 22 bp, Artificial Sequence
  chemically synthesized
cccacacagccatcccaataac

SEQ ID NO: 137923 - DNA, 22 bp, Artificial Sequence
  chemically synthesized
ccacacagccatcccaataact

SEQ ID NO: 137924 - DNA, 22 bp, Artificial Sequence
  chemically synthesized
atttcagtgactcaacccttga

SEQ ID NO: 137925 - DNA, 22 bp, Artificial Sequence
  chemically synthesized
cagtgactcaacccttgacttt

SEQ ID NO: 137926 - DNA, 22 bp, Artificial Sequence
  chemically synthesized
agtgactcaacccttgacttta

SEQ ID NO: 137927 - DNA, 22 bp, Artificial Sequence
  chemically synthesized
aacccttgactttataaaagtc

SEQ ID NO: 137928 - DNA, 22 bp, Artificial Sequence
  chemically synthesized
gactttataaaagtcttgggca

SEQ ID NO: 137929 - DNA, 22 bp, Artificial Sequence
  chemically synthesized
actttataaaagtcttgggcag

SEQ ID NO: 137930 - DNA, 22 bp, Artificial Sequence
  chemically synthesized
tataaaagtcttgggcagtata

SEQ ID NO: 137931 - DNA, 22 bp, Artificial Sequence
  chemically synthesized
ataaaagtcttgggcagtatag

SEQ ID NO: 137932 - DNA, 22 bp, Artificial Sequence
  chemically synthesized
taaaagtcttgggcagtataga

SEQ ID NO: 137933 - DNA, 22 bp, Artificial Sequence
  chemically synthesized
gggcagtatagagcagagatta

SEQ ID NO: 137934 - DNA, 22 bp, Artificial Sequence
  chemically synthesized
ggcagtatagagcagagattaa

SEQ ID NO: 137935 - DNA, 22 bp, Artificial Sequence
  chemically synthesized
agagtacagatgctggagccag

SEQ ID NO: 137936 - DNA, 22 bp, Artificial Sequence
  chemically synthesized
gagccagaccacctgagtgatt

SEQ ID NO: 137937 - DNA, 22 bp, Artificial Sequence
  chemically synthesized
agtgattagtgactcagtttct

SEQ ID NO: 137938 - DNA, 22 bp, Artificial Sequence
  chemically synthesized
gtgactcagtttctcttagtag

SEQ ID NO: 137939 - DNA, 22 bp, Artificial Sequence
  chemically synthesized
agtttctcttagtagttgtatg

SEQ ID NO: 137940 - DNA, 22 bp, Artificial Sequence
  chemically synthesized
ctcttagtagttgtatgactca

SEQ ID NO: 137941 - DNA, 22 bp, Artificial Sequence
  chemically synthesized
tcttagtagttgtatgactcag

SEQ ID NO: 137942 - DNA, 22 bp, Artificial Sequence
  chemically synthesized
ttagtagttgtatgactcagtt

SEQ ID NO: 137943 - DNA, 22 bp, Artificial Sequence
  chemically synthesized
agtagttgtatgactcagtttc

SEQ ID NO: 137944 - DNA, 22 bp, Artificial Sequence
  chemically synthesized
gtagttgtatgactcagtttct

SEQ ID NO: 137945 - DNA, 22 bp, Artificial Sequence
  chemically synthesized
tatgactcagtttcttcatctg

SEQ ID NO: 137946 - DNA, 22 bp, Artificial Sequence
  chemically synthesized
agtttcttcatctgtaaaatgg

SEQ ID NO: 137947 - DNA, 22 bp, Artificial Sequence
  chemically synthesized
cttcatctgtaaaatggagggt

SEQ ID NO: 137948 - DNA, 22 bp, Artificial Sequence
  chemically synthesized
ttcatctgtaaaatggagggtt

SEQ ID NO: 137949 - DNA, 22 bp, Artificial Sequence
  chemically synthesized
catctgtaaaatggagggtttt

SEQ ID NO: 137950 - DNA, 22 bp, Artificial Sequence
  chemically synthesized
atctgtaaaatggagggttttt

SEQ ID NO: 137951 - DNA, 22 bp, Artificial Sequence
  chemically synthesized
taaaatggagggttttttaatt

SEQ ID NO: 137952 - DNA, 22 bp, Artificial Sequence
  chemically synthesized
tttaattagtttgtttttgaga

SEQ ID NO: 137953 - DNA, 22 bp, Artificial Sequence
  chemically synthesized
ttaattagtttgtttttgagaa

SEQ ID NO: 137954 - DNA, 22 bp, Artificial Sequence
  chemically synthesized
taattagtttgtttttgagaaa

SEQ ID NO: 137955 - DNA, 22 bp, Artificial Sequence
  chemically synthesized
aattagtttgtttttgagaaag

SEQ ID NO: 137956 - DNA, 22 bp, Artificial Sequence
  chemically synthesized
attagtttgtttttgagaaagg

SEQ ID NO: 137957 - DNA, 22 bp, Artificial Sequence
  chemically synthesized
gtttgtttttgagaaagggtct

SEQ ID NO: 137958 - DNA, 22 bp, Artificial Sequence
  chemically synthesized
gtttttgagaaagggtctcact

SEQ ID NO: 137959 - DNA, 22 bp, Artificial Sequence
  chemically synthesized
tttttgagaaagggtctcactc

SEQ ID NO: 137960 - DNA, 22 bp, Artificial Sequence
  chemically synthesized
ttgagaaagggtctcactctgt

SEQ ID NO: 137961 - DNA, 22 bp, Artificial Sequence
  chemically synthesized
tgagaaagggtctcactctgtc

SEQ ID NO: 137962 - DNA, 22 bp, Artificial Sequence
  chemically synthesized
gagaaagggtctcactctgtca

SEQ ID NO: 137963 - DNA, 22 bp, Artificial Sequence
  chemically synthesized
agaaagggtctcactctgtcac

SEQ ID NO: 137964 - DNA, 22 bp, Artificial Sequence
  chemically synthesized
actctgtcacccaaatgggagt

SEQ ID NO: 137965 - DNA, 22 bp, Artificial Sequence
  chemically synthesized
tgtcacccaaatgggagtgtag

SEQ ID NO: 137966 - DNA, 22 bp, Artificial Sequence
  chemically synthesized
tcacccaaatgggagtgtagtg

SEQ ID NO: 137967 - DNA, 22 bp, Artificial Sequence
  chemically synthesized
ggctcactgcaacttgcacttc

SEQ ID NO: 137968 - DNA, 22 bp, Artificial Sequence
  chemically synthesized
actgcaacttgcacttcccagg

SEQ ID NO: 137969 - DNA, 22 bp, Artificial Sequence
  chemically synthesized
caacttgcacttcccaggctca

SEQ ID NO: 137970 - DNA, 22 bp, Artificial Sequence
  chemically synthesized
gcacttcccaggctcaagcggt

SEQ ID NO: 137971 - DNA, 22 bp, Artificial Sequence
  chemically synthesized
cacttcccaggctcaagcggtc

SEQ ID NO: 137972 - DNA, 22 bp, Artificial Sequence
  chemically synthesized
cccaggctcaagcggtcctccc

SEQ ID NO: 137973 - DNA, 22 bp, Artificial Sequence
  chemically synthesized
ccaggctcaagcggtcctccca

SEQ ID NO: 137974 - DNA, 22 bp, Artificial Sequence
  chemically synthesized
aagcggtcctcccacctcaaca

SEQ ID NO: 137975 - DNA, 22 bp, Artificial Sequence
  chemically synthesized
ccacctcaacatcctgagtagc

SEQ ID NO: 137976 - DNA, 22 bp, Artificial Sequence
  chemically synthesized
aacatcctgagtagctggaacc

SEQ ID NO: 137977 - DNA, 22 bp, Artificial Sequence
  chemically synthesized
agtagctggaaccacaggtaca

SEQ ID NO: 137978 - DNA, 22 bp, Artificial Sequence
  chemically synthesized
gaaccacaggtacacaccacca

SEQ ID NO: 137979 - DNA, 22 bp, Artificial Sequence
  chemically synthesized
gctaattttttgtatttttggt

SEQ ID NO: 137980 - DNA, 22 bp, Artificial Sequence
  chemically synthesized
attttttgtatttttggtagag

SEQ ID NO: 137981 - DNA, 22 bp, Artificial Sequence
  chemically synthesized
tttgtatttttggtagagatgg

SEQ ID NO: 137982 - DNA, 22 bp, Artificial Sequence
  chemically synthesized
ttgtatttttggtagagatggg

SEQ ID NO: 137983 - DNA, 22 bp, Artificial Sequence
  chemically synthesized
tgtatttttggtagagatgggg

SEQ ID NO: 137984 - DNA, 22 bp, Artificial Sequence
  chemically synthesized
gtatttttggtagagatggggt

SEQ ID NO: 137985 - DNA, 22 bp, Artificial Sequence
  chemically synthesized
tatttttggtagagatggggtt

SEQ ID NO: 137986 - DNA, 22 bp, Artificial Sequence
  chemically synthesized
ttggtagagatggggtttcaca

SEQ ID NO: 137987 - DNA, 22 bp, Artificial Sequence
  chemically synthesized
tggtagagatggggtttcacat

SEQ ID NO: 137988 - DNA, 22 bp, Artificial Sequence
  chemically synthesized
ggtagagatggggtttcacatg

SEQ ID NO: 137989 - DNA, 22 bp, Artificial Sequence
  chemically synthesized
gtagagatggggtttcacatgt

SEQ ID NO: 137990 - DNA, 22 bp, Artificial Sequence
  chemically synthesized
cacatgttacacaggatggtct

SEQ ID NO: 137991 - DNA, 22 bp, Artificial Sequence
  chemically synthesized
acatgttacacaggatggtctc

SEQ ID NO: 137992 - DNA, 22 bp, Artificial Sequence
  chemically synthesized
cacaggatggtctcagactccg

SEQ ID NO: 137993 - DNA, 22 bp, Artificial Sequence
  chemically synthesized
agactccggagctcaagcaatc

SEQ ID NO: 137994 - DNA, 22 bp, Artificial Sequence
  chemically synthesized
cggagctcaagcaatctgccca

SEQ ID NO: 137995 - DNA, 22 bp, Artificial Sequence
  chemically synthesized
aagcaatctgcccacctcagcc

SEQ ID NO: 137996 - DNA, 22 bp, Artificial Sequence
  chemically synthesized
cccacctcagccttccaaagtg

SEQ ID NO: 137997 - DNA, 22 bp, Artificial Sequence
  chemically synthesized
agccttccaaagtgctgggatt

SEQ ID NO: 137998 - DNA, 22 bp, Artificial Sequence
  chemically synthesized
ccaaagtgctgggattataagc

SEQ ID NO: 137999 - DNA, 22 bp, Artificial Sequence
  chemically synthesized
caaagtgctgggattataagca

SEQ ID NO: 138000 - DNA, 22 bp, Artificial Sequence
  chemically synthesized
ggattataagcatgattacagg

SEQ ID NO: 138001 - DNA, 22 bp, Artificial Sequence
  chemically synthesized
taagcatgattacaggagtttt

SEQ ID NO: 138002 - DNA, 22 bp, Artificial Sequence
  chemically synthesized
caggagttttaacaggctcata

SEQ ID NO: 138003 - DNA, 22 bp, Artificial Sequence
  chemically synthesized
taacaggctcataagattgttc

SEQ ID NO: 138004 - DNA, 22 bp, Artificial Sequence
  chemically synthesized
aacaggctcataagattgttct

SEQ ID NO: 138005 - DNA, 22 bp, Artificial Sequence
  chemically synthesized
acaggctcataagattgttctg

SEQ ID NO: 138006 - DNA, 22 bp, Artificial Sequence
  chemically synthesized
ataagattgttctgcagcccga

SEQ ID NO: 138007 - DNA, 22 bp, Artificial Sequence
  chemically synthesized
ttctgcagcccgagtgagttaa

SEQ ID NO: 138008 - DNA, 22 bp, Artificial Sequence
  chemically synthesized
tgcagcccgagtgagttaatac

SEQ ID NO: 138009 - DNA, 22 bp, Artificial Sequence
  chemically synthesized
cagcccgagtgagttaatacat

SEQ ID NO: 138010 - DNA, 22 bp, Artificial Sequence
  chemically synthesized
atacatgcaaagagtttaaagc

SEQ ID NO: 138011 - DNA, 22 bp, Artificial Sequence
  chemically synthesized
aaagcagtgacttataaatgct

SEQ ID NO: 138012 - DNA, 22 bp, Artificial Sequence
  chemically synthesized
aagcagtgacttataaatgcta

SEQ ID NO: 138013 - DNA, 22 bp, Artificial Sequence
  chemically synthesized
ataaatgctaactactctagaa

SEQ ID NO: 138014 - DNA, 22 bp, Artificial Sequence
  chemically synthesized
taaatgctaactactctagaaa

SEQ ID NO: 138015 - DNA, 22 bp, Artificial Sequence
  chemically synthesized
actactctagaaatgtttgcta

SEQ ID NO: 138016 - DNA, 22 bp, Artificial Sequence
  chemically synthesized
ctctagaaatgtttgctagtat

SEQ ID NO: 138017 - DNA, 22 bp, Artificial Sequence
  chemically synthesized
tagaaatgtttgctagtatttt

SEQ ID NO: 138018 - DNA, 22 bp, Artificial Sequence
  chemically synthesized
gaaatgtttgctagtatttttt

SEQ ID NO: 138019 - DNA, 22 bp, Artificial Sequence
  chemically synthesized
gctagtattttttgtttaactg

SEQ ID NO: 138020 - DNA, 22 bp, Artificial Sequence
  chemically synthesized
ctagtattttttgtttaactgc

SEQ ID NO: 138021 - DNA, 22 bp, Artificial Sequence
  chemically synthesized
gtattttttgtttaactgcaat

SEQ ID NO: 138022 - DNA, 22 bp, Artificial Sequence
  chemically synthesized
tttgtttaactgcaatcattct

SEQ ID NO: 138023 - DNA, 22 bp, Artificial Sequence
  chemically synthesized
ttgtttaactgcaatcattctt

SEQ ID NO: 138024 - DNA, 22 bp, Artificial Sequence
  chemically synthesized
tgtttaactgcaatcattcttg

SEQ ID NO: 138025 - DNA, 22 bp, Artificial Sequence
  chemically synthesized
gtttaactgcaatcattcttgc

SEQ ID NO: 138026 - DNA, 22 bp, Artificial Sequence
  chemically synthesized
tttaactgcaatcattcttgct

SEQ ID NO: 138027 - DNA, 22 bp, Artificial Sequence
  chemically synthesized
aactgcaatcattcttgctgca

SEQ ID NO: 138028 - DNA, 22 bp, Artificial Sequence
  chemically synthesized
actgcaatcattcttgctgcag

SEQ ID NO: 138029 - DNA, 22 bp, Artificial Sequence
  chemically synthesized
caatcattcttgctgcaggtga

SEQ ID NO: 138030 - DNA, 22 bp, Artificial Sequence
  chemically synthesized
ttgctgcaggtgaaaactagtg

SEQ ID NO: 138031 - DNA, 22 bp, Artificial Sequence
  chemically synthesized
gctgcaggtgaaaactagtgtt

SEQ ID NO: 138032 - DNA, 22 bp, Artificial Sequence
  chemically synthesized
ctgcaggtgaaaactagtgttc

SEQ ID NO: 138033 - DNA, 22 bp, Artificial Sequence
  chemically synthesized
caggtgaaaactagtgttctgt

SEQ ID NO: 138034 - DNA, 22 bp, Artificial Sequence
  chemically synthesized
gtgttctgtactttatgcccat

SEQ ID NO: 138035 - DNA, 22 bp, Artificial Sequence
  chemically synthesized
tgtactttatgcccattcatct

SEQ ID NO: 138036 - DNA, 22 bp, Artificial Sequence
  chemically synthesized
tactttatgcccattcatcttt

SEQ ID NO: 138037 - DNA, 22 bp, Artificial Sequence
  chemically synthesized
tatgcccattcatctttaactg

SEQ ID NO: 138038 - DNA, 22 bp, Artificial Sequence
  chemically synthesized
atgcccattcatctttaactgt

SEQ ID NO: 138039 - DNA, 22 bp, Artificial Sequence
  chemically synthesized
tgcccattcatctttaactgta

SEQ ID NO: 138040 - DNA, 22 bp, Artificial Sequence
  chemically synthesized
atctttaactgtaataataaaa

SEQ ID NO: 138041 - DNA, 22 bp, Artificial Sequence
  chemically synthesized
taactgtaataataaaaataac

SEQ ID NO: 138042 - DNA, 22 bp, Artificial Sequence
  chemically synthesized
aactgtaataataaaaataact

SEQ ID NO: 138043 - DNA, 22 bp, Artificial Sequence
  chemically synthesized
actgtaataataaaaataactg

SEQ ID NO: 138044 - DNA, 22 bp, Artificial Sequence
  chemically synthesized
taataataaaaataactgacat

SEQ ID NO: 138045 - DNA, 22 bp, Artificial Sequence
  chemically synthesized
acatttattgaaggctatcaga

SEQ ID NO: 138046 - DNA, 22 bp, Artificial Sequence
  chemically synthesized
attgaaggctatcagagactgt

SEQ ID NO: 138047 - DNA, 22 bp, Artificial Sequence
  chemically synthesized
ttgaaggctatcagagactgta

SEQ ID NO: 138048 - DNA, 22 bp, Artificial Sequence
  chemically synthesized
aaggctatcagagactgtaatt

SEQ ID NO: 138049 - DNA, 22 bp, Artificial Sequence
  chemically synthesized
tcagagactgtaattagtgctt

SEQ ID NO: 138050 - DNA, 22 bp, Artificial Sequence
  chemically synthesized
taattagtgctttgcataatta

SEQ ID NO: 138051 - DNA, 22 bp, Artificial Sequence
  chemically synthesized
gtgctttgcataattaatcata

SEQ ID NO: 138052 - DNA, 22 bp, Artificial Sequence
  chemically synthesized
tgcataattaatcatatttaat

SEQ ID NO: 138053 - DNA, 22 bp, Artificial Sequence
  chemically synthesized
gcataattaatcatatttaata

SEQ ID NO: 138054 - DNA, 22 bp, Artificial Sequence
  chemically synthesized
cataattaatcatatttaatac

SEQ ID NO: 138055 - DNA, 22 bp, Artificial Sequence
  chemically synthesized
atcatatttaatactcttggat

SEQ ID NO: 138056 - DNA, 22 bp, Artificial Sequence
  chemically synthesized
aatactcttggattctttcagg

SEQ ID NO: 138057 - DNA, 22 bp, Artificial Sequence
  chemically synthesized
atactcttggattctttcaggt

SEQ ID NO: 138058 - DNA, 22 bp, Artificial Sequence
  chemically synthesized
ttggattctttcaggtagatac

SEQ ID NO: 138059 - DNA, 22 bp, Artificial Sequence
  chemically synthesized
ggattctttcaggtagatacta

SEQ ID NO: 138060 - DNA, 22 bp, Artificial Sequence
  chemically synthesized
gattctttcaggtagatactat

SEQ ID NO: 138061 - DNA, 22 bp, Artificial Sequence
  chemically synthesized
tttcaggtagatactattatta

SEQ ID NO: 138062 - DNA, 22 bp, Artificial Sequence
  chemically synthesized
tcaggtagatactattattatc

SEQ ID NO: 138063 - DNA, 22 bp, Artificial Sequence
  chemically synthesized
caggtagatactattattatcc

SEQ ID NO: 138064 - DNA, 22 bp, Artificial Sequence
  chemically synthesized
aggtagatactattattatccc

SEQ ID NO: 138065 - DNA, 22 bp, Artificial Sequence
  chemically synthesized
ttattatccccattttactaca

SEQ ID NO: 138066 - DNA, 22 bp, Artificial Sequence
  chemically synthesized
ttatccccattttactacagtt

SEQ ID NO: 138067 - DNA, 22 bp, Artificial Sequence
  chemically synthesized
tccccattttactacagttaaa

SEQ ID NO: 138068 - DNA, 22 bp, Artificial Sequence
  chemically synthesized
tactacagttaaaaaaactacc

SEQ ID NO: 138069 - DNA, 22 bp, Artificial Sequence
  chemically synthesized
actacagttaaaaaaactacct

SEQ ID NO: 138070 - DNA, 22 bp, Artificial Sequence
  chemically synthesized
ctacagttaaaaaaactacctc

SEQ ID NO: 138071 - DNA, 22 bp, Artificial Sequence
  chemically synthesized
cagttaaaaaaactacctctca

SEQ ID NO: 138072 - DNA, 22 bp, Artificial Sequence
  chemically synthesized
aaaaaactacctctcaacttgc

SEQ ID NO: 138073 - DNA, 22 bp, Artificial Sequence
  chemically synthesized
cctctcaacttgctcaagcata

SEQ ID NO: 138074 - DNA, 22 bp, Artificial Sequence
  chemically synthesized
tcaacttgctcaagcatacact

SEQ ID NO: 138075 - DNA, 22 bp, Artificial Sequence
  chemically synthesized
aacttgctcaagcatacactct

SEQ ID NO: 138076 - DNA, 22 bp, Artificial Sequence
  chemically synthesized
gctcaagcatacactctcacac

SEQ ID NO: 138077 - DNA, 22 bp, Artificial Sequence
  chemically synthesized
ctcaagcatacactctcacaca

SEQ ID NO: 138078 - DNA, 22 bp, Artificial Sequence
  chemically synthesized
aagcatacactctcacacacac

SEQ ID NO: 138079 - DNA, 22 bp, Artificial Sequence
  chemically synthesized
tcacacacacaaacataaacta

SEQ ID NO: 138080 - DNA, 22 bp, Artificial Sequence
  chemically synthesized
acacacacaaacataaactact

SEQ ID NO: 138081 - DNA, 22 bp, Artificial Sequence
  chemically synthesized
ctagcaaatagtagaattgaga

SEQ ID NO: 138082 - DNA, 22 bp, Artificial Sequence
  chemically synthesized
gcaaatagtagaattgagattt

SEQ ID NO: 138083 - DNA, 22 bp, Artificial Sequence
  chemically synthesized
agatttggtcctaattatgtct

SEQ ID NO: 138084 - DNA, 22 bp, Artificial Sequence
  chemically synthesized
ggtcctaattatgtctttgctc

SEQ ID NO: 138085 - DNA, 22 bp, Artificial Sequence
  chemically synthesized
gtcctaattatgtctttgctca

SEQ ID NO: 138086 - DNA, 22 bp, Artificial Sequence
  chemically synthesized
attatgtctttgctcactatcc

SEQ ID NO: 138087 - DNA, 22 bp, Artificial Sequence
  chemically synthesized
tgtctttgctcactatccaata

SEQ ID NO: 138088 - DNA, 22 bp, Artificial Sequence
  chemically synthesized
tgctcactatccaataaatatt

SEQ ID NO: 138089 - DNA, 22 bp, Artificial Sequence
  chemically synthesized
gctcactatccaataaatattt

SEQ ID NO: 138090 - DNA, 22 bp, Artificial Sequence
  chemically synthesized
ctcactatccaataaatattta

SEQ ID NO: 138091 - DNA, 22 bp, Artificial Sequence
  chemically synthesized
actatccaataaatatttattg

SEQ ID NO: 138092 - DNA, 22 bp, Artificial Sequence
  chemically synthesized
tccaataaatatttattgacat

SEQ ID NO: 138093 - DNA, 22 bp, Artificial Sequence
  chemically synthesized
attgacatgtacttcttggcag

SEQ ID NO: 138094 - DNA, 22 bp, Artificial Sequence
  chemically synthesized
ttgacatgtacttcttggcagt

SEQ ID NO: 138095 - DNA, 22 bp, Artificial Sequence
  chemically synthesized
acatgtacttcttggcagtctg

SEQ ID NO: 138096 - DNA, 22 bp, Artificial Sequence
  chemically synthesized
cttggcagtctgtatgctggat

SEQ ID NO: 138097 - DNA, 22 bp, Artificial Sequence
  chemically synthesized
ttggcagtctgtatgctggatg

SEQ ID NO: 138098 - DNA, 22 bp, Artificial Sequence
  chemically synthesized
ggcagtctgtatgctggatgct

SEQ ID NO: 138099 - DNA, 22 bp, Artificial Sequence
  chemically synthesized
gcagtctgtatgctggatgctg

SEQ ID NO: 138100 - DNA, 22 bp, Artificial Sequence
  chemically synthesized
tatgctggatgctggggataca

SEQ ID NO: 138101 - DNA, 22 bp, Artificial Sequence
  chemically synthesized
gatgctggggatacaaagatgt

SEQ ID NO: 138102 - DNA, 22 bp, Artificial Sequence
  chemically synthesized
gggatacaaagatgtttaaatt

SEQ ID NO: 138103 - DNA, 22 bp, Artificial Sequence
  chemically synthesized
aaatttaagctccagtctctgc

SEQ ID NO: 138104 - DNA, 22 bp, Artificial Sequence
  chemically synthesized
aatttaagctccagtctctgct

SEQ ID NO: 138105 - DNA, 22 bp, Artificial Sequence
  chemically synthesized
aagctccagtctctgcttccaa

SEQ ID NO: 138106 - DNA, 22 bp, Artificial Sequence
  chemically synthesized
agctccagtctctgcttccaaa

SEQ ID NO: 138107 - DNA, 22 bp, Artificial Sequence
  chemically synthesized
cagtctctgcttccaaaggcct

SEQ ID NO: 138108 - DNA, 22 bp, Artificial Sequence
  chemically synthesized
tgcttccaaaggcctcccaggc

SEQ ID NO: 138109 - DNA, 22 bp, Artificial Sequence
  chemically synthesized
cttccaaaggcctcccaggcca

SEQ ID NO: 138110 - DNA, 22 bp, Artificial Sequence
  chemically synthesized
ccaaaggcctcccaggccaagt

SEQ ID NO: 138111 - DNA, 22 bp, Artificial Sequence
  chemically synthesized
caaaggcctcccaggccaagtt

SEQ ID NO: 138112 - DNA, 22 bp, Artificial Sequence
  chemically synthesized
ccaggccaagttatccattcag

SEQ ID NO: 138113 - DNA, 22 bp, Artificial Sequence
  chemically synthesized
tccattcagaaagcatttttta

SEQ ID NO: 138114 - DNA, 22 bp, Artificial Sequence
  chemically synthesized
agaaagcattttttactctttg

SEQ ID NO: 138115 - DNA, 22 bp, Artificial Sequence
  chemically synthesized
tttactctttgcattccactgt

SEQ ID NO: 138116 - DNA, 22 bp, Artificial Sequence
  chemically synthesized
ttactctttgcattccactgtt

SEQ ID NO: 138117 - DNA, 22 bp, Artificial Sequence
  chemically synthesized
tactctttgcattccactgttt

SEQ ID NO: 138118 - DNA, 22 bp, Artificial Sequence
  chemically synthesized
actctttgcattccactgtttt

SEQ ID NO: 138119 - DNA, 22 bp, Artificial Sequence
  chemically synthesized
ctctttgcattccactgttttt

SEQ ID NO: 138120 - DNA, 22 bp, Artificial Sequence
  chemically synthesized
tttgcattccactgtttttcct

SEQ ID NO: 138121 - DNA, 22 bp, Artificial Sequence
  chemically synthesized
tgcattccactgtttttcctaa

SEQ ID NO: 138122 - DNA, 22 bp, Artificial Sequence
  chemically synthesized
gcattccactgtttttcctaag

SEQ ID NO: 138123 - DNA, 22 bp, Artificial Sequence
  chemically synthesized
cattccactgtttttcctaagt

SEQ ID NO: 138124 - DNA, 22 bp, Artificial Sequence
  chemically synthesized
cactgtttttcctaagtgacta

SEQ ID NO: 138125 - DNA, 22 bp, Artificial Sequence
  chemically synthesized
tttttcctaagtgactaaaaaa

SEQ ID NO: 138126 - DNA, 22 bp, Artificial Sequence
  chemically synthesized
ttcctaagtgactaaaaaatta

SEQ ID NO: 138127 - DNA, 22 bp, Artificial Sequence
  chemically synthesized
tcctaagtgactaaaaaattac

SEQ ID NO: 138128 - DNA, 22 bp, Artificial Sequence
  chemically synthesized
cctaagtgactaaaaaattaca

SEQ ID NO: 138129 - DNA, 22 bp, Artificial Sequence
  chemically synthesized
ctaagtgactaaaaaattacac

SEQ ID NO: 138130 - DNA, 22 bp, Artificial Sequence
  chemically synthesized
agtgactaaaaaattacacttt

SEQ ID NO: 138131 - DNA, 22 bp, Artificial Sequence
  chemically synthesized
aaaaattacactttattcgtct

SEQ ID NO: 138132 - DNA, 22 bp, Artificial Sequence
  chemically synthesized
cactttattcgtctgtgtcctg

SEQ ID NO: 138133 - DNA, 22 bp, Artificial Sequence
  chemically synthesized
tattcgtctgtgtcctgctctg

SEQ ID NO: 138134 - DNA, 22 bp, Artificial Sequence
  chemically synthesized
attcgtctgtgtcctgctctgg

SEQ ID NO: 138135 - DNA, 22 bp, Artificial Sequence
  chemically synthesized
ttcgtctgtgtcctgctctggg

SEQ ID NO: 138136 - DNA, 22 bp, Artificial Sequence
  chemically synthesized
gtctgtgtcctgctctgggatg

SEQ ID NO: 138137 - DNA, 22 bp, Artificial Sequence
  chemically synthesized
tgtcctgctctgggatgatagt

SEQ ID NO: 138138 - DNA, 22 bp, Artificial Sequence
  chemically synthesized
ctctgggatgatagtctgactt

SEQ ID NO: 138139 - DNA, 22 bp, Artificial Sequence
  chemically synthesized
tgggatgatagtctgactttcc

SEQ ID NO: 138140 - DNA, 22 bp, Artificial Sequence
  chemically synthesized
ggatgatagtctgactttccta

SEQ ID NO: 138141 - DNA, 22 bp, Artificial Sequence
  chemically synthesized
actttcctaacctgagcctaac

SEQ ID NO: 138142 - DNA, 22 bp, Artificial Sequence
  chemically synthesized
tcctaacctgagcctaacatcc

SEQ ID NO: 138143 - DNA, 22 bp, Artificial Sequence
  chemically synthesized
cctaacctgagcctaacatccc

SEQ ID NO: 138144 - DNA, 22 bp, Artificial Sequence
  chemically synthesized
ctaacctgagcctaacatccct

SEQ ID NO: 138145 - DNA, 22 bp, Artificial Sequence
  chemically synthesized
acctgagcctaacatccctgac

SEQ ID NO: 138146 - DNA, 22 bp, Artificial Sequence
  chemically synthesized
agcctaacatccctgacatcag

SEQ ID NO: 138147 - DNA, 22 bp, Artificial Sequence
  chemically synthesized
acatccctgacatcaggaaaga

SEQ ID NO: 138148 - DNA, 22 bp, Artificial Sequence
  chemically synthesized
acatcaggaaagactacaccat

SEQ ID NO: 138149 - DNA, 22 bp, Artificial Sequence
  chemically synthesized
caccatgtggagaaggggtggt

SEQ ID NO: 138150 - DNA, 22 bp, Artificial Sequence
  chemically synthesized
tgattgctgctgtcttcagtta

SEQ ID NO: 138151 - DNA, 22 bp, Artificial Sequence
  chemically synthesized
gattgctgctgtcttcagttag

SEQ ID NO: 138152 - DNA, 22 bp, Artificial Sequence
  chemically synthesized
attgctgctgtcttcagttaga

SEQ ID NO: 138153 - DNA, 22 bp, Artificial Sequence
  chemically synthesized
ctgctgtcttcagttagatggt

SEQ ID NO: 138154 - DNA, 22 bp, Artificial Sequence
  chemically synthesized
ctgtcttcagttagatggttaa

SEQ ID NO: 138155 - DNA, 22 bp, Artificial Sequence
  chemically synthesized
tcttcagttagatggttaactt

SEQ ID NO: 138156 - DNA, 22 bp, Artificial Sequence
  chemically synthesized
cagttagatggttaactttgtg

SEQ ID NO: 138157 - DNA, 22 bp, Artificial Sequence
  chemically synthesized
agttagatggttaactttgtga

SEQ ID NO: 138158 - DNA, 22 bp, Artificial Sequence
  chemically synthesized
gatggttaactttgtgaagttg

SEQ ID NO: 138159 - DNA, 22 bp, Artificial Sequence
  chemically synthesized
actttgtgaagttgaaaactgt

SEQ ID NO: 138160 - DNA, 22 bp, Artificial Sequence
  chemically synthesized
tgtgaagttgaaaactgtggct

SEQ ID NO: 138161 - DNA, 22 bp, Artificial Sequence
  chemically synthesized
gtgaagttgaaaactgtggctc

SEQ ID NO: 138162 - DNA, 22 bp, Artificial Sequence
  chemically synthesized
tgaagttgaaaactgtggctct

SEQ ID NO: 138163 - DNA, 22 bp, Artificial Sequence
  chemically synthesized
aaaactgtggctctctggttga

SEQ ID NO: 138164 - DNA, 22 bp, Artificial Sequence
  chemically synthesized
tggctctctggttgactgttag

SEQ ID NO: 138165 - DNA, 22 bp, Artificial Sequence
  chemically synthesized
tctggttgactgttagagttct

SEQ ID NO: 138166 - DNA, 22 bp, Artificial Sequence
  chemically synthesized
tggttgactgttagagttctgg

SEQ ID NO: 138167 - DNA, 22 bp, Artificial Sequence
  chemically synthesized
gttgactgttagagttctggca

SEQ ID NO: 138168 - DNA, 22 bp, Artificial Sequence
  chemically synthesized
actgttagagttctggcacttg

SEQ ID NO: 138169 - DNA, 22 bp, Artificial Sequence
  chemically synthesized
ttagagttctggcacttgtcac

SEQ ID NO: 138170 - DNA, 22 bp, Artificial Sequence
  chemically synthesized
gagttctggcacttgtcactat

SEQ ID NO: 138171 - DNA, 22 bp, Artificial Sequence
  chemically synthesized
tggcacttgtcactatgcctat

SEQ ID NO: 138172 - DNA, 22 bp, Artificial Sequence
  chemically synthesized
gcacttgtcactatgcctatta

SEQ ID NO: 138173 - DNA, 22 bp, Artificial Sequence
  chemically synthesized
gtcactatgcctattatttaac

SEQ ID NO: 138174 - DNA, 22 bp, Artificial Sequence
  chemically synthesized
tcactatgcctattatttaaca

SEQ ID NO: 138175 - DNA, 22 bp, Artificial Sequence
  chemically synthesized
tgcctattatttaacaaatgca

SEQ ID NO: 138176 - DNA, 22 bp, Artificial Sequence
  chemically synthesized
ttatttaacaaatgcatgaatg

SEQ ID NO: 138177 - DNA, 22 bp, Artificial Sequence
  chemically synthesized
tttaacaaatgcatgaatgctt

SEQ ID NO: 138178 - DNA, 22 bp, Artificial Sequence
  chemically synthesized
aacaaatgcatgaatgcttcag

SEQ ID NO: 138179 - DNA, 22 bp, Artificial Sequence
  chemically synthesized
acaaatgcatgaatgcttcaga

SEQ ID NO: 138180 - DNA, 22 bp, Artificial Sequence
  chemically synthesized
cagaatatgggaatattatctt

SEQ ID NO: 138181 - DNA, 22 bp, Artificial Sequence
  chemically synthesized
agaatatgggaatattatcttc

SEQ ID NO: 138182 - DNA, 22 bp, Artificial Sequence
  chemically synthesized
tcttctggaatagggaatcaag

SEQ ID NO: 138183 - DNA, 22 bp, Artificial Sequence
  chemically synthesized
ctggaatagggaatcaagttat

SEQ ID NO: 138184 - DNA, 22 bp, Artificial Sequence
  chemically synthesized
tggaatagggaatcaagttata

SEQ ID NO: 138185 - DNA, 22 bp, Artificial Sequence
  chemically synthesized
gaatagggaatcaagttatatt

SEQ ID NO: 138186 - DNA, 22 bp, Artificial Sequence
  chemically synthesized
tattatgtaacccaggattaga

SEQ ID NO: 138187 - DNA, 22 bp, Artificial Sequence
  chemically synthesized
tgtaacccaggattagaagatt

SEQ ID NO: 138188 - DNA, 22 bp, Artificial Sequence
  chemically synthesized
gaagattcttctgtgtgtaaga

SEQ ID NO: 138189 - DNA, 22 bp, Artificial Sequence
  chemically synthesized
ttctgtgtgtaagaatttcata

SEQ ID NO: 138190 - DNA, 22 bp, Artificial Sequence
  chemically synthesized
ctgtgtgtaagaatttcataaa

SEQ ID NO: 138191 - DNA, 22 bp, Artificial Sequence
  chemically synthesized
tgtgtgtaagaatttcataaac

SEQ ID NO: 138192 - DNA, 22 bp, Artificial Sequence
  chemically synthesized
tgtgtaagaatttcataaacat

SEQ ID NO: 138193 - DNA, 22 bp, Artificial Sequence
  chemically synthesized
cataaacattaagctgtctagc

SEQ ID NO: 138194 - DNA, 22 bp, Artificial Sequence
  chemically synthesized
ataaacattaagctgtctagca

SEQ ID NO: 138195 - DNA, 22 bp, Artificial Sequence
  chemically synthesized
agctgtctagcaaaagcaaggg

SEQ ID NO: 138196 - DNA, 22 bp, Artificial Sequence
  chemically synthesized
tctagcaaaagcaagggcttgg

SEQ ID NO: 138197 - DNA, 22 bp, Artificial Sequence
  chemically synthesized
gcaaaagcaagggcttggaaaa

SEQ ID NO: 138198 - DNA, 22 bp, Artificial Sequence
  chemically synthesized
ggaaaatctgtgagctcctcac

SEQ ID NO: 138199 - DNA, 22 bp, Artificial Sequence
  chemically synthesized
gaaaatctgtgagctcctcacc

SEQ ID NO: 138200 - DNA, 22 bp, Artificial Sequence
  chemically synthesized
tgagctcctcaccatatagaaa

SEQ ID NO: 138201 - DNA, 22 bp, Artificial Sequence
  chemically synthesized
ctcaccatatagaaagctttta

SEQ ID NO: 138202 - DNA, 22 bp, Artificial Sequence
  chemically synthesized
accatatagaaagcttttaacc

SEQ ID NO: 138203 - DNA, 22 bp, Artificial Sequence
  chemically synthesized
ttaacccatcattgaataaatc

SEQ ID NO: 138204 - DNA, 22 bp, Artificial Sequence
  chemically synthesized
taacccatcattgaataaatcc

SEQ ID NO: 138205 - DNA, 22 bp, Artificial Sequence
  chemically synthesized
aacccatcattgaataaatccc

SEQ ID NO: 138206 - DNA, 22 bp, Artificial Sequence
  chemically synthesized
acccatcattgaataaatccct

SEQ ID NO: 138207 - DNA, 22 bp, Artificial Sequence
  chemically synthesized
aataaatccctataggggattt

SEQ ID NO: 138208 - DNA, 22 bp, Artificial Sequence
  chemically synthesized
taggggatttctaccctgagca

SEQ ID NO: 138209 - DNA, 22 bp, Artificial Sequence
  chemically synthesized
ctaccctgagcaaaaggctggt

SEQ ID NO: 138210 - DNA, 22 bp, Artificial Sequence
  chemically synthesized
taccctgagcaaaaggctggtc

SEQ ID NO: 138211 - DNA, 22 bp, Artificial Sequence
  chemically synthesized
ccctgagcaaaaggctggtctt

SEQ ID NO: 138212 - DNA, 22 bp, Artificial Sequence
  chemically synthesized
agcaaaaggctggtcttgatta

SEQ ID NO: 138213 - DNA, 22 bp, Artificial Sequence
  chemically synthesized
gtcttgattaattcccaaactc

SEQ ID NO: 138214 - DNA, 22 bp, Artificial Sequence
  chemically synthesized
gattaattcccaaactcatata

SEQ ID NO: 138215 - DNA, 22 bp, Artificial Sequence
  chemically synthesized
attaattcccaaactcatatag

SEQ ID NO: 138216 - DNA, 22 bp, Artificial Sequence
  chemically synthesized
attcccaaactcatatagctct

SEQ ID NO: 138217 - DNA, 22 bp, Artificial Sequence
  chemically synthesized
ccaaactcatatagctctgaga

SEQ ID NO: 138218 - DNA, 22 bp, Artificial Sequence
  chemically synthesized
atatagctctgagaaagtctat

SEQ ID NO: 138219 - DNA, 22 bp, Artificial Sequence
  chemically synthesized
tgagaaagtctatgctgttaac

SEQ ID NO: 138220 - DNA, 22 bp, Artificial Sequence
  chemically synthesized
agaaagtctatgctgttaacgt

SEQ ID NO: 138221 - DNA, 22 bp, Artificial Sequence
  chemically synthesized
tgctgttaacgttttcttgtct

SEQ ID NO: 138222 - DNA, 22 bp, Artificial Sequence
  chemically synthesized
ttaacgttttcttgtctgctac

SEQ ID NO: 138223 - DNA, 22 bp, Artificial Sequence
  chemically synthesized
acgttttcttgtctgctacccc

SEQ ID NO: 138224 - DNA, 22 bp, Artificial Sequence
  chemically synthesized
tcttgtctgctaccccatcata

SEQ ID NO: 138225 - DNA, 22 bp, Artificial Sequence
  chemically synthesized
cttgtctgctaccccatcatat

SEQ ID NO: 138226 - DNA, 22 bp, Artificial Sequence
  chemically synthesized
ttgtctgctaccccatcatatg

SEQ ID NO: 138227 - DNA, 22 bp, Artificial Sequence
  chemically synthesized
gtctgctaccccatcatatgca

SEQ ID NO: 138228 - DNA, 22 bp, Artificial Sequence
  chemically synthesized
tctgctaccccatcatatgcac

SEQ ID NO: 138229 - DNA, 22 bp, Artificial Sequence
  chemically synthesized
ctaccccatcatatgcacaaca

SEQ ID NO: 138230 - DNA, 22 bp, Artificial Sequence
  chemically synthesized
ccccatcatatgcacaacaata

SEQ ID NO: 138231 - DNA, 22 bp, Artificial Sequence
  chemically synthesized
ggcatgactgaaggctctctca

SEQ ID NO: 138232 - DNA, 22 bp, Artificial Sequence
  chemically synthesized
aaggctctctcataattcttgg

SEQ ID NO: 138233 - DNA, 22 bp, Artificial Sequence
  chemically synthesized
tctcataattcttggttgcatg

SEQ ID NO: 138234 - DNA, 22 bp, Artificial Sequence
  chemically synthesized
tcataattcttggttgcatgaa

SEQ ID NO: 138235 - DNA, 22 bp, Artificial Sequence
  chemically synthesized
ataattcttggttgcatgaatc

SEQ ID NO: 138236 - DNA, 22 bp, Artificial Sequence
  chemically synthesized
ttggttgcatgaatcagattat

SEQ ID NO: 138237 - DNA, 22 bp, Artificial Sequence
  chemically synthesized
ggttgcatgaatcagattatca

SEQ ID NO: 138238 - DNA, 22 bp, Artificial Sequence
  chemically synthesized
gttgcatgaatcagattatcaa

SEQ ID NO: 138239 - DNA, 22 bp, Artificial Sequence
  chemically synthesized
catgaatcagattatcaacaga

SEQ ID NO: 138240 - DNA, 22 bp, Artificial Sequence
  chemically synthesized
tcaacagaaatgttgagacaaa

SEQ ID NO: 138241 - DNA, 22 bp, Artificial Sequence
  chemically synthesized
agacaaactatggggaagcagg

SEQ ID NO: 138242 - DNA, 22 bp, Artificial Sequence
  chemically synthesized
tggggaagcagggtatgaaaga

SEQ ID NO: 138243 - DNA, 22 bp, Artificial Sequence
  chemically synthesized
tgaatgaaatggaaaccgcaat

SEQ ID NO: 138244 - DNA, 22 bp, Artificial Sequence
  chemically synthesized
aatgaaatggaaaccgcaatgc

SEQ ID NO: 138245 - DNA, 22 bp, Artificial Sequence
  chemically synthesized
cctgcccattcagggctccagc

SEQ ID NO: 138246 - DNA, 22 bp, Artificial Sequence
  chemically synthesized
ctgcccattcagggctccagca

SEQ ID NO: 138247 - DNA, 22 bp, Artificial Sequence
  chemically synthesized
cccattcagggctccagcatgt

SEQ ID NO: 138248 - DNA, 22 bp, Artificial Sequence
  chemically synthesized
agggctccagcatgtagaaatc

SEQ ID NO: 138249 - DNA, 22 bp, Artificial Sequence
  chemically synthesized
cagcatgtagaaatctggggct

SEQ ID NO: 138250 - DNA, 22 bp, Artificial Sequence
  chemically synthesized
gggctttgtgaagactggctta

SEQ ID NO: 138251 - DNA, 22 bp, Artificial Sequence
  chemically synthesized
tgtgaagactggcttaaaatca

SEQ ID NO: 138252 - DNA, 22 bp, Artificial Sequence
  chemically synthesized
gtgaagactggcttaaaatcag

SEQ ID NO: 138253 - DNA, 22 bp, Artificial Sequence
  chemically synthesized
tgaagactggcttaaaatcaga

SEQ ID NO: 138254 - DNA, 22 bp, Artificial Sequence
  chemically synthesized
gcttaaaatcagaagccccatt

SEQ ID NO: 138255 - DNA, 22 bp, Artificial Sequence
  chemically synthesized
aaaatcagaagccccattggat

SEQ ID NO: 138256 - DNA, 22 bp, Artificial Sequence
  chemically synthesized
aaatcagaagccccattggata

SEQ ID NO: 138257 - DNA, 22 bp, Artificial Sequence
  chemically synthesized
gataagagtagggaagaaccta

SEQ ID NO: 138258 - DNA, 22 bp, Artificial Sequence
  chemically synthesized
gagcctacgctgagcaggtttc

SEQ ID NO: 138259 - DNA, 22 bp, Artificial Sequence
  chemically synthesized
cgctgagcaggtttccttcatg

SEQ ID NO: 138260 - DNA, 22 bp, Artificial Sequence
  chemically synthesized
agcaggtttccttcatgtgaca

SEQ ID NO: 138261 - DNA, 22 bp, Artificial Sequence
  chemically synthesized
ccttcatgtgacagggagcctc

SEQ ID NO: 138262 - DNA, 22 bp, Artificial Sequence
  chemically synthesized
cttcatgtgacagggagcctcc

SEQ ID NO: 138263 - DNA, 22 bp, Artificial Sequence
  chemically synthesized
catgtgacagggagcctcctgc

SEQ ID NO: 138264 - DNA, 22 bp, Artificial Sequence
  chemically synthesized
atgtgacagggagcctcctgcc

SEQ ID NO: 138265 - DNA, 22 bp, Artificial Sequence
  chemically synthesized
ctgccccgaacttccagggatc

SEQ ID NO: 138266 - DNA, 22 bp, Artificial Sequence
  chemically synthesized
ccccgaacttccagggatcctc

SEQ ID NO: 138267 - DNA, 22 bp, Artificial Sequence
  chemically synthesized
ccagggatcctctcttaagtgt

SEQ ID NO: 138268 - DNA, 22 bp, Artificial Sequence
  chemically synthesized
cagggatcctctcttaagtgtt

SEQ ID NO: 138269 - DNA, 22 bp, Artificial Sequence
  chemically synthesized
tcttaagtgtttcctgctggaa

SEQ ID NO: 138270 - DNA, 22 bp, Artificial Sequence
  chemically synthesized
ttaagtgtttcctgctggaatc

SEQ ID NO: 138271 - DNA, 22 bp, Artificial Sequence
  chemically synthesized
aagtgtttcctgctggaatctc

SEQ ID NO: 138272 - DNA, 22 bp, Artificial Sequence
  chemically synthesized
agtgtttcctgctggaatctcc

SEQ ID NO: 138273 - DNA, 22 bp, Artificial Sequence
  chemically synthesized
cctgctggaatctcctcacttc

SEQ ID NO: 138274 - DNA, 22 bp, Artificial Sequence
  chemically synthesized
ctgctggaatctcctcacttct

SEQ ID NO: 138275 - DNA, 22 bp, Artificial Sequence
  chemically synthesized
ctggaatctcctcacttctatc

SEQ ID NO: 138276 - DNA, 22 bp, Artificial Sequence
  chemically synthesized
gaatctcctcacttctatctgg

SEQ ID NO: 138277 - DNA, 22 bp, Artificial Sequence
  chemically synthesized
ctcacttctatctggaaatggt

SEQ ID NO: 138278 - DNA, 22 bp, Artificial Sequence
  chemically synthesized
acttctatctggaaatggtttc

SEQ ID NO: 138279 - DNA, 22 bp, Artificial Sequence
  chemically synthesized
ctatctggaaatggtttctcca

SEQ ID NO: 138280 - DNA, 22 bp, Artificial Sequence
  chemically synthesized
tatctggaaatggtttctccac

SEQ ID NO: 138281 - DNA, 22 bp, Artificial Sequence
  chemically synthesized
tctggaaatggtttctccacag

SEQ ID NO: 138282 - DNA, 22 bp, Artificial Sequence
  chemically synthesized
gaaatggtttctccacagtcca

SEQ ID NO: 138283 - DNA, 22 bp, Artificial Sequence
  chemically synthesized
ctccacagtccagcccctggct

SEQ ID NO: 138284 - DNA, 22 bp, Artificial Sequence
  chemically synthesized
tccacagtccagcccctggcta

SEQ ID NO: 138285 - DNA, 22 bp, Artificial Sequence
  chemically synthesized
cacagtccagcccctggctagt

SEQ ID NO: 138286 - DNA, 22 bp, Artificial Sequence
  chemically synthesized
gctagttgaaagagttacccat

SEQ ID NO: 138287 - DNA, 22 bp, Artificial Sequence
  chemically synthesized
gttgaaagagttacccatgcag

SEQ ID NO: 138288 - DNA, 22 bp, Artificial Sequence
  chemically synthesized
aaagagttacccatgcagaggc

SEQ ID NO: 138289 - DNA, 22 bp, Artificial Sequence
  chemically synthesized
cccatgcagaggccctcctagc

SEQ ID NO: 138290 - DNA, 22 bp, Artificial Sequence
  chemically synthesized
ctagcatccagagactagtgct

SEQ ID NO: 138291 - DNA, 22 bp, Artificial Sequence
  chemically synthesized
gcatccagagactagtgcttag

SEQ ID NO: 138292 - DNA, 22 bp, Artificial Sequence
  chemically synthesized
gtgcttagattcctactttcag

SEQ ID NO: 138293 - DNA, 22 bp, Artificial Sequence
  chemically synthesized
agattcctactttcagcgttgg

SEQ ID NO: 138294 - DNA, 22 bp, Artificial Sequence
  chemically synthesized
gattcctactttcagcgttgga

SEQ ID NO: 138295 - DNA, 22 bp, Artificial Sequence
  chemically synthesized
ctactttcagcgttggacaacc

SEQ ID NO: 138296 - DNA, 22 bp, Artificial Sequence
  chemically synthesized
ctttcagcgttggacaacctgg

SEQ ID NO: 138297 - DNA, 22 bp, Artificial Sequence
  chemically synthesized
tcagcgttggacaacctggatc

SEQ ID NO: 138298 - DNA, 22 bp, Artificial Sequence
  chemically synthesized
cagcgttggacaacctggatcc

SEQ ID NO: 138299 - DNA, 22 bp, Artificial Sequence
  chemically synthesized
agcgttggacaacctggatcca

SEQ ID NO: 138300 - DNA, 22 bp, Artificial Sequence
  chemically synthesized
gacaacctggatccacttgccc

SEQ ID NO: 138301 - DNA, 22 bp, Artificial Sequence
  chemically synthesized
gatccacttgcccagtgttctt

SEQ ID NO: 138302 - DNA, 22 bp, Artificial Sequence
  chemically synthesized
gcccagtgttcttccttagttc

SEQ ID NO: 138303 - DNA, 22 bp, Artificial Sequence
  chemically synthesized
cccagtgttcttccttagttcc

SEQ ID NO: 138304 - DNA, 22 bp, Artificial Sequence
  chemically synthesized
ttccttagttcctaccttcgac

SEQ ID NO: 138305 - DNA, 22 bp, Artificial Sequence
  chemically synthesized
ccttagttcctaccttcgacct

SEQ ID NO: 138306 - DNA, 22 bp, Artificial Sequence
  chemically synthesized
cttagttcctaccttcgacctt

SEQ ID NO: 138307 - DNA, 22 bp, Artificial Sequence
  chemically synthesized
agttcctaccttcgaccttgat

SEQ ID NO: 138308 - DNA, 22 bp, Artificial Sequence
  chemically synthesized
gttcctaccttcgaccttgatc

SEQ ID NO: 138309 - DNA, 22 bp, Artificial Sequence
  chemically synthesized
ctaccttcgaccttgatcctcc

SEQ ID NO: 138310 - DNA, 22 bp, Artificial Sequence
  chemically synthesized
ccttcgaccttgatcctccttt

SEQ ID NO: 138311 - DNA, 22 bp, Artificial Sequence
  chemically synthesized
cgaccttgatcctcctttatct

SEQ ID NO: 138312 - DNA, 22 bp, Artificial Sequence
  chemically synthesized
gaccttgatcctcctttatctt

SEQ ID NO: 138313 - DNA, 22 bp, Artificial Sequence
  chemically synthesized
gatcctcctttatcttcctgaa

SEQ ID NO: 138314 - DNA, 22 bp, Artificial Sequence
  chemically synthesized
atcctcctttatcttcctgaac

SEQ ID NO: 138315 - DNA, 22 bp, Artificial Sequence
  chemically synthesized
ctttatcttcctgaaccctgct

SEQ ID NO: 138316 - DNA, 22 bp, Artificial Sequence
  chemically synthesized
tatcttcctgaaccctgctgag

SEQ ID NO: 138317 - DNA, 22 bp, Artificial Sequence
  chemically synthesized
atcttcctgaaccctgctgaga

SEQ ID NO: 138318 - DNA, 22 bp, Artificial Sequence
  chemically synthesized
tcttcctgaaccctgctgagat

SEQ ID NO: 138319 - DNA, 22 bp, Artificial Sequence
  chemically synthesized
cctgaaccctgctgagatgatc

SEQ ID NO: 138320 - DNA, 22 bp, Artificial Sequence
  chemically synthesized
ctgaaccctgctgagatgatct

SEQ ID NO: 138321 - DNA, 22 bp, Artificial Sequence
  chemically synthesized
aaccctgctgagatgatctatg

SEQ ID NO: 138322 - DNA, 22 bp, Artificial Sequence
  chemically synthesized
ctgagatgatctatgtggggag

SEQ ID NO: 138323 - DNA, 22 bp, Artificial Sequence
  chemically synthesized
agatgatctatgtggggagaat

SEQ ID NO: 138324 - DNA, 22 bp, Artificial Sequence
  chemically synthesized
tgtggggagaatggcttctttg

SEQ ID NO: 138325 - DNA, 22 bp, Artificial Sequence
  chemically synthesized
ctttgagaaacatcttcttcgt

SEQ ID NO: 138326 - DNA, 22 bp, Artificial Sequence
  chemically synthesized
tttgagaaacatcttcttcgtt

SEQ ID NO: 138327 - DNA, 22 bp, Artificial Sequence
  chemically synthesized
tgagaaacatcttcttcgttag

SEQ ID NO: 138328 - DNA, 22 bp, Artificial Sequence
  chemically synthesized
gagaaacatcttcttcgttagt

SEQ ID NO: 138329 - DNA, 22 bp, Artificial Sequence
  chemically synthesized
agaaacatcttcttcgttagtg

SEQ ID NO: 138330 - DNA, 22 bp, Artificial Sequence
  chemically synthesized
cttcgttagtggcctgcccctc

SEQ ID NO: 138331 - DNA, 22 bp, Artificial Sequence
  chemically synthesized
ttcgttagtggcctgcccctca

SEQ ID NO: 138332 - DNA, 22 bp, Artificial Sequence
  chemically synthesized
cgttagtggcctgcccctcatt

SEQ ID NO: 138333 - DNA, 22 bp, Artificial Sequence
  chemically synthesized
gttagtggcctgcccctcattc

SEQ ID NO: 138334 - DNA, 22 bp, Artificial Sequence
  chemically synthesized
gtggcctgcccctcattcccac

SEQ ID NO: 138335 - DNA, 22 bp, Artificial Sequence
  chemically synthesized
cccctcattcccactttaatat

SEQ ID NO: 138336 - DNA, 22 bp, Artificial Sequence
  chemically synthesized
attcccactttaatatccagaa

SEQ ID NO: 138337 - DNA, 22 bp, Artificial Sequence
  chemically synthesized
ccactttaatatccagaatcac

SEQ ID NO: 138338 - DNA, 22 bp, Artificial Sequence
  chemically synthesized
taatatccagaatcactataag

SEQ ID NO: 138339 - DNA, 22 bp, Artificial Sequence
  chemically synthesized
aatatccagaatcactataaga

SEQ ID NO: 138340 - DNA, 22 bp, Artificial Sequence
  chemically synthesized
atatccagaatcactataagaa

SEQ ID NO: 138341 - DNA, 22 bp, Artificial Sequence
  chemically synthesized
taagaagaatataataagagga

SEQ ID NO: 138342 - DNA, 22 bp, Artificial Sequence
  chemically synthesized
ttattataggtaagggaaaatt

SEQ ID NO: 138343 - DNA, 22 bp, Artificial Sequence
  chemically synthesized
attataggtaagggaaaattaa

SEQ ID NO: 138344 - DNA, 22 bp, Artificial Sequence
  chemically synthesized
ttataggtaagggaaaattaag

SEQ ID NO: 138345 - DNA, 22 bp, Artificial Sequence
  chemically synthesized
taggtaagggaaaattaagagg

SEQ ID NO: 138346 - DNA, 22 bp, Artificial Sequence
  chemically synthesized
agaggcatacgtgatgggatga

SEQ ID NO: 138347 - DNA, 22 bp, Artificial Sequence
  chemically synthesized
atggacgataaaatctactact

SEQ ID NO: 138348 - DNA, 22 bp, Artificial Sequence
  chemically synthesized
ctactatttgttgagacctttt

SEQ ID NO: 138349 - DNA, 22 bp, Artificial Sequence
  chemically synthesized
ctatttgttgagaccttttata

SEQ ID NO: 138350 - DNA, 22 bp, Artificial Sequence
  chemically synthesized
tttgttgagaccttttatagtc

SEQ ID NO: 138351 - DNA, 22 bp, Artificial Sequence
  chemically synthesized
gttgagaccttttatagtctaa

SEQ ID NO: 138352 - DNA, 22 bp, Artificial Sequence
  chemically synthesized
ttgagaccttttatagtctaat

SEQ ID NO: 138353 - DNA, 22 bp, Artificial Sequence
  chemically synthesized
agaccttttatagtctaatcaa

SEQ ID NO: 138354 - DNA, 22 bp, Artificial Sequence
  chemically synthesized
ttatagtctaatcaattttgct

SEQ ID NO: 138355 - DNA, 22 bp, Artificial Sequence
  chemically synthesized
tatagtctaatcaattttgcta

SEQ ID NO: 138356 - DNA, 22 bp, Artificial Sequence
  chemically synthesized
atagtctaatcaattttgctat

SEQ ID NO: 138357 - DNA, 22 bp, Artificial Sequence
  chemically synthesized
tagtctaatcaattttgctatt

SEQ ID NO: 138358 - DNA, 22 bp, Artificial Sequence
  chemically synthesized
atcaattttgctattgttttcc

SEQ ID NO: 138359 - DNA, 22 bp, Artificial Sequence
  chemically synthesized
tgctattgttttccatcctcac

SEQ ID NO: 138360 - DNA, 22 bp, Artificial Sequence
  chemically synthesized
gctattgttttccatcctcacg

SEQ ID NO: 138361 - DNA, 22 bp, Artificial Sequence
  chemically synthesized
ctattgttttccatcctcacgc

SEQ ID NO: 138362 - DNA, 22 bp, Artificial Sequence
  chemically synthesized
ttgttttccatcctcacgctaa

SEQ ID NO: 138363 - DNA, 22 bp, Artificial Sequence
  chemically synthesized
ttttccatcctcacgctaactc

SEQ ID NO: 138364 - DNA, 22 bp, Artificial Sequence
  chemically synthesized
tccatcctcacgctaactccat

SEQ ID NO: 138365 - DNA, 22 bp, Artificial Sequence
  chemically synthesized
ccatcctcacgctaactccata

SEQ ID NO: 138366 - DNA, 22 bp, Artificial Sequence
  chemically synthesized
catcctcacgctaactccataa

SEQ ID NO: 138367 - DNA, 22 bp, Artificial Sequence
  chemically synthesized
acgctaactccataaaaaaaca

SEQ ID NO: 138368 - DNA, 22 bp, Artificial Sequence
  chemically synthesized
actccataaaaaaacactatta

SEQ ID NO: 138369 - DNA, 22 bp, Artificial Sequence
  chemically synthesized
cataaaaaaacactattattat

SEQ ID NO: 138370 - DNA, 22 bp, Artificial Sequence
  chemically synthesized
ttattatctttattttgccatg

SEQ ID NO: 138371 - DNA, 22 bp, Artificial Sequence
  chemically synthesized
ttatctttattttgccatgaca

SEQ ID NO: 138372 - DNA, 22 bp, Artificial Sequence
  chemically synthesized
tctttattttgccatgacaaga

SEQ ID NO: 138373 - DNA, 22 bp, Artificial Sequence
  chemically synthesized
tattttgccatgacaagactga

SEQ ID NO: 138374 - DNA, 22 bp, Artificial Sequence
  chemically synthesized
attttgccatgacaagactgag

SEQ ID NO: 138375 - DNA, 22 bp, Artificial Sequence
  chemically synthesized
ttttgccatgacaagactgagc

SEQ ID NO: 138376 - DNA, 22 bp, Artificial Sequence
  chemically synthesized
tgccatgacaagactgagctca

SEQ ID NO: 138377 - DNA, 22 bp, Artificial Sequence
  chemically synthesized
gccatgacaagactgagctcag

SEQ ID NO: 138378 - DNA, 22 bp, Artificial Sequence
  chemically synthesized
ccatgacaagactgagctcaga

SEQ ID NO: 138379 - DNA, 22 bp, Artificial Sequence
  chemically synthesized
agctcagaagagtcaagcattt

SEQ ID NO: 138380 - DNA, 22 bp, Artificial Sequence
  chemically synthesized
agaagagtcaagcatttgccta

SEQ ID NO: 138381 - DNA, 22 bp, Artificial Sequence
  chemically synthesized
gcctaaggtcggacatgtcaga

SEQ ID NO: 138382 - DNA, 22 bp, Artificial Sequence
  chemically synthesized
cctaaggtcggacatgtcagag

SEQ ID NO: 138383 - DNA, 22 bp, Artificial Sequence
  chemically synthesized
aggtcggacatgtcagaggcag

SEQ ID NO: 138384 - DNA, 22 bp, Artificial Sequence
  chemically synthesized
tgtgagactctgcagctactgc

SEQ ID NO: 138385 - DNA, 22 bp, Artificial Sequence
  chemically synthesized
tgcagctactgctcatgggccc

SEQ ID NO: 138386 - DNA, 22 bp, Artificial Sequence
  chemically synthesized
cagctactgctcatgggccctg

SEQ ID NO: 138387 - DNA, 22 bp, Artificial Sequence
  chemically synthesized
ctgctcatgggccctgtgctgc

SEQ ID NO: 138388 - DNA, 22 bp, Artificial Sequence
  chemically synthesized
ctcatgggccctgtgctgcact

SEQ ID NO: 138389 - DNA, 22 bp, Artificial Sequence
  chemically synthesized
atgggccctgtgctgcactgat

SEQ ID NO: 138390 - DNA, 22 bp, Artificial Sequence
  chemically synthesized
tgctgcactgatgaggaggatc

SEQ ID NO: 138391 - DNA, 22 bp, Artificial Sequence
  chemically synthesized
cactgatgaggaggatcagatg

SEQ ID NO: 138392 - DNA, 22 bp, Artificial Sequence
  chemically synthesized
atgaggaggatcagatggatgg

SEQ ID NO: 138393 - DNA, 22 bp, Artificial Sequence
  chemically synthesized
tgtggataaaggagacagccat

SEQ ID NO: 138394 - DNA, 22 bp, Artificial Sequence
  chemically synthesized
tggataaaggagacagccatga

SEQ ID NO: 138395 - DNA, 22 bp, Artificial Sequence
  chemically synthesized
tgactgtaaatttgggagcagg

SEQ ID NO: 138396 - DNA, 22 bp, Artificial Sequence
  chemically synthesized
taaatttgggagcaggagtctc

SEQ ID NO: 138397 - DNA, 22 bp, Artificial Sequence
  chemically synthesized
gggagcaggagtctctaaggac

SEQ ID NO: 138398 - DNA, 22 bp, Artificial Sequence
  chemically synthesized
ggagcaggagtctctaaggact

SEQ ID NO: 138399 - DNA, 22 bp, Artificial Sequence
  chemically synthesized
taaggacttggatttcaaggaa

SEQ ID NO: 138400 - DNA, 22 bp, Artificial Sequence
  chemically synthesized
aggacttggatttcaaggaatt

SEQ ID NO: 138401 - DNA, 22 bp, Artificial Sequence
  chemically synthesized
ggatttcaaggaattttgactc

SEQ ID NO: 138402 - DNA, 22 bp, Artificial Sequence
  chemically synthesized
gatttcaaggaattttgactca

SEQ ID NO: 138403 - DNA, 22 bp, Artificial Sequence
  chemically synthesized
caaggaattttgactcagcaaa

SEQ ID NO: 138404 - DNA, 22 bp, Artificial Sequence
  chemically synthesized
aaggaattttgactcagcaaac

SEQ ID NO: 138405 - DNA, 22 bp, Artificial Sequence
  chemically synthesized
tgactcagcaaacacaagaccc

SEQ ID NO: 138406 - DNA, 22 bp, Artificial Sequence
  chemically synthesized
gactcagcaaacacaagaccct

SEQ ID NO: 138407 - DNA, 22 bp, Artificial Sequence
  chemically synthesized
actcagcaaacacaagaccctc

SEQ ID NO: 138408 - DNA, 22 bp, Artificial Sequence
  chemically synthesized
agcaaacacaagaccctcacgg

SEQ ID NO: 138409 - DNA, 22 bp, Artificial Sequence
  chemically synthesized
acggtgactttgcgagctggtg

SEQ ID NO: 138410 - DNA, 22 bp, Artificial Sequence
  chemically synthesized
tgcgagctggtgtgccagatgt

SEQ ID NO: 138411 - DNA, 22 bp, Artificial Sequence
  chemically synthesized
gcgagctggtgtgccagatgtg

SEQ ID NO: 138412 - DNA, 22 bp, Artificial Sequence
  chemically synthesized
cgagctggtgtgccagatgtgt

SEQ ID NO: 138413 - DNA, 22 bp, Artificial Sequence
  chemically synthesized
gtgtgccagatgtgtctatcag

SEQ ID NO: 138414 - DNA, 22 bp, Artificial Sequence
  chemically synthesized
tcagaggttccagggagggtgg

SEQ ID NO: 138415 - DNA, 22 bp, Artificial Sequence
  chemically synthesized
cagggagggtggggtggggtca

SEQ ID NO: 138416 - DNA, 22 bp, Artificial Sequence
  chemically synthesized
gccaccagctatcagggcccag

SEQ ID NO: 138417 - DNA, 22 bp, Artificial Sequence
  chemically synthesized
tcagggcccagatgggttatag

SEQ ID NO: 138418 - DNA, 22 bp, Artificial Sequence
  chemically synthesized
taggctggcaggctcagatagg

SEQ ID NO: 138419 - DNA, 22 bp, Artificial Sequence
  chemically synthesized
gcaggctcagataggtggttag

SEQ ID NO: 138420 - DNA, 22 bp, Artificial Sequence
  chemically synthesized
agataggtggttaggtcaggtt

SEQ ID NO: 138421 - DNA, 22 bp, Artificial Sequence
  chemically synthesized
ggtcaggttggtggtgctgggt

SEQ ID NO: 138422 - DNA, 22 bp, Artificial Sequence
  chemically synthesized
gtggtgctgggtggagtccatg

SEQ ID NO: 138423 - DNA, 22 bp, Artificial Sequence
  chemically synthesized
ggtggagtccatgactcccagg

SEQ ID NO: 138424 - DNA, 22 bp, Artificial Sequence
  chemically synthesized
ccaggagccaggagagatagac

SEQ ID NO: 138425 - DNA, 22 bp, Artificial Sequence
  chemically synthesized
ttcattctactactacatggga

SEQ ID NO: 138426 - DNA, 22 bp, Artificial Sequence
  chemically synthesized
tcattctactactacatgggac

SEQ ID NO: 138427 - DNA, 22 bp, Artificial Sequence
  chemically synthesized
cattctactactacatgggact

SEQ ID NO: 138428 - DNA, 22 bp, Artificial Sequence
  chemically synthesized
attctactactacatgggactg

SEQ ID NO: 138429 - DNA, 22 bp, Artificial Sequence
  chemically synthesized
tactactacatgggactgctcc

SEQ ID NO: 138430 - DNA, 22 bp, Artificial Sequence
  chemically synthesized
ctactacatgggactgctcccc

SEQ ID NO: 138431 - DNA, 22 bp, Artificial Sequence
  chemically synthesized
ctacatgggactgctcccctat

SEQ ID NO: 138432 - DNA, 22 bp, Artificial Sequence
  chemically synthesized
catgggactgctcccctatacc

SEQ ID NO: 138433 - DNA, 22 bp, Artificial Sequence
  chemically synthesized
ctcccctatacccccagctagg

SEQ ID NO: 138434 - DNA, 22 bp, Artificial Sequence
  chemically synthesized
ccctatacccccagctaggggc

SEQ ID NO: 138435 - DNA, 22 bp, Artificial Sequence
  chemically synthesized
tacccccagctaggggcaagtg

SEQ ID NO: 138436 - DNA, 22 bp, Artificial Sequence
  chemically synthesized
ggggcaagtgccttgactccta

SEQ ID NO: 138437 - DNA, 22 bp, Artificial Sequence
  chemically synthesized
gactcctatgttttcaggatca

SEQ ID NO: 138438 - DNA, 22 bp, Artificial Sequence
  chemically synthesized
actcctatgttttcaggatcat

SEQ ID NO: 138439 - DNA, 22 bp, Artificial Sequence
  chemically synthesized
ctatgttttcaggatcatcatc

SEQ ID NO: 138440 - DNA, 22 bp, Artificial Sequence
  chemically synthesized
tgttttcaggatcatcatctat

SEQ ID NO: 138441 - DNA, 22 bp, Artificial Sequence
  chemically synthesized
tcaggatcatcatctataaagt

SEQ ID NO: 138442 - DNA, 22 bp, Artificial Sequence
  chemically synthesized
caggatcatcatctataaagta

SEQ ID NO: 138443 - DNA, 22 bp, Artificial Sequence
  chemically synthesized
aggatcatcatctataaagtaa

SEQ ID NO: 138444 - DNA, 22 bp, Artificial Sequence
  chemically synthesized
taaagtaagagtaataattgtg

SEQ ID NO: 138445 - DNA, 22 bp, Artificial Sequence
  chemically synthesized
tgtctatctcatagggttatta

SEQ ID NO: 138446 - DNA, 22 bp, Artificial Sequence
  chemically synthesized
tctcatagggttattatgagga

SEQ ID NO: 138447 - DNA, 22 bp, Artificial Sequence
  chemically synthesized
atagggttattatgaggatcaa

SEQ ID NO: 138448 - DNA, 22 bp, Artificial Sequence
  chemically synthesized
ttatgaggatcaaaggagatgc

SEQ ID NO: 138449 - DNA, 22 bp, Artificial Sequence
  chemically synthesized
tgaggatcaaaggagatgcaca

SEQ ID NO: 138450 - DNA, 22 bp, Artificial Sequence
  chemically synthesized
tctggaccagtggcctaacagt

SEQ ID NO: 138451 - DNA, 22 bp, Artificial Sequence
  chemically synthesized
tggaccagtggcctaacagttc

SEQ ID NO: 138452 - DNA, 22 bp, Artificial Sequence
  chemically synthesized
gaccagtggcctaacagttcag

SEQ ID NO: 138453 - DNA, 22 bp, Artificial Sequence
  chemically synthesized
acagttcaggacagagctatgg

SEQ ID NO: 138454 - DNA, 22 bp, Artificial Sequence
  chemically synthesized
aggacagagctatgggcttcct

SEQ ID NO: 138455 - DNA, 22 bp, Artificial Sequence
  chemically synthesized
tgggcttcctatgtatgggtca

SEQ ID NO: 138456 - DNA, 22 bp, Artificial Sequence
  chemically synthesized
cctatgtatgggtcagtggtct

SEQ ID NO: 138457 - DNA, 22 bp, Artificial Sequence
  chemically synthesized
ctatgtatgggtcagtggtctc

SEQ ID NO: 138458 - DNA, 22 bp, Artificial Sequence
  chemically synthesized
tgtatgggtcagtggtctcaat

SEQ ID NO: 138459 - DNA, 22 bp, Artificial Sequence
  chemically synthesized
aatgtagcaggcaagttccaga

SEQ ID NO: 138460 - DNA, 22 bp, Artificial Sequence
  chemically synthesized
cagaagatagcatcaaccactg

SEQ ID NO: 138461 - DNA, 22 bp, Artificial Sequence
  chemically synthesized
ttagagatatactgccagtctc

SEQ ID NO: 138462 - DNA, 22 bp, Artificial Sequence
  chemically synthesized
gagatatactgccagtctcaga

SEQ ID NO: 138463 - DNA, 22 bp, Artificial Sequence
  chemically synthesized
ccagtctcagagcctgatgtta

SEQ ID NO: 138464 - DNA, 22 bp, Artificial Sequence
  chemically synthesized
agagcctgatgttaatttagca

SEQ ID NO: 138465 - DNA, 22 bp, Artificial Sequence
  chemically synthesized
atgttaatttagcaatgggctg

SEQ ID NO: 138466 - DNA, 22 bp, Artificial Sequence
  chemically synthesized
atttagcaatgggctgggaccc

SEQ ID NO: 138467 - DNA, 22 bp, Artificial Sequence
  chemically synthesized
agcaatgggctgggaccctcct

SEQ ID NO: 138468 - DNA, 22 bp, Artificial Sequence
  chemically synthesized
gcaatgggctgggaccctcctc

SEQ ID NO: 138469 - DNA, 22 bp, Artificial Sequence
  chemically synthesized
ggaccctcctccagtagaacct

SEQ ID NO: 138470 - DNA, 22 bp, Artificial Sequence
  chemically synthesized
ctccagtagaaccttctaacca

SEQ ID NO: 138471 - DNA, 22 bp, Artificial Sequence
  chemically synthesized
cagtagaaccttctaaccagct

SEQ ID NO: 138472 - DNA, 22 bp, Artificial Sequence
  chemically synthesized
ctaaccagctgctgcagtcaaa

SEQ ID NO: 138473 - DNA, 22 bp, Artificial Sequence
  chemically synthesized
taaccagctgctgcagtcaaag

SEQ ID NO: 138474 - DNA, 22 bp, Artificial Sequence
  chemically synthesized
accagctgctgcagtcaaagtc

SEQ ID NO: 138475 - DNA, 22 bp, Artificial Sequence
  chemically synthesized
ctgcagtcaaagtcgaatgcag

SEQ ID NO: 138476 - DNA, 22 bp, Artificial Sequence
  chemically synthesized
cagtcaaagtcgaatgcagctg

SEQ ID NO: 138477 - DNA, 22 bp, Artificial Sequence
  chemically synthesized
gttagactttttttaatgaaag

SEQ ID NO: 138478 - DNA, 22 bp, Artificial Sequence
  chemically synthesized
gactttttttaatgaaagctta

SEQ ID NO: 138479 - DNA, 22 bp, Artificial Sequence
  chemically synthesized
tttttaatgaaagcttagcttt

SEQ ID NO: 138480 - DNA, 22 bp, Artificial Sequence
  chemically synthesized
ttttaatgaaagcttagctttc

SEQ ID NO: 138481 - DNA, 22 bp, Artificial Sequence
  chemically synthesized
tttaatgaaagcttagctttca

SEQ ID NO: 138482 - DNA, 22 bp, Artificial Sequence
  chemically synthesized
ttaatgaaagcttagctttcat

SEQ ID NO: 138483 - DNA, 22 bp, Artificial Sequence
  chemically synthesized
taatgaaagcttagctttcatt

SEQ ID NO: 138484 - DNA, 22 bp, Artificial Sequence
  chemically synthesized
aatgaaagcttagctttcatta

SEQ ID NO: 138485 - DNA, 22 bp, Artificial Sequence
  chemically synthesized
atgaaagcttagctttcattaa

SEQ ID NO: 138486 - DNA, 22 bp, Artificial Sequence
  chemically synthesized
agctttcattaaagattaagct

SEQ ID NO: 138487 - DNA, 22 bp, Artificial Sequence
  chemically synthesized
gctttcattaaagattaagctc

SEQ ID NO: 138488 - DNA, 22 bp, Artificial Sequence
  chemically synthesized
tcattaaagattaagctcctaa

SEQ ID NO: 138489 - DNA, 22 bp, Artificial Sequence
  chemically synthesized
cattaaagattaagctcctaag

SEQ ID NO: 138490 - DNA, 22 bp, Artificial Sequence
  chemically synthesized
attaaagattaagctcctaagc

SEQ ID NO: 138491 - DNA, 22 bp, Artificial Sequence
  chemically synthesized
aagattaagctcctaagcaggg

SEQ ID NO: 138492 - DNA, 22 bp, Artificial Sequence
  chemically synthesized
agctcctaagcagggcacagat

SEQ ID NO: 138493 - DNA, 22 bp, Artificial Sequence
  chemically synthesized
ctaagcagggcacagatgaaat

SEQ ID NO: 138494 - DNA, 22 bp, Artificial Sequence
  chemically synthesized
agcagggcacagatgaaattgt

SEQ ID NO: 138495 - DNA, 22 bp, Artificial Sequence
  chemically synthesized
tctaacagcaactttgccatct

SEQ ID NO: 138496 - DNA, 22 bp, Artificial Sequence
  chemically synthesized
acagcaactttgccatctaaaa

SEQ ID NO: 138497 - DNA, 22 bp, Artificial Sequence
  chemically synthesized
tgccatctaaaaaaatctgact

SEQ ID NO: 138498 - DNA, 22 bp, Artificial Sequence
  chemically synthesized
gccatctaaaaaaatctgactt

SEQ ID NO: 138499 - DNA, 22 bp, Artificial Sequence
  chemically synthesized
ccatctaaaaaaatctgacttc

SEQ ID NO: 138500 - DNA, 22 bp, Artificial Sequence
  chemically synthesized
aaaaaatctgacttcactggaa

SEQ ID NO: 138501 - DNA, 22 bp, Artificial Sequence
  chemically synthesized
acttcactggaaacatggaagc

SEQ ID NO: 138502 - DNA, 22 bp, Artificial Sequence
  chemically synthesized
cactggaaacatggaagcccaa

SEQ ID NO: 138503 - DNA, 22 bp, Artificial Sequence
  chemically synthesized
actggaaacatggaagcccaag

SEQ ID NO: 138504 - DNA, 22 bp, Artificial Sequence
  chemically synthesized
gaaacatggaagcccaaggttc

SEQ ID NO: 138505 - DNA, 22 bp, Artificial Sequence
  chemically synthesized
tgaacatgagaaatttttagga

SEQ ID NO: 138506 - DNA, 22 bp, Artificial Sequence
  chemically synthesized
aacatgagaaatttttaggaat

SEQ ID NO: 138507 - DNA, 22 bp, Artificial Sequence
  chemically synthesized
ttaggaatctgcacaggagttg

SEQ ID NO: 138508 - DNA, 22 bp, Artificial Sequence
  chemically synthesized
taggaatctgcacaggagttga

SEQ ID NO: 138509 - DNA, 22 bp, Artificial Sequence
  chemically synthesized
aggaatctgcacaggagttgag

SEQ ID NO: 138510 - DNA, 22 bp, Artificial Sequence
  chemically synthesized
ggaatctgcacaggagttgaga

SEQ ID NO: 138511 - DNA, 22 bp, Artificial Sequence
  chemically synthesized
cacaggagttgagagggaaaca

SEQ ID NO: 138512 - DNA, 22 bp, Artificial Sequence
  chemically synthesized
agagggaaacaagatggtgaag

SEQ ID NO: 138513 - DNA, 22 bp, Artificial Sequence
  chemically synthesized
gaaaccacatgagagacacgag

SEQ ID NO: 138514 - DNA, 22 bp, Artificial Sequence
  chemically synthesized
aggctggaggtaaatgaaagag

SEQ ID NO: 138515 - DNA, 22 bp, Artificial Sequence
  chemically synthesized
ggctggaggtaaatgaaagaga

SEQ ID NO: 138516 - DNA, 22 bp, Artificial Sequence
  chemically synthesized
gaggtaaatgaaagagaagtgg

SEQ ID NO: 138517 - DNA, 22 bp, Artificial Sequence
  chemically synthesized
atacttactgaaatctttctat

SEQ ID NO: 138518 - DNA, 22 bp, Artificial Sequence
  chemically synthesized
actgaaatctttctatatgtca

SEQ ID NO: 138519 - DNA, 22 bp, Artificial Sequence
  chemically synthesized
ctgaaatctttctatatgtcag

SEQ ID NO: 138520 - DNA, 22 bp, Artificial Sequence
  chemically synthesized
aaatctttctatatgtcaggtg

SEQ ID NO: 138521 - DNA, 22 bp, Artificial Sequence
  chemically synthesized
tctatatgtcaggtgccatttt

SEQ ID NO: 138522 - DNA, 22 bp, Artificial Sequence
  chemically synthesized
ctatatgtcaggtgccatttta

SEQ ID NO: 138523 - DNA, 22 bp, Artificial Sequence
  chemically synthesized
tatatgtcaggtgccattttat

SEQ ID NO: 138524 - DNA, 22 bp, Artificial Sequence
  chemically synthesized
tatgtcaggtgccattttatga

SEQ ID NO: 138525 - DNA, 22 bp, Artificial Sequence
  chemically synthesized
tatgatatttaataatctcatt

SEQ ID NO: 138526 - DNA, 22 bp, Artificial Sequence
  chemically synthesized
atgatatttaataatctcatta

SEQ ID NO: 138527 - DNA, 22 bp, Artificial Sequence
  chemically synthesized
tgatatttaataatctcattac

SEQ ID NO: 138528 - DNA, 22 bp, Artificial Sequence
  chemically synthesized
aataatctcattacatatggta

SEQ ID NO: 138529 - DNA, 22 bp, Artificial Sequence
  chemically synthesized
ataatctcattacatatggtaa

SEQ ID NO: 138530 - DNA, 22 bp, Artificial Sequence
  chemically synthesized
attacatatggtaattctgtga

SEQ ID NO: 138531 - DNA, 22 bp, Artificial Sequence
  chemically synthesized
catatggtaattctgtgagata

SEQ ID NO: 138532 - DNA, 22 bp, Artificial Sequence
  chemically synthesized
tgtgagatatgtattattgaac

SEQ ID NO: 138533 - DNA, 22 bp, Artificial Sequence
  chemically synthesized
tgagatatgtattattgaacat

SEQ ID NO: 138534 - DNA, 22 bp, Artificial Sequence
  chemically synthesized
ttgaacatactataattaatac

SEQ ID NO: 138535 - DNA, 22 bp, Artificial Sequence
  chemically synthesized
aacatactataattaatactaa

SEQ ID NO: 138536 - DNA, 22 bp, Artificial Sequence
  chemically synthesized
taattaatactaatgataagta

SEQ ID NO: 138537 - DNA, 22 bp, Artificial Sequence
  chemically synthesized
atactaatgataagtaacacct

SEQ ID NO: 138538 - DNA, 22 bp, Artificial Sequence
  chemically synthesized
atgataagtaacacctcttgag

SEQ ID NO: 138539 - DNA, 22 bp, Artificial Sequence
  chemically synthesized
ttgagtacttagtatatgctag

SEQ ID NO: 138540 - DNA, 22 bp, Artificial Sequence
  chemically synthesized
gagtacttagtatatgctagaa

SEQ ID NO: 138541 - DNA, 22 bp, Artificial Sequence
  chemically synthesized
agtacttagtatatgctagaat

SEQ ID NO: 138542 - DNA, 22 bp, Artificial Sequence
  chemically synthesized
agtatatgctagaatcaaattt

SEQ ID NO: 138543 - DNA, 22 bp, Artificial Sequence
  chemically synthesized
gtatatgctagaatcaaattta

SEQ ID NO: 138544 - DNA, 22 bp, Artificial Sequence
  chemically synthesized
gaatcaaatttaagtttatcat

SEQ ID NO: 138545 - DNA, 22 bp, Artificial Sequence
  chemically synthesized
aagtttatcatatgaggccggg

SEQ ID NO: 138546 - DNA, 22 bp, Artificial Sequence
  chemically synthesized
agtttatcatatgaggccgggc

SEQ ID NO: 138547 - DNA, 22 bp, Artificial Sequence
  chemically synthesized
atcatatgaggccgggcacggt

SEQ ID NO: 138548 - DNA, 22 bp, Artificial Sequence
  chemically synthesized
tcatatgaggccgggcacggtg

SEQ ID NO: 138549 - DNA, 22 bp, Artificial Sequence
  chemically synthesized
atatatgggattacatgcctgt

SEQ ID NO: 138550 - DNA, 22 bp, Artificial Sequence
  chemically synthesized
catgcctgtaatcccagcactt

SEQ ID NO: 138551 - DNA, 22 bp, Artificial Sequence
  chemically synthesized
taatcccagcactttgggaggc

SEQ ID NO: 138552 - DNA, 22 bp, Artificial Sequence
  chemically synthesized
tgggaggccaaggcaattggat

SEQ ID NO: 138553 - DNA, 22 bp, Artificial Sequence
  chemically synthesized
gggaggccaaggcaattggatc

SEQ ID NO: 138554 - DNA, 22 bp, Artificial Sequence
  chemically synthesized
ggaggccaaggcaattggatca

SEQ ID NO: 138555 - DNA, 22 bp, Artificial Sequence
  chemically synthesized
gatcacctgaggtcaggagttc

SEQ ID NO: 138556 - DNA, 22 bp, Artificial Sequence
  chemically synthesized
aggtcaggagttccagaccagc

SEQ ID NO: 138557 - DNA, 22 bp, Artificial Sequence
  chemically synthesized
cagaccagcctggccaacatgg

SEQ ID NO: 138558 - DNA, 22 bp, Artificial Sequence
  chemically synthesized
gccaacatggtgaaaccccttc

SEQ ID NO: 138559 - DNA, 22 bp, Artificial Sequence
  chemically synthesized
ctctactaaaaaatacaaaaaa

SEQ ID NO: 138560 - DNA, 22 bp, Artificial Sequence
  chemically synthesized
tctactaaaaaatacaaaaaat

SEQ ID NO: 138561 - DNA, 22 bp, Artificial Sequence
  chemically synthesized
tactaaaaaatacaaaaaatca

SEQ ID NO: 138562 - DNA, 22 bp, Artificial Sequence
  chemically synthesized
ctaaaaaatacaaaaaatcagc

SEQ ID NO: 138563 - DNA, 22 bp, Artificial Sequence
  chemically synthesized
aaaaatacaaaaaatcagccag

SEQ ID NO: 138564 - DNA, 22 bp, Artificial Sequence
  chemically synthesized
taatcccagctactcaggaggc

SEQ ID NO: 138565 - DNA, 22 bp, Artificial Sequence
  chemically synthesized
ctcaggaggctgaggcaggaga

SEQ ID NO: 138566 - DNA, 22 bp, Artificial Sequence
  chemically synthesized
aggaggctgaggcaggagaatc

SEQ ID NO: 138567 - DNA, 22 bp, Artificial Sequence
  chemically synthesized
aggcaggagaatcacttgaacc

SEQ ID NO: 138568 - DNA, 22 bp, Artificial Sequence
  chemically synthesized
gaacccaggaggtggaggttgc

SEQ ID NO: 138569 - DNA, 22 bp, Artificial Sequence
  chemically synthesized
aacccaggaggtggaggttgca

SEQ ID NO: 138570 - DNA, 22 bp, Artificial Sequence
  chemically synthesized
cagtgagctaagattgcaccac

SEQ ID NO: 138571 - DNA, 22 bp, Artificial Sequence
  chemically synthesized
agattgcaccactgcactccag

SEQ ID NO: 138572 - DNA, 22 bp, Artificial Sequence
  chemically synthesized
caccactgcactccagcctagg

SEQ ID NO: 138573 - DNA, 22 bp, Artificial Sequence
  chemically synthesized
cactccagcctaggcgacagag

SEQ ID NO: 138574 - DNA, 22 bp, Artificial Sequence
  chemically synthesized
cagcctaggcgacagagtgaga

SEQ ID NO: 138575 - DNA, 22 bp, Artificial Sequence
  chemically synthesized
ggcgacagagtgagactccatc

SEQ ID NO: 138576 - DNA, 22 bp, Artificial Sequence
  chemically synthesized
catctcaaaaaaaaaaaaagaa

SEQ ID NO: 138577 - DNA, 22 bp, Artificial Sequence
  chemically synthesized
aaaaaaaaaaaaagaagtttat

SEQ ID NO: 138578 - DNA, 22 bp, Artificial Sequence
  chemically synthesized
attatatgaattaacttagttt

SEQ ID NO: 138579 - DNA, 22 bp, Artificial Sequence
  chemically synthesized
ttatatgaattaacttagtttt

SEQ ID NO: 138580 - DNA, 22 bp, Artificial Sequence
  chemically synthesized
tatgaattaacttagttttact

SEQ ID NO: 138581 - DNA, 22 bp, Artificial Sequence
  chemically synthesized
acttagttttactcacaccaat

SEQ ID NO: 138582 - DNA, 22 bp, Artificial Sequence
  chemically synthesized
agttttactcacaccaatactc

SEQ ID NO: 138583 - DNA, 22 bp, Artificial Sequence
  chemically synthesized
gttttactcacaccaatactca

SEQ ID NO: 138584 - DNA, 22 bp, Artificial Sequence
  chemically synthesized
tactcacaccaatactcagaag

SEQ ID NO: 138585 - DNA, 22 bp, Artificial Sequence
  chemically synthesized
actcacaccaatactcagaagt

SEQ ID NO: 138586 - DNA, 22 bp, Artificial Sequence
  chemically synthesized
ctcacaccaatactcagaagta

SEQ ID NO: 138587 - DNA, 22 bp, Artificial Sequence
  chemically synthesized
acaccaatactcagaagtagat

SEQ ID NO: 138588 - DNA, 22 bp, Artificial Sequence
  chemically synthesized
agaagtagattattacctcatt

SEQ ID NO: 138589 - DNA, 22 bp, Artificial Sequence
  chemically synthesized
ttacctcatttattgatgagga

SEQ ID NO: 138590 - DNA, 22 bp, Artificial Sequence
  chemically synthesized
cctcatttattgatgaggagcc

SEQ ID NO: 138591 - DNA, 22 bp, Artificial Sequence
  chemically synthesized
atttattgatgaggagcccaat

SEQ ID NO: 138592 - DNA, 22 bp, Artificial Sequence
  chemically synthesized
attgatgaggagcccaatgtac

SEQ ID NO: 138593 - DNA, 22 bp, Artificial Sequence
  chemically synthesized
ttgatgaggagcccaatgtact

SEQ ID NO: 138594 - DNA, 22 bp, Artificial Sequence
  chemically synthesized
atgaggagcccaatgtacttgt

SEQ ID NO: 138595 - DNA, 22 bp, Artificial Sequence
  chemically synthesized
gtagtgtagatcaacttattga

SEQ ID NO: 138596 - DNA, 22 bp, Artificial Sequence
  chemically synthesized
tagtgtagatcaacttattgaa

SEQ ID NO: 138597 - DNA, 22 bp, Artificial Sequence
  chemically synthesized
attgaaagcacaagctaataag

SEQ ID NO: 138598 - DNA, 22 bp, Artificial Sequence
  chemically synthesized
ttgaaagcacaagctaataagt

SEQ ID NO: 138599 - DNA, 22 bp, Artificial Sequence
  chemically synthesized
aaagcacaagctaataagtaga

SEQ ID NO: 138600 - DNA, 22 bp, Artificial Sequence
  chemically synthesized
ataagtagacaattagtaatta

SEQ ID NO: 138601 - DNA, 22 bp, Artificial Sequence
  chemically synthesized
gtaattagaagtcagatggtct

SEQ ID NO: 138602 - DNA, 22 bp, Artificial Sequence
  chemically synthesized
gaagtcagatggtctgagctct

SEQ ID NO: 138603 - DNA, 22 bp, Artificial Sequence
  chemically synthesized
agctctcctactgtctacatta

SEQ ID NO: 138604 - DNA, 22 bp, Artificial Sequence
  chemically synthesized
tcctactgtctacattacatga

SEQ ID NO: 138605 - DNA, 22 bp, Artificial Sequence
  chemically synthesized
ctactgtctacattacatgagc

SEQ ID NO: 138606 - DNA, 22 bp, Artificial Sequence
  chemically synthesized
ctgtctacattacatgagctct

SEQ ID NO: 138607 - DNA, 22 bp, Artificial Sequence
  chemically synthesized
tctacattacatgagctcttat

SEQ ID NO: 138608 - DNA, 22 bp, Artificial Sequence
  chemically synthesized
cattacatgagctcttattaac

SEQ ID NO: 138609 - DNA, 22 bp, Artificial Sequence
  chemically synthesized
catgagctcttattaactgggg

SEQ ID NO: 138610 - DNA, 22 bp, Artificial Sequence
  chemically synthesized
ttattaactggggactcgaaaa

SEQ ID NO: 138611 - DNA, 22 bp, Artificial Sequence
  chemically synthesized
attaactggggactcgaaaatc

SEQ ID NO: 138612 - DNA, 22 bp, Artificial Sequence
  chemically synthesized
ttaactggggactcgaaaatca

SEQ ID NO: 138613 - DNA, 22 bp, Artificial Sequence
  chemically synthesized
actggggactcgaaaatcaaag

SEQ ID NO: 138614 - DNA, 22 bp, Artificial Sequence
  chemically synthesized
gggactcgaaaatcaaagacat

SEQ ID NO: 138615 - DNA, 22 bp, Artificial Sequence
  chemically synthesized
gaaaatcaaagacatgaaataa

SEQ ID NO: 138616 - DNA, 22 bp, Artificial Sequence
  chemically synthesized
gtccaagcttacagaaccacca

SEQ ID NO: 138617 - DNA, 22 bp, Artificial Sequence
  chemically synthesized
tccaagcttacagaaccaccaa

SEQ ID NO: 138618 - DNA, 22 bp, Artificial Sequence
  chemically synthesized
acagaaccaccaagtagtaagg

SEQ ID NO: 138619 - DNA, 22 bp, Artificial Sequence
  chemically synthesized
cagaaccaccaagtagtaaggc

SEQ ID NO: 138620 - DNA, 22 bp, Artificial Sequence
  chemically synthesized
ggatgtagacccagttctgcta

SEQ ID NO: 138621 - DNA, 22 bp, Artificial Sequence
  chemically synthesized
tgctacctctgaagacagtgtt

SEQ ID NO: 138622 - DNA, 22 bp, Artificial Sequence
  chemically synthesized
ctacctctgaagacagtgtttt

SEQ ID NO: 138623 - DNA, 22 bp, Artificial Sequence
  chemically synthesized
cctctgaagacagtgttttttc

SEQ ID NO: 138624 - DNA, 22 bp, Artificial Sequence
  chemically synthesized
tgaagacagtgttttttccaca

SEQ ID NO: 138625 - DNA, 22 bp, Artificial Sequence
  chemically synthesized
aagacagtgttttttccacagc

SEQ ID NO: 138626 - DNA, 22 bp, Artificial Sequence
  chemically synthesized
tttccacagcaaaacacaaact

SEQ ID NO: 138627 - DNA, 22 bp, Artificial Sequence
  chemically synthesized
ttccacagcaaaacacaaactc

SEQ ID NO: 138628 - DNA, 22 bp, Artificial Sequence
  chemically synthesized
tccacagcaaaacacaaactca

SEQ ID NO: 138629 - DNA, 22 bp, Artificial Sequence
  chemically synthesized
ccacagcaaaacacaaactcag

SEQ ID NO: 138630 - DNA, 22 bp, Artificial Sequence
  chemically synthesized
cacagcaaaacacaaactcaga

SEQ ID NO: 138631 - DNA, 22 bp, Artificial Sequence
  chemically synthesized
agatattgtggatgcgagaaat

SEQ ID NO: 138632 - DNA, 22 bp, Artificial Sequence
  chemically synthesized
tggatgcgagaaattagaagta

SEQ ID NO: 138633 - DNA, 22 bp, Artificial Sequence
  chemically synthesized
gaagtagatattcctgccctgt

SEQ ID NO: 138634 - DNA, 22 bp, Artificial Sequence
  chemically synthesized
ctgccctgtggcccttgcttct

SEQ ID NO: 138635 - DNA, 22 bp, Artificial Sequence
  chemically synthesized
ccctgtggcccttgcttcttac

SEQ ID NO: 138636 - DNA, 22 bp, Artificial Sequence
  chemically synthesized
tggcccttgcttcttactttta

SEQ ID NO: 138637 - DNA, 22 bp, Artificial Sequence
  chemically synthesized
gcttcttacttttacttcttgt

SEQ ID NO: 138638 - DNA, 22 bp, Artificial Sequence
  chemically synthesized
cttcttacttttacttcttgtc

SEQ ID NO: 138639 - DNA, 22 bp, Artificial Sequence
  chemically synthesized
cttacttttacttcttgtcgat

SEQ ID NO: 138640 - DNA, 22 bp, Artificial Sequence
  chemically synthesized
ttacttttacttcttgtcgatt

SEQ ID NO: 138641 - DNA, 22 bp, Artificial Sequence
  chemically synthesized
acttttacttcttgtcgattgg

SEQ ID NO: 138642 - DNA, 22 bp, Artificial Sequence
  chemically synthesized
cttttacttcttgtcgattgga

SEQ ID NO: 138643 - DNA, 22 bp, Artificial Sequence
  chemically synthesized
ttacttcttgtcgattggaagt

SEQ ID NO: 138644 - DNA, 22 bp, Artificial Sequence
  chemically synthesized
tacttcttgtcgattggaagtt

SEQ ID NO: 138645 - DNA, 22 bp, Artificial Sequence
  chemically synthesized
acttcttgtcgattggaagttg

SEQ ID NO: 138646 - DNA, 22 bp, Artificial Sequence
  chemically synthesized
cttcttgtcgattggaagttgt

SEQ ID NO: 138647 - DNA, 22 bp, Artificial Sequence
  chemically synthesized
cttgtcgattggaagttgtggt

SEQ ID NO: 138648 - DNA, 22 bp, Artificial Sequence
  chemically synthesized
ttgtcgattggaagttgtggtc

SEQ ID NO: 138649 - DNA, 22 bp, Artificial Sequence
  chemically synthesized
gtcgattggaagttgtggtcca

SEQ ID NO: 138650 - DNA, 22 bp, Artificial Sequence
  chemically synthesized
tcgattggaagttgtggtccaa

SEQ ID NO: 138651 - DNA, 22 bp, Artificial Sequence
  chemically synthesized
gaagttgtggtccaagccacag

SEQ ID NO: 138652 - DNA, 22 bp, Artificial Sequence
  chemically synthesized
tggtccaagccacagttgcaga

SEQ ID NO: 138653 - DNA, 22 bp, Artificial Sequence
  chemically synthesized
cagaccatacttcctcaaccat

SEQ ID NO: 138654 - DNA, 22 bp, Artificial Sequence
  chemically synthesized
cctcaaccataattgcatttct

SEQ ID NO: 138655 - DNA, 22 bp, Artificial Sequence
  chemically synthesized
ctcaaccataattgcatttctt

SEQ ID NO: 138656 - DNA, 22 bp, Artificial Sequence
  chemically synthesized
aaccataattgcatttcttcag

SEQ ID NO: 138657 - DNA, 22 bp, Artificial Sequence
  chemically synthesized
catttcttcaggaaagtttgag

SEQ ID NO: 138658 - DNA, 22 bp, Artificial Sequence
  chemically synthesized
cttcaggaaagtttgagggaga

SEQ ID NO: 138659 - DNA, 22 bp, Artificial Sequence
  chemically synthesized
ttcaggaaagtttgagggagaa

SEQ ID NO: 138660 - DNA, 22 bp, Artificial Sequence
  chemically synthesized
caggaaagtttgagggagaaaa

SEQ ID NO: 138661 - DNA, 22 bp, Artificial Sequence
  chemically synthesized
aggaaagtttgagggagaaaaa

SEQ ID NO: 138662 - DNA, 22 bp, Artificial Sequence
  chemically synthesized
gagggagaaaaaggtaaagaaa

SEQ ID NO: 138663 - DNA, 22 bp, Artificial Sequence
  chemically synthesized
agggagaaaaaggtaaagaaaa

SEQ ID NO: 138664 - DNA, 22 bp, Artificial Sequence
  chemically synthesized
agaaacaacttcagaataaaga

SEQ ID NO: 138665 - DNA, 22 bp, Artificial Sequence
  chemically synthesized
gaaacaacttcagaataaagag

SEQ ID NO: 138666 - DNA, 22 bp, Artificial Sequence
  chemically synthesized
cagaataaagagattttctctt

SEQ ID NO: 138667 - DNA, 22 bp, Artificial Sequence
  chemically synthesized
agaataaagagattttctcttg

SEQ ID NO: 138668 - DNA, 22 bp, Artificial Sequence
  chemically synthesized
tctcttgggttacagagattgt

SEQ ID NO: 138669 - DNA, 22 bp, Artificial Sequence
  chemically synthesized
ctcttgggttacagagattgtc

SEQ ID NO: 138670 - DNA, 22 bp, Artificial Sequence
  chemically synthesized
tcttgggttacagagattgtca

SEQ ID NO: 138671 - DNA, 22 bp, Artificial Sequence
  chemically synthesized
ttgggttacagagattgtcata

SEQ ID NO: 138672 - DNA, 22 bp, Artificial Sequence
  chemically synthesized
gggttacagagattgtcatatg

SEQ ID NO: 138673 - DNA, 22 bp, Artificial Sequence
  chemically synthesized
ggttacagagattgtcatatga

SEQ ID NO: 138674 - DNA, 22 bp, Artificial Sequence
  chemically synthesized
cagagattgtcatatgacaaat

SEQ ID NO: 138675 - DNA, 22 bp, Artificial Sequence
  chemically synthesized
tcatatgacaaattataagcag

SEQ ID NO: 138676 - DNA, 22 bp, Artificial Sequence
  chemically synthesized
taagcagacacttgagaaaact

SEQ ID NO: 138677 - DNA, 22 bp, Artificial Sequence
  chemically synthesized
gagaaaactgaaggcccatgcc

SEQ ID NO: 138678 - DNA, 22 bp, Artificial Sequence
  chemically synthesized
agaaaactgaaggcccatgcct

SEQ ID NO: 138679 - DNA, 22 bp, Artificial Sequence
  chemically synthesized
aaggcccatgcctgcccaaatt

SEQ ID NO: 138680 - DNA, 22 bp, Artificial Sequence
  chemically synthesized
cccaaattaccctttgacccct

SEQ ID NO: 138681 - DNA, 22 bp, Artificial Sequence
  chemically synthesized
ccctttgaccccttggtcaagc

SEQ ID NO: 138682 - DNA, 22 bp, Artificial Sequence
  chemically synthesized
tgaccccttggtcaagctgcaa

SEQ ID NO: 138683 - DNA, 22 bp, Artificial Sequence
  chemically synthesized
gaccccttggtcaagctgcaac

SEQ ID NO: 138684 - DNA, 22 bp, Artificial Sequence
  chemically synthesized
accccttggtcaagctgcaact

SEQ ID NO: 138685 - DNA, 22 bp, Artificial Sequence
  chemically synthesized
ggtcaagctgcaactttggtta

SEQ ID NO: 138686 - DNA, 22 bp, Artificial Sequence
  chemically synthesized
gtcaagctgcaactttggttaa

SEQ ID NO: 138687 - DNA, 22 bp, Artificial Sequence
  chemically synthesized
caactttggttaaagggagtgt

SEQ ID NO: 138688 - DNA, 22 bp, Artificial Sequence
  chemically synthesized
tggttaaagggagtgtttatgt

SEQ ID NO: 138689 - DNA, 22 bp, Artificial Sequence
  chemically synthesized
ggttaaagggagtgtttatgtg

SEQ ID NO: 138690 - DNA, 22 bp, Artificial Sequence
  chemically synthesized
gttaaagggagtgtttatgtgt

SEQ ID NO: 138691 - DNA, 22 bp, Artificial Sequence
  chemically synthesized
aagggagtgtttatgtgttata

SEQ ID NO: 138692 - DNA, 22 bp, Artificial Sequence
  chemically synthesized
atgtgttatagtgttcatttac

SEQ ID NO: 138693 - DNA, 22 bp, Artificial Sequence
  chemically synthesized
tgtgttatagtgttcatttact

SEQ ID NO: 138694 - DNA, 22 bp, Artificial Sequence
  chemically synthesized
tagtgttcatttactcttctgg

SEQ ID NO: 138695 - DNA, 22 bp, Artificial Sequence
  chemically synthesized
atttactcttctggtctaaccc

SEQ ID NO: 138696 - DNA, 22 bp, Artificial Sequence
  chemically synthesized
actcttctggtctaacccattg

SEQ ID NO: 138697 - DNA, 22 bp, Artificial Sequence
  chemically synthesized
ctcttctggtctaacccattgg

SEQ ID NO: 138698 - DNA, 22 bp, Artificial Sequence
  chemically synthesized
ttctggtctaacccattggctc

SEQ ID NO: 138699 - DNA, 22 bp, Artificial Sequence
  chemically synthesized
ctggtctaacccattggctccg

SEQ ID NO: 138700 - DNA, 22 bp, Artificial Sequence
  chemically synthesized
tggtctaacccattggctccgt

SEQ ID NO: 138701 - DNA, 22 bp, Artificial Sequence
  chemically synthesized
gtctaacccattggctccgtct

SEQ ID NO: 138702 - DNA, 22 bp, Artificial Sequence
  chemically synthesized
acccattggctccgtcttcatc

SEQ ID NO: 138703 - DNA, 22 bp, Artificial Sequence
  chemically synthesized
gctccgtcttcatcctgcagtg

SEQ ID NO: 138704 - DNA, 22 bp, Artificial Sequence
  chemically synthesized
cgtcttcatcctgcagtgacct

SEQ ID NO: 138705 - DNA, 22 bp, Artificial Sequence
  chemically synthesized
catcctgcagtgacctcagtgc

SEQ ID NO: 138706 - DNA, 22 bp, Artificial Sequence
  chemically synthesized
atcctgcagtgacctcagtgcc

SEQ ID NO: 138707 - DNA, 22 bp, Artificial Sequence
  chemically synthesized
cagtgacctcagtgcctcagaa

SEQ ID NO: 138708 - DNA, 22 bp, Artificial Sequence
  chemically synthesized
agtgcctcagaaacatacatat

SEQ ID NO: 138709 - DNA, 22 bp, Artificial Sequence
  chemically synthesized
agaaacatacatatgtttgtct

SEQ ID NO: 138710 - DNA, 22 bp, Artificial Sequence
  chemically synthesized
gtctagtttaagtttgtgtgaa

SEQ ID NO: 138711 - DNA, 22 bp, Artificial Sequence
  chemically synthesized
tctagtttaagtttgtgtgaaa

SEQ ID NO: 138712 - DNA, 22 bp, Artificial Sequence
  chemically synthesized
gtttaagtttgtgtgaaattct

SEQ ID NO: 138713 - DNA, 22 bp, Artificial Sequence
  chemically synthesized
aagtttgtgtgaaattctaact

SEQ ID NO: 138714 - DNA, 22 bp, Artificial Sequence
  chemically synthesized
agtttgtgtgaaattctaacta

SEQ ID NO: 138715 - DNA, 22 bp, Artificial Sequence
  chemically synthesized
gtgtgaaattctaactagcgtc

SEQ ID NO: 138716 - DNA, 22 bp, Artificial Sequence
  chemically synthesized
tgtgaaattctaactagcgtca

SEQ ID NO: 138717 - DNA, 22 bp, Artificial Sequence
  chemically synthesized
taactagcgtcaagaactgagg

SEQ ID NO: 138718 - DNA, 22 bp, Artificial Sequence
  chemically synthesized
actagcgtcaagaactgagggc

SEQ ID NO: 138719 - DNA, 22 bp, Artificial Sequence
  chemically synthesized
gcgtcaagaactgagggcccta

SEQ ID NO: 138720 - DNA, 22 bp, Artificial Sequence
  chemically synthesized
agggccctaaactatgctagga

SEQ ID NO: 138721 - DNA, 22 bp, Artificial Sequence
  chemically synthesized
aactatgctaggaatagtgctg

SEQ ID NO: 138722 - DNA, 22 bp, Artificial Sequence
  chemically synthesized
tgctaggaatagtgctgtggtg

SEQ ID NO: 138723 - DNA, 22 bp, Artificial Sequence
  chemically synthesized
ggaatagtgctgtggtgctgtg

SEQ ID NO: 138724 - DNA, 22 bp, Artificial Sequence
  chemically synthesized
tggtgctgtgataggtacacaa

SEQ ID NO: 138725 - DNA, 22 bp, Artificial Sequence
  chemically synthesized
tgataggtacacaagaaatgag

SEQ ID NO: 138726 - DNA, 22 bp, Artificial Sequence
  chemically synthesized
cagattctctgcatctcccttt

SEQ ID NO: 138727 - DNA, 22 bp, Artificial Sequence
  chemically synthesized
tctgcatctccctttgccgggt

SEQ ID NO: 138728 - DNA, 22 bp, Artificial Sequence
  chemically synthesized
tgcatctccctttgccgggtct

SEQ ID NO: 138729 - DNA, 22 bp, Artificial Sequence
  chemically synthesized
catctccctttgccgggtctga

SEQ ID NO: 138730 - DNA, 22 bp, Artificial Sequence
  chemically synthesized
cctttgccgggtctgacaacaa

SEQ ID NO: 138731 - DNA, 22 bp, Artificial Sequence
  chemically synthesized
tgccgggtctgacaacaaagtt

SEQ ID NO: 138732 - DNA, 22 bp, Artificial Sequence
  chemically synthesized
gccgggtctgacaacaaagttt

SEQ ID NO: 138733 - DNA, 22 bp, Artificial Sequence
  chemically synthesized
ccgggtctgacaacaaagtttc

SEQ ID NO: 138734 - DNA, 22 bp, Artificial Sequence
  chemically synthesized
acaacaaagtttccccaaattt

SEQ ID NO: 138735 - DNA, 22 bp, Artificial Sequence
  chemically synthesized
ccccaaattttaccaatgcaag

SEQ ID NO: 138736 - DNA, 22 bp, Artificial Sequence
  chemically synthesized
cccaaattttaccaatgcaagc

SEQ ID NO: 138737 - DNA, 22 bp, Artificial Sequence
  chemically synthesized
taccaatgcaagccatttctcc

SEQ ID NO: 138738 - DNA, 22 bp, Artificial Sequence
  chemically synthesized
accaatgcaagccatttctcca

SEQ ID NO: 138739 - DNA, 22 bp, Artificial Sequence
  chemically synthesized
ccaatgcaagccatttctccat

SEQ ID NO: 138740 - DNA, 22 bp, Artificial Sequence
  chemically synthesized
ctccatatgctaactactttaa

SEQ ID NO: 138741 - DNA, 22 bp, Artificial Sequence
  chemically synthesized
tccatatgctaactactttaaa

SEQ ID NO: 138742 - DNA, 22 bp, Artificial Sequence
  chemically synthesized
catatgctaactactttaaaat

SEQ ID NO: 138743 - DNA, 22 bp, Artificial Sequence
  chemically synthesized
actactttaaaatcatttgggg

SEQ ID NO: 138744 - DNA, 22 bp, Artificial Sequence
  chemically synthesized
ctttaaaatcatttggggcttc

SEQ ID NO: 138745 - DNA, 22 bp, Artificial Sequence
  chemically synthesized
taaaatcatttggggcttcaca

SEQ ID NO: 138746 - DNA, 22 bp, Artificial Sequence
  chemically synthesized
aaaatcatttggggcttcacat

SEQ ID NO: 138747 - DNA, 22 bp, Artificial Sequence
  chemically synthesized
aaatcatttggggcttcacatt

SEQ ID NO: 138748 - DNA, 22 bp, Artificial Sequence
  chemically synthesized
ggggcttcacattgtctttctc

SEQ ID NO: 138749 - DNA, 22 bp, Artificial Sequence
  chemically synthesized
gggcttcacattgtctttctca

SEQ ID NO: 138750 - DNA, 22 bp, Artificial Sequence
  chemically synthesized
cacattgtctttctcatctgta

SEQ ID NO: 138751 - DNA, 22 bp, Artificial Sequence
  chemically synthesized
acattgtctttctcatctgtaa

SEQ ID NO: 138752 - DNA, 22 bp, Artificial Sequence
  chemically synthesized
tctttctcatctgtaaaaagaa

SEQ ID NO: 138753 - DNA, 22 bp, Artificial Sequence
  chemically synthesized
tctcatctgtaaaaagaatgga

SEQ ID NO: 138754 - DNA, 22 bp, Artificial Sequence
  chemically synthesized
ctcatctgtaaaaagaatggaa

SEQ ID NO: 138755 - DNA, 22 bp, Artificial Sequence
  chemically synthesized
tcatctgtaaaaagaatggaag

SEQ ID NO: 138756 - DNA, 22 bp, Artificial Sequence
  chemically synthesized
atctgtaaaaagaatggaagaa

SEQ ID NO: 138757 - DNA, 22 bp, Artificial Sequence
  chemically synthesized
taaaaagaatggaagaactcat

SEQ ID NO: 138758 - DNA, 22 bp, Artificial Sequence
  chemically synthesized
attcctacagaactccctatgt

SEQ ID NO: 138759 - DNA, 22 bp, Artificial Sequence
  chemically synthesized
ctacagaactccctatgtcttc

SEQ ID NO: 138760 - DNA, 22 bp, Artificial Sequence
  chemically synthesized
cagaactccctatgtcttccct

SEQ ID NO: 138761 - DNA, 22 bp, Artificial Sequence
  chemically synthesized
cctatgtcttccctgatgggct

SEQ ID NO: 138762 - DNA, 22 bp, Artificial Sequence
  chemically synthesized
tgtcttccctgatgggctagag

SEQ ID NO: 138763 - DNA, 22 bp, Artificial Sequence
  chemically synthesized
ccctgatgggctagagttcctc

SEQ ID NO: 138764 - DNA, 22 bp, Artificial Sequence
  chemically synthesized
cctgatgggctagagttcctct

SEQ ID NO: 138765 - DNA, 22 bp, Artificial Sequence
  chemically synthesized
atgggctagagttcctctttct

SEQ ID NO: 138766 - DNA, 22 bp, Artificial Sequence
  chemically synthesized
gagttcctctttctcaaaaatt

SEQ ID NO: 138767 - DNA, 22 bp, Artificial Sequence
  chemically synthesized
ctctttctcaaaaattagccat

SEQ ID NO: 138768 - DNA, 22 bp, Artificial Sequence
  chemically synthesized
tttctcaaaaattagccattat

SEQ ID NO: 138769 - DNA, 22 bp, Artificial Sequence
  chemically synthesized
tctcaaaaattagccattattg

SEQ ID NO: 138770 - DNA, 22 bp, Artificial Sequence
  chemically synthesized
ctcaaaaattagccattattgt

SEQ ID NO: 138771 - DNA, 22 bp, Artificial Sequence
  chemically synthesized
tcaaaaattagccattattgta

SEQ ID NO: 138772 - DNA, 22 bp, Artificial Sequence
  chemically synthesized
aaaaattagccattattgtatt

SEQ ID NO: 138773 - DNA, 22 bp, Artificial Sequence
  chemically synthesized
gccattattgtatttccttcta

SEQ ID NO: 138774 - DNA, 22 bp, Artificial Sequence
  chemically synthesized
ttgtatttccttctaagccaaa

SEQ ID NO: 138775 - DNA, 22 bp, Artificial Sequence
  chemically synthesized
tatttccttctaagccaaagct

SEQ ID NO: 138776 - DNA, 22 bp, Artificial Sequence
  chemically synthesized
ccttctaagccaaagctcagag

SEQ ID NO: 138777 - DNA, 22 bp, Artificial Sequence
  chemically synthesized
cttctaagccaaagctcagagg

SEQ ID NO: 138778 - DNA, 22 bp, Artificial Sequence
  chemically synthesized
ctaagccaaagctcagaggtct

SEQ ID NO: 138779 - DNA, 22 bp, Artificial Sequence
  chemically synthesized
taagccaaagctcagaggtctt

SEQ ID NO: 138780 - DNA, 22 bp, Artificial Sequence
  chemically synthesized
agccaaagctcagaggtcttgt

SEQ ID NO: 138781 - DNA, 22 bp, Artificial Sequence
  chemically synthesized
agaggtcttgtattgcccagtg

SEQ ID NO: 138782 - DNA, 22 bp, Artificial Sequence
  chemically synthesized
gtattgcccagtgacatgcaca

SEQ ID NO: 138783 - DNA, 22 bp, Artificial Sequence
  chemically synthesized
tattgcccagtgacatgcacac

SEQ ID NO: 138784 - DNA, 22 bp, Artificial Sequence
  chemically synthesized
cccagtgacatgcacactggtc

SEQ ID NO: 138785 - DNA, 22 bp, Artificial Sequence
  chemically synthesized
gtcaaaagtaggctaagtagaa

SEQ ID NO: 138786 - DNA, 22 bp, Artificial Sequence
  chemically synthesized
agtagaagggtactttcacagg

SEQ ID NO: 138787 - DNA, 22 bp, Artificial Sequence
  chemically synthesized
tcacaggaacagagagcaaaag

SEQ ID NO: 138788 - DNA, 22 bp, Artificial Sequence
  chemically synthesized
cacaggaacagagagcaaaaga

SEQ ID NO: 138789 - DNA, 22 bp, Artificial Sequence
  chemically synthesized
acaggaacagagagcaaaagag

SEQ ID NO: 138790 - DNA, 22 bp, Artificial Sequence
  chemically synthesized
caacatgatggcttgttgtcta

SEQ ID NO: 138791 - DNA, 22 bp, Artificial Sequence
  chemically synthesized
gttgtctaaatatctcctaggg

SEQ ID NO: 138792 - DNA, 22 bp, Artificial Sequence
  chemically synthesized
ttgtctaaatatctcctaggga

SEQ ID NO: 138793 - DNA, 22 bp, Artificial Sequence
  chemically synthesized
tctaaatatctcctagggaatt

SEQ ID NO: 138794 - DNA, 22 bp, Artificial Sequence
  chemically synthesized
aatatctcctagggaattattg

SEQ ID NO: 138795 - DNA, 22 bp, Artificial Sequence
  chemically synthesized
ctagggaattattgtgagaggt

SEQ ID NO: 138796 - DNA, 22 bp, Artificial Sequence
  chemically synthesized
gggaattattgtgagaggtctg

SEQ ID NO: 138797 - DNA, 22 bp, Artificial Sequence
  chemically synthesized
ttgtgagaggtctgaatagtgt

SEQ ID NO: 138798 - DNA, 22 bp, Artificial Sequence
  chemically synthesized
tgagaggtctgaatagtgttgt

SEQ ID NO: 138799 - DNA, 22 bp, Artificial Sequence
  chemically synthesized
aatagtgttgtaaaataagctg

SEQ ID NO: 138800 - DNA, 22 bp, Artificial Sequence
  chemically synthesized
taaaataagctgaatctgctgc

SEQ ID NO: 138801 - DNA, 22 bp, Artificial Sequence
  chemically synthesized
aatctgctgccaacattaacag

SEQ ID NO: 138802 - DNA, 22 bp, Artificial Sequence
  chemically synthesized
ctgccaacattaacagtcaaga

SEQ ID NO: 138803 - DNA, 22 bp, Artificial Sequence
  chemically synthesized
ccaacattaacagtcaagaaat

SEQ ID NO: 138804 - DNA, 22 bp, Artificial Sequence
  chemically synthesized
acagtcaagaaatacctccgaa

SEQ ID NO: 138805 - DNA, 22 bp, Artificial Sequence
  chemically synthesized
cgaataactgtacctccaatta

SEQ ID NO: 138806 - DNA, 22 bp, Artificial Sequence
  chemically synthesized
tacctccaattattctttaagg

SEQ ID NO: 138807 - DNA, 22 bp, Artificial Sequence
  chemically synthesized
caattattctttaaggtagcat

SEQ ID NO: 138808 - DNA, 22 bp, Artificial Sequence
  chemically synthesized
ttctttaaggtagcatgcaact

SEQ ID NO: 138809 - DNA, 22 bp, Artificial Sequence
  chemically synthesized
tttaaggtagcatgcaactgta

SEQ ID NO: 138810 - DNA, 22 bp, Artificial Sequence
  chemically synthesized
taaggtagcatgcaactgtaat

SEQ ID NO: 138811 - DNA, 22 bp, Artificial Sequence
  chemically synthesized
aaggtagcatgcaactgtaata

SEQ ID NO: 138812 - DNA, 22 bp, Artificial Sequence
  chemically synthesized
aggtagcatgcaactgtaatag

SEQ ID NO: 138813 - DNA, 22 bp, Artificial Sequence
  chemically synthesized
taatagttgcatgtatatattt

SEQ ID NO: 138814 - DNA, 22 bp, Artificial Sequence
  chemically synthesized
catgtatatatttatcataata

SEQ ID NO: 138815 - DNA, 22 bp, Artificial Sequence
  chemically synthesized
atcataatactgtaacagaaaa

SEQ ID NO: 138816 - DNA, 22 bp, Artificial Sequence
  chemically synthesized
tcataatactgtaacagaaaac

SEQ ID NO: 138817 - DNA, 22 bp, Artificial Sequence
  chemically synthesized
taacagaaaacacttactgaat

SEQ ID NO: 138818 - DNA, 22 bp, Artificial Sequence
  chemically synthesized
actgaatatatactgtgtccct

SEQ ID NO: 138819 - DNA, 22 bp, Artificial Sequence
  chemically synthesized
ctgaatatatactgtgtcccta

SEQ ID NO: 138820 - DNA, 22 bp, Artificial Sequence
  chemically synthesized
aatatatactgtgtccctagtt

SEQ ID NO: 138821 - DNA, 22 bp, Artificial Sequence
  chemically synthesized
tgtccctagttctttacacaat

SEQ ID NO: 138822 - DNA, 22 bp, Artificial Sequence
  chemically synthesized
gttctttacacaataaactaat

SEQ ID NO: 138823 - DNA, 22 bp, Artificial Sequence
  chemically synthesized
tttacacaataaactaatctca

SEQ ID NO: 138824 - DNA, 22 bp, Artificial Sequence
  chemically synthesized
tacacaataaactaatctcatc

SEQ ID NO: 138825 - DNA, 22 bp, Artificial Sequence
  chemically synthesized
acacaataaactaatctcatcc

SEQ ID NO: 138826 - DNA, 22 bp, Artificial Sequence
  chemically synthesized
cacaataaactaatctcatcct

SEQ ID NO: 138827 - DNA, 22 bp, Artificial Sequence
  chemically synthesized
atctcatcctcataattctatt

SEQ ID NO: 138828 - DNA, 22 bp, Artificial Sequence
  chemically synthesized
atcctcataattctattagcta

SEQ ID NO: 138829 - DNA, 22 bp, Artificial Sequence
  chemically synthesized
ataattctattagctaatacat

SEQ ID NO: 138830 - DNA, 22 bp, Artificial Sequence
  chemically synthesized
tattagctaatacatattatca

SEQ ID NO: 138831 - DNA, 22 bp, Artificial Sequence
  chemically synthesized
ttagctaatacatattatcatc

SEQ ID NO: 138832 - DNA, 22 bp, Artificial Sequence
  chemically synthesized
gctaatacatattatcatccta

SEQ ID NO: 138833 - DNA, 22 bp, Artificial Sequence
  chemically synthesized
atacatattatcatcctatatt

SEQ ID NO: 138834 - DNA, 22 bp, Artificial Sequence
  chemically synthesized
tcatcctatatttcagagactt

SEQ ID NO: 138835 - DNA, 22 bp, Artificial Sequence
  chemically synthesized
tatttcagagacttcaagaagt

SEQ ID NO: 138836 - DNA, 22 bp, Artificial Sequence
  chemically synthesized
cagagacttcaagaagttaagc

SEQ ID NO: 138837 - DNA, 22 bp, Artificial Sequence
  chemically synthesized
agagacttcaagaagttaagca

SEQ ID NO: 138838 - DNA, 22 bp, Artificial Sequence
  chemically synthesized
caagaagttaagcaacttgctc

SEQ ID NO: 138839 - DNA, 22 bp, Artificial Sequence
  chemically synthesized
aagaagttaagcaacttgctca

SEQ ID NO: 138840 - DNA, 22 bp, Artificial Sequence
  chemically synthesized
agcaacttgctcaagatcatct

SEQ ID NO: 138841 - DNA, 22 bp, Artificial Sequence
  chemically synthesized
gctcaagatcatctaagaagta

SEQ ID NO: 138842 - DNA, 22 bp, Artificial Sequence
  chemically synthesized
ctcaagatcatctaagaagtag

SEQ ID NO: 138843 - DNA, 22 bp, Artificial Sequence
  chemically synthesized
aagatcatctaagaagtaggtg

SEQ ID NO: 138844 - DNA, 22 bp, Artificial Sequence
  chemically synthesized
agaagtaggtggtatttctggg

SEQ ID NO: 138845 - DNA, 22 bp, Artificial Sequence
  chemically synthesized
ctgggctcatttggcccctcct

SEQ ID NO: 138846 - DNA, 22 bp, Artificial Sequence
  chemically synthesized
tgggctcatttggcccctccta

SEQ ID NO: 138847 - DNA, 22 bp, Artificial Sequence
  chemically synthesized
ggctcatttggcccctcctaat

SEQ ID NO: 138848 - DNA, 22 bp, Artificial Sequence
  chemically synthesized
atttggcccctcctaatctctc

SEQ ID NO: 138849 - DNA, 22 bp, Artificial Sequence
  chemically synthesized
ggcccctcctaatctctcatgg

SEQ ID NO: 138850 - DNA, 22 bp, Artificial Sequence
  chemically synthesized
gcccctcctaatctctcatggc

SEQ ID NO: 138851 - DNA, 22 bp, Artificial Sequence
  chemically synthesized
ctaatctctcatggcaacatgg

SEQ ID NO: 138852 - DNA, 22 bp, Artificial Sequence
  chemically synthesized
atctctcatggcaacatggctg

SEQ ID NO: 138853 - DNA, 22 bp, Artificial Sequence
  chemically synthesized
tcatggcaacatggctgcctaa

SEQ ID NO: 138854 - DNA, 22 bp, Artificial Sequence
  chemically synthesized
atggcaacatggctgcctaaag

SEQ ID NO: 138855 - DNA, 22 bp, Artificial Sequence
  chemically synthesized
cctaaagtgttgattgccttaa

SEQ ID NO: 138856 - DNA, 22 bp, Artificial Sequence
  chemically synthesized
aagtgttgattgccttaattca

SEQ ID NO: 138857 - DNA, 22 bp, Artificial Sequence
  chemically synthesized
attgccttaattcatcagggat

SEQ ID NO: 138858 - DNA, 22 bp, Artificial Sequence
  chemically synthesized
ccttaattcatcagggatgggc

SEQ ID NO: 138859 - DNA, 22 bp, Artificial Sequence
  chemically synthesized
aattcatcagggatgggctcat

SEQ ID NO: 138860 - DNA, 22 bp, Artificial Sequence
  chemically synthesized
attcatcagggatgggctcata

SEQ ID NO: 138861 - DNA, 22 bp, Artificial Sequence
  chemically synthesized
atcagggatgggctcatactca

SEQ ID NO: 138862 - DNA, 22 bp, Artificial Sequence
  chemically synthesized
atactcactgcagaccttaact

SEQ ID NO: 138863 - DNA, 22 bp, Artificial Sequence
  chemically synthesized
actgcagaccttaactggcatc

SEQ ID NO: 138864 - DNA, 22 bp, Artificial Sequence
  chemically synthesized
cagaccttaactggcatcctct

SEQ ID NO: 138865 - DNA, 22 bp, Artificial Sequence
  chemically synthesized
aactggcatcctcttttcttat

SEQ ID NO: 138866 - DNA, 22 bp, Artificial Sequence
  chemically synthesized
actggcatcctcttttcttatg

SEQ ID NO: 138867 - DNA, 22 bp, Artificial Sequence
  chemically synthesized
gcatcctcttttcttatgtgat

SEQ ID NO: 138868 - DNA, 22 bp, Artificial Sequence
  chemically synthesized
ttttcttatgtgatctgcctga

SEQ ID NO: 138869 - DNA, 22 bp, Artificial Sequence
  chemically synthesized
ttcttatgtgatctgcctgacc

SEQ ID NO: 138870 - DNA, 22 bp, Artificial Sequence
  chemically synthesized
tcttatgtgatctgcctgaccc

SEQ ID NO: 138871 - DNA, 22 bp, Artificial Sequence
  chemically synthesized
cttatgtgatctgcctgaccct

SEQ ID NO: 138872 - DNA, 22 bp, Artificial Sequence
  chemically synthesized
ttatgtgatctgcctgacccta

SEQ ID NO: 138873 - DNA, 22 bp, Artificial Sequence
  chemically synthesized
atgtgatctgcctgaccctagt

SEQ ID NO: 138874 - DNA, 22 bp, Artificial Sequence
  chemically synthesized
tgtgatctgcctgaccctagta

SEQ ID NO: 138875 - DNA, 22 bp, Artificial Sequence
  chemically synthesized
cctgaccctagtagacttatga

SEQ ID NO: 138876 - DNA, 22 bp, Artificial Sequence
  chemically synthesized
accctagtagacttatgaaatt

SEQ ID NO: 138877 - DNA, 22 bp, Artificial Sequence
  chemically synthesized
gtagacttatgaaatttctgat

SEQ ID NO: 138878 - DNA, 22 bp, Artificial Sequence
  chemically synthesized
atgaaatttctgatgagaaagg

SEQ ID NO: 138879 - DNA, 22 bp, Artificial Sequence
  chemically synthesized
tgaaatttctgatgagaaagga

SEQ ID NO: 138880 - DNA, 22 bp, Artificial Sequence
  chemically synthesized
ctgatgagaaaggagagaggag

SEQ ID NO: 138881 - DNA, 22 bp, Artificial Sequence
  chemically synthesized
tgatgagaaaggagagaggaga

SEQ ID NO: 138882 - DNA, 22 bp, Artificial Sequence
  chemically synthesized
atgagaaaggagagaggagaaa

SEQ ID NO: 138883 - DNA, 22 bp, Artificial Sequence
  chemically synthesized
actgtgatgagtgatgaaggtg

SEQ ID NO: 138884 - DNA, 22 bp, Artificial Sequence
  chemically synthesized
tgatgagtgatgaaggtgcctt

SEQ ID NO: 138885 - DNA, 22 bp, Artificial Sequence
  chemically synthesized
ctcatctgggtaccagtggggc

SEQ ID NO: 138886 - DNA, 22 bp, Artificial Sequence
  chemically synthesized
tcatctgggtaccagtggggcc

SEQ ID NO: 138887 - DNA, 22 bp, Artificial Sequence
  chemically synthesized
atctgggtaccagtggggcctc

SEQ ID NO: 138888 - DNA, 22 bp, Artificial Sequence
  chemically synthesized
ggtaccagtggggcctctaaga

SEQ ID NO: 138889 - DNA, 22 bp, Artificial Sequence
  chemically synthesized
taagactaagtcactctgtctc

SEQ ID NO: 138890 - DNA, 22 bp, Artificial Sequence
  chemically synthesized
agactaagtcactctgtctcac

SEQ ID NO: 138891 - DNA, 22 bp, Artificial Sequence
  chemically synthesized
agtcactctgtctcactgtgtc

SEQ ID NO: 138892 - DNA, 22 bp, Artificial Sequence
  chemically synthesized
tgtctcactgtgtcttagccag

SEQ ID NO: 138893 - DNA, 22 bp, Artificial Sequence
  chemically synthesized
tctcactgtgtcttagccagtt

SEQ ID NO: 138894 - DNA, 22 bp, Artificial Sequence
  chemically synthesized
actgtgtcttagccagttcctt

SEQ ID NO: 138895 - DNA, 22 bp, Artificial Sequence
  chemically synthesized
tgtcttagccagttccttacag

SEQ ID NO: 138896 - DNA, 22 bp, Artificial Sequence
  chemically synthesized
agccagttccttacagcttgcc

SEQ ID NO: 138897 - DNA, 22 bp, Artificial Sequence
  chemically synthesized
gccagttccttacagcttgccc

SEQ ID NO: 138898 - DNA, 22 bp, Artificial Sequence
  chemically synthesized
cttacagcttgccctgatggga

SEQ ID NO: 138899 - DNA, 22 bp, Artificial Sequence
  chemically synthesized
acagcttgccctgatgggagat

SEQ ID NO: 138900 - DNA, 22 bp, Artificial Sequence
  chemically synthesized
cagcttgccctgatgggagata

SEQ ID NO: 138901 - DNA, 22 bp, Artificial Sequence
  chemically synthesized
gccctgatgggagatagagaat

SEQ ID NO: 138902 - DNA, 22 bp, Artificial Sequence
  chemically synthesized
ccctgatgggagatagagaatg

SEQ ID NO: 138903 - DNA, 22 bp, Artificial Sequence
  chemically synthesized
atgggagatagagaatgggtat

SEQ ID NO: 138904 - DNA, 22 bp, Artificial Sequence
  chemically synthesized
caacaaaaaaataaattttcat

SEQ ID NO: 138905 - DNA, 22 bp, Artificial Sequence
  chemically synthesized
tcatttctcaaggtccaactta

SEQ ID NO: 138906 - DNA, 22 bp, Artificial Sequence
  chemically synthesized
catttctcaaggtccaacttat

SEQ ID NO: 138907 - DNA, 22 bp, Artificial Sequence
  chemically synthesized
atttctcaaggtccaacttatg

SEQ ID NO: 138908 - DNA, 22 bp, Artificial Sequence
  chemically synthesized
ctcaaggtccaacttatgtttt

SEQ ID NO: 138909 - DNA, 22 bp, Artificial Sequence
  chemically synthesized
tcaaggtccaacttatgttttc

SEQ ID NO: 138910 - DNA, 22 bp, Artificial Sequence
  chemically synthesized
aaggtccaacttatgttttctt

SEQ ID NO: 138911 - DNA, 22 bp, Artificial Sequence
  chemically synthesized
atgttttcttaatttttaaaaa

SEQ ID NO: 138912 - DNA, 22 bp, Artificial Sequence
  chemically synthesized
tgttttcttaatttttaaaaaa

SEQ ID NO: 138913 - DNA, 22 bp, Artificial Sequence
  chemically synthesized
tcttaatttttaaaaaaatctt

SEQ ID NO: 138914 - DNA, 22 bp, Artificial Sequence
  chemically synthesized
cttaatttttaaaaaaatcttg

SEQ ID NO: 138915 - DNA, 22 bp, Artificial Sequence
  chemically synthesized
ttaatttttaaaaaaatcttga

SEQ ID NO: 138916 - DNA, 22 bp, Artificial Sequence
  chemically synthesized
aatttttaaaaaaatcttgacc

SEQ ID NO: 138917 - DNA, 22 bp, Artificial Sequence
  chemically synthesized
atttttaaaaaaatcttgacca

SEQ ID NO: 138918 - DNA, 22 bp, Artificial Sequence
  chemically synthesized
ttaaaaaaatcttgaccattct

SEQ ID NO: 138919 - DNA, 22 bp, Artificial Sequence
  chemically synthesized
taaaaaaatcttgaccattctc

SEQ ID NO: 138920 - DNA, 22 bp, Artificial Sequence
  chemically synthesized
aaaaaaatcttgaccattctcc

SEQ ID NO: 138921 - DNA, 22 bp, Artificial Sequence
  chemically synthesized
aaaaaatcttgaccattctcca

SEQ ID NO: 138922 - DNA, 22 bp, Artificial Sequence
  chemically synthesized
gaccattctccactctctaaaa

SEQ ID NO: 138923 - DNA, 22 bp, Artificial Sequence
  chemically synthesized
accattctccactctctaaaat

SEQ ID NO: 138924 - DNA, 22 bp, Artificial Sequence
  chemically synthesized
tccactctctaaaataatccac

SEQ ID NO: 138925 - DNA, 22 bp, Artificial Sequence
  chemically synthesized
cactctctaaaataatccacag

SEQ ID NO: 138926 - DNA, 22 bp, Artificial Sequence
  chemically synthesized
tctaaaataatccacagtgaga

SEQ ID NO: 138927 - DNA, 22 bp, Artificial Sequence
  chemically synthesized
taaaataatccacagtgagaga

SEQ ID NO: 138928 - DNA, 22 bp, Artificial Sequence
  chemically synthesized
aaataatccacagtgagagaaa

SEQ ID NO: 138929 - DNA, 22 bp, Artificial Sequence
  chemically synthesized
ttttcccccatcccataaatac

SEQ ID NO: 138930 - DNA, 22 bp, Artificial Sequence
  chemically synthesized
ttcccccatcccataaatacct

SEQ ID NO: 138931 - DNA, 22 bp, Artificial Sequence
  chemically synthesized
tcccccatcccataaatacctc

SEQ ID NO: 138932 - DNA, 22 bp, Artificial Sequence
  chemically synthesized
cccccatcccataaatacctct

SEQ ID NO: 138933 - DNA, 22 bp, Artificial Sequence
  chemically synthesized
ccccatcccataaatacctcta

SEQ ID NO: 138934 - DNA, 22 bp, Artificial Sequence
  chemically synthesized
tattaaatatggaaaatctggg

SEQ ID NO: 138935 - DNA, 22 bp, Artificial Sequence
  chemically synthesized
ttaaatatggaaaatctgggca

SEQ ID NO: 138936 - DNA, 22 bp, Artificial Sequence
  chemically synthesized
aatatggaaaatctgggcatgg

SEQ ID NO: 138937 - DNA, 22 bp, Artificial Sequence
  chemically synthesized
ggcatggtgtctcacacctgta

SEQ ID NO: 138938 - DNA, 22 bp, Artificial Sequence
  chemically synthesized
acacctgtaatcccagcacttt

SEQ ID NO: 138939 - DNA, 22 bp, Artificial Sequence
  chemically synthesized
taatcccagcactttgggaggc

SEQ ID NO: 138940 - DNA, 22 bp, Artificial Sequence
  chemically synthesized
tgggaggctgaggtgggtggac

SEQ ID NO: 138941 - DNA, 22 bp, Artificial Sequence
  chemically synthesized
gggaggctgaggtgggtggact

SEQ ID NO: 138942 - DNA, 22 bp, Artificial Sequence
  chemically synthesized
ggaggctgaggtgggtggactg

SEQ ID NO: 138943 - DNA, 22 bp, Artificial Sequence
  chemically synthesized
aggtgggtggactgcttggagc

SEQ ID NO: 138944 - DNA, 22 bp, Artificial Sequence
  chemically synthesized
cttggagctcaggagttcaaga

SEQ ID NO: 138945 - DNA, 22 bp, Artificial Sequence
  chemically synthesized
ggagctcaggagttcaagacca

SEQ ID NO: 138946 - DNA, 22 bp, Artificial Sequence
  chemically synthesized
gagctcaggagttcaagaccat

SEQ ID NO: 138947 - DNA, 22 bp, Artificial Sequence
  chemically synthesized
aggagttcaagaccatcttgga

SEQ ID NO: 138948 - DNA, 22 bp, Artificial Sequence
  chemically synthesized
aagaccatcttggacaacatgg

SEQ ID NO: 138949 - DNA, 22 bp, Artificial Sequence
  chemically synthesized
ggacaacatggtgataccctgc

SEQ ID NO: 138950 - DNA, 22 bp, Artificial Sequence
  chemically synthesized
gacaacatggtgataccctgcc

SEQ ID NO: 138951 - DNA, 22 bp, Artificial Sequence
  chemically synthesized
cctctacaaaaagtacaaaaat

SEQ ID NO: 138952 - DNA, 22 bp, Artificial Sequence
  chemically synthesized
tacaaaaagtacaaaaattagc

SEQ ID NO: 138953 - DNA, 22 bp, Artificial Sequence
  chemically synthesized
caaaaagtacaaaaattagcct

SEQ ID NO: 138954 - DNA, 22 bp, Artificial Sequence
  chemically synthesized
gcctggcatggtggtgtgcacc

SEQ ID NO: 138955 - DNA, 22 bp, Artificial Sequence
  chemically synthesized
gcatggtggtgtgcacctgtaa

SEQ ID NO: 138956 - DNA, 22 bp, Artificial Sequence
  chemically synthesized
taatcccagctattagggtggc

SEQ ID NO: 138957 - DNA, 22 bp, Artificial Sequence
  chemically synthesized
ttagggtggctgaggcaggaga

SEQ ID NO: 138958 - DNA, 22 bp, Artificial Sequence
  chemically synthesized
gggtggctgaggcaggagaatt

SEQ ID NO: 138959 - DNA, 22 bp, Artificial Sequence
  chemically synthesized
aggcaggagaattgcttgaacc

SEQ ID NO: 138960 - DNA, 22 bp, Artificial Sequence
  chemically synthesized
cttgaacccgggaggcggaggt

SEQ ID NO: 138961 - DNA, 22 bp, Artificial Sequence
  chemically synthesized
gaacccgggaggcggaggttgc

SEQ ID NO: 138962 - DNA, 22 bp, Artificial Sequence
  chemically synthesized
aacccgggaggcggaggttgca

SEQ ID NO: 138963 - DNA, 22 bp, Artificial Sequence
  chemically synthesized
cagtgagctgagatcgtgccac

SEQ ID NO: 138964 - DNA, 22 bp, Artificial Sequence
  chemically synthesized
agatcgtgccactgcactccag

SEQ ID NO: 138965 - DNA, 22 bp, Artificial Sequence
  chemically synthesized
cactccagcctgggggacagag

SEQ ID NO: 138966 - DNA, 22 bp, Artificial Sequence
  chemically synthesized
cagcctgggggacagagcacat

SEQ ID NO: 138967 - DNA, 22 bp, Artificial Sequence
  chemically synthesized
ggggacagagcacattataatt

SEQ ID NO: 138968 - DNA, 22 bp, Artificial Sequence
  chemically synthesized
taattaactgttattttttact

SEQ ID NO: 138969 - DNA, 22 bp, Artificial Sequence
  chemically synthesized
actgttattttttacttggact

SEQ ID NO: 138970 - DNA, 22 bp, Artificial Sequence
  chemically synthesized
ttattttttacttggactcttg

SEQ ID NO: 138971 - DNA, 22 bp, Artificial Sequence
  chemically synthesized
ttttttacttggactcttgtgg

SEQ ID NO: 138972 - DNA, 22 bp, Artificial Sequence
  chemically synthesized
tttacttggactcttgtgggga

SEQ ID NO: 138973 - DNA, 22 bp, Artificial Sequence
  chemically synthesized
ttacttggactcttgtggggaa

SEQ ID NO: 138974 - DNA, 22 bp, Artificial Sequence
  chemically synthesized
tacttggactcttgtggggaat

SEQ ID NO: 138975 - DNA, 22 bp, Artificial Sequence
  chemically synthesized
acttggactcttgtggggaata

SEQ ID NO: 138976 - DNA, 22 bp, Artificial Sequence
  chemically synthesized
cttggactcttgtggggaataa

SEQ ID NO: 138977 - DNA, 22 bp, Artificial Sequence
  chemically synthesized
ggactcttgtggggaataagat

SEQ ID NO: 138978 - DNA, 22 bp, Artificial Sequence
  chemically synthesized
gactcttgtggggaataagata

SEQ ID NO: 138979 - DNA, 22 bp, Artificial Sequence
  chemically synthesized
ttgtggggaataagatacatgt

SEQ ID NO: 138980 - DNA, 22 bp, Artificial Sequence
  chemically synthesized
gtggggaataagatacatgttt

SEQ ID NO: 138981 - DNA, 22 bp, Artificial Sequence
  chemically synthesized
tggggaataagatacatgtttt

SEQ ID NO: 138982 - DNA, 22 bp, Artificial Sequence
  chemically synthesized
tattcttatttatgattcaagc

SEQ ID NO: 138983 - DNA, 22 bp, Artificial Sequence
  chemically synthesized
attcttatttatgattcaagca

SEQ ID NO: 138984 - DNA, 22 bp, Artificial Sequence
  chemically synthesized
ttcttatttatgattcaagcac

SEQ ID NO: 138985 - DNA, 22 bp, Artificial Sequence
  chemically synthesized
ttatttatgattcaagcactga

SEQ ID NO: 138986 - DNA, 22 bp, Artificial Sequence
  chemically synthesized
atttatgattcaagcactgaaa

SEQ ID NO: 138987 - DNA, 22 bp, Artificial Sequence
  chemically synthesized
tttatgattcaagcactgaaaa

SEQ ID NO: 138988 - DNA, 22 bp, Artificial Sequence
  chemically synthesized
atgattcaagcactgaaaatag

SEQ ID NO: 138989 - DNA, 22 bp, Artificial Sequence
  chemically synthesized
tgattcaagcactgaaaatagt

SEQ ID NO: 138990 - DNA, 22 bp, Artificial Sequence
  chemically synthesized
aagcactgaaaatagtgtttag

SEQ ID NO: 138991 - DNA, 22 bp, Artificial Sequence
  chemically synthesized
aaaatagtgtttagcatccagc

SEQ ID NO: 138992 - DNA, 22 bp, Artificial Sequence
  chemically synthesized
agcatccagcaggtgcttcaaa

SEQ ID NO: 138993 - DNA, 22 bp, Artificial Sequence
  chemically synthesized
gcatccagcaggtgcttcaaaa

SEQ ID NO: 138994 - DNA, 22 bp, Artificial Sequence
  chemically synthesized
caaaaccatttgctgaatgatt

SEQ ID NO: 138995 - DNA, 22 bp, Artificial Sequence
  chemically synthesized
aaaaccatttgctgaatgatta

SEQ ID NO: 138996 - DNA, 22 bp, Artificial Sequence
  chemically synthesized
gctgaatgattactatactttt

SEQ ID NO: 138997 - DNA, 22 bp, Artificial Sequence
  chemically synthesized
ctgaatgattactatacttttt

SEQ ID NO: 138998 - DNA, 22 bp, Artificial Sequence
  chemically synthesized
aatgattactatactttttaca

SEQ ID NO: 138999 - DNA, 22 bp, Artificial Sequence
  chemically synthesized
ctatactttttacaagctcagc

SEQ ID NO: 139000 - DNA, 22 bp, Artificial Sequence
  chemically synthesized
tactttttacaagctcagctcc

SEQ ID NO: 139001 - DNA, 22 bp, Artificial Sequence
  chemically synthesized
tttacaagctcagctccctcta

SEQ ID NO: 139002 - DNA, 22 bp, Artificial Sequence
  chemically synthesized
ttacaagctcagctccctctat

SEQ ID NO: 139003 - DNA, 22 bp, Artificial Sequence
  chemically synthesized
tacaagctcagctccctctatc

SEQ ID NO: 139004 - DNA, 22 bp, Artificial Sequence
  chemically synthesized
acaagctcagctccctctatcc

SEQ ID NO: 139005 - DNA, 22 bp, Artificial Sequence
  chemically synthesized
caagctcagctccctctatccc

SEQ ID NO: 139006 - DNA, 22 bp, Artificial Sequence
  chemically synthesized
agctccctctatcccttccagc

SEQ ID NO: 139007 - DNA, 22 bp, Artificial Sequence
  chemically synthesized
cctctatcccttccagcatcct

SEQ ID NO: 139008 - DNA, 22 bp, Artificial Sequence
  chemically synthesized
tatcccttccagcatcctcatc

SEQ ID NO: 139009 - DNA, 22 bp, Artificial Sequence
  chemically synthesized
tcccttccagcatcctcatctc

SEQ ID NO: 139010 - DNA, 22 bp, Artificial Sequence
  chemically synthesized
ccagcatcctcatctctgatta

SEQ ID NO: 139011 - DNA, 22 bp, Artificial Sequence
  chemically synthesized
cagcatcctcatctctgattaa

SEQ ID NO: 139012 - DNA, 22 bp, Artificial Sequence
  chemically synthesized
atctctgattaaataagcttca

SEQ ID NO: 139013 - DNA, 22 bp, Artificial Sequence
  chemically synthesized
tgattaaataagcttcagtttt

SEQ ID NO: 139014 - DNA, 22 bp, Artificial Sequence
  chemically synthesized
attaaataagcttcagtttttc

SEQ ID NO: 139015 - DNA, 22 bp, Artificial Sequence
  chemically synthesized
aataagcttcagtttttcctta

SEQ ID NO: 139016 - DNA, 22 bp, Artificial Sequence
  chemically synthesized
cagtttttccttagttcctgtt

SEQ ID NO: 139017 - DNA, 22 bp, Artificial Sequence
  chemically synthesized
agtttttccttagttcctgtta

SEQ ID NO: 139018 - DNA, 22 bp, Artificial Sequence
  chemically synthesized
ttccttagttcctgttacattt

SEQ ID NO: 139019 - DNA, 22 bp, Artificial Sequence
  chemically synthesized
tccttagttcctgttacatttc

SEQ ID NO: 139020 - DNA, 22 bp, Artificial Sequence
  chemically synthesized
ccttagttcctgttacatttct

SEQ ID NO: 139021 - DNA, 22 bp, Artificial Sequence
  chemically synthesized
cttagttcctgttacatttctg

SEQ ID NO: 139022 - DNA, 22 bp, Artificial Sequence
  chemically synthesized
agttcctgttacatttctgtgt

SEQ ID NO: 139023 - DNA, 22 bp, Artificial Sequence
  chemically synthesized
gttcctgttacatttctgtgtg

SEQ ID NO: 139024 - DNA, 22 bp, Artificial Sequence
  chemically synthesized
ctgttacatttctgtgtgtctc

SEQ ID NO: 139025 - DNA, 22 bp, Artificial Sequence
  chemically synthesized
ttacatttctgtgtgtctccat

SEQ ID NO: 139026 - DNA, 22 bp, Artificial Sequence
  chemically synthesized
catttctgtgtgtctccattag

SEQ ID NO: 139027 - DNA, 22 bp, Artificial Sequence
  chemically synthesized
ctgtgtgtctccattagtgacc

SEQ ID NO: 139028 - DNA, 22 bp, Artificial Sequence
  chemically synthesized
tgtgtgtctccattagtgacct

SEQ ID NO: 139029 - DNA, 22 bp, Artificial Sequence
  chemically synthesized
tgtgtctccattagtgacctcc

SEQ ID NO: 139030 - DNA, 22 bp, Artificial Sequence
  chemically synthesized
cattagtgacctcccatagtcc

SEQ ID NO: 139031 - DNA, 22 bp, Artificial Sequence
  chemically synthesized
gtgacctcccatagtccaagca

SEQ ID NO: 139032 - DNA, 22 bp, Artificial Sequence
  chemically synthesized
ccatagtccaagcatgagcagt

SEQ ID NO: 139033 - DNA, 22 bp, Artificial Sequence
  chemically synthesized
tggccaggcccctgtcggggtc

SEQ ID NO: 139034 - DNA, 22 bp, Artificial Sequence
  chemically synthesized
gccaggcccctgtcggggtcag

SEQ ID NO: 139035 - DNA, 22 bp, Artificial Sequence
  chemically synthesized
tcggggtcagtgccccaccccc

SEQ ID NO: 139036 - DNA, 22 bp, Artificial Sequence
  chemically synthesized
ctggttctgtgtaaccttctaa

SEQ ID NO: 139037 - DNA, 22 bp, Artificial Sequence
  chemically synthesized
tggttctgtgtaaccttctaag

SEQ ID NO: 139038 - DNA, 22 bp, Artificial Sequence
  chemically synthesized
gttctgtgtaaccttctaagca

SEQ ID NO: 139039 - DNA, 22 bp, Artificial Sequence
  chemically synthesized
tgtgtaaccttctaagcaaacc

SEQ ID NO: 139040 - DNA, 22 bp, Artificial Sequence
  chemically synthesized
tgtaaccttctaagcaaacctt

SEQ ID NO: 139041 - DNA, 22 bp, Artificial Sequence
  chemically synthesized
ctaagcaaaccttctggctcaa

SEQ ID NO: 139042 - DNA, 22 bp, Artificial Sequence
  chemically synthesized
taagcaaaccttctggctcaag

SEQ ID NO: 139043 - DNA, 22 bp, Artificial Sequence
  chemically synthesized
agcaaaccttctggctcaagca

SEQ ID NO: 139044 - DNA, 22 bp, Artificial Sequence
  chemically synthesized
ctggctcaagcacagcaatgct

SEQ ID NO: 139045 - DNA, 22 bp, Artificial Sequence
  chemically synthesized
tggctcaagcacagcaatgctg

SEQ ID NO: 139046 - DNA, 22 bp, Artificial Sequence
  chemically synthesized
gctcaagcacagcaatgctgag

SEQ ID NO: 139047 - DNA, 22 bp, Artificial Sequence
  chemically synthesized
aagcacagcaatgctgagtcat

SEQ ID NO: 139048 - DNA, 22 bp, Artificial Sequence
  chemically synthesized
agtcatgatgagtcatgctgag

SEQ ID NO: 139049 - DNA, 22 bp, Artificial Sequence
  chemically synthesized
aggcttagggtgtgtgcccaga

SEQ ID NO: 139050 - DNA, 22 bp, Artificial Sequence
  chemically synthesized
agggtgtgtgcccagatgttct

SEQ ID NO: 139051 - DNA, 22 bp, Artificial Sequence
  chemically synthesized
gggtgtgtgcccagatgttctc

SEQ ID NO: 139052 - DNA, 22 bp, Artificial Sequence
  chemically synthesized
tcagcctagagtgatgactcct

SEQ ID NO: 139053 - DNA, 22 bp, Artificial Sequence
  chemically synthesized
agcctagagtgatgactcctat

SEQ ID NO: 139054 - DNA, 22 bp, Artificial Sequence
  chemically synthesized
gagtgatgactcctatctgggt

SEQ ID NO: 139055 - DNA, 22 bp, Artificial Sequence
  chemically synthesized
ctatctgggtccccagcaggat

SEQ ID NO: 139056 - DNA, 22 bp, Artificial Sequence
  chemically synthesized
tctgggtccccagcaggatgct

SEQ ID NO: 139057 - DNA, 22 bp, Artificial Sequence
  chemically synthesized
ggtccccagcaggatgcttaca

SEQ ID NO: 139058 - DNA, 22 bp, Artificial Sequence
  chemically synthesized
acagggcagatggcaaaaaaaa

SEQ ID NO: 139059 - DNA, 22 bp, Artificial Sequence
  chemically synthesized
cagggcagatggcaaaaaaaag

SEQ ID NO: 139060 - DNA, 22 bp, Artificial Sequence
  chemically synthesized
accacctgactaaaactccacc

SEQ ID NO: 139061 - DNA, 22 bp, Artificial Sequence
  chemically synthesized
actaaaactccacctcaaacgg

SEQ ID NO: 139062 - DNA, 22 bp, Artificial Sequence
  chemically synthesized
aaactccacctcaaacggcatc

SEQ ID NO: 139063 - DNA, 22 bp, Artificial Sequence
  chemically synthesized
cacctcaaacggcatcataaag

SEQ ID NO: 139064 - DNA, 22 bp, Artificial Sequence
  chemically synthesized
aaacggcatcataaagaaaatg

SEQ ID NO: 139065 - DNA, 22 bp, Artificial Sequence
  chemically synthesized
agacagaatgtgacatattcta

SEQ ID NO: 139066 - DNA, 22 bp, Artificial Sequence
  chemically synthesized
tagaatatattatttcctgaat

SEQ ID NO: 139067 - DNA, 22 bp, Artificial Sequence
  chemically synthesized
gaatatattatttcctgaatat

SEQ ID NO: 139068 - DNA, 22 bp, Artificial Sequence
  chemically synthesized
tttcctgaatatatatatatat

SEQ ID NO: 139069 - DNA, 22 bp, Artificial Sequence
  chemically synthesized
cctgaatatatatatatatata

SEQ ID NO: 139070 - DNA, 22 bp, Artificial Sequence
  chemically synthesized
ctgaatatatatatatatatac

SEQ ID NO: 139071 - DNA, 22 bp, Artificial Sequence
  chemically synthesized
aatatatatatatatatacaca

SEQ ID NO: 139072 - DNA, 22 bp, Artificial Sequence
  chemically synthesized
gttgttatcaattgccatagaa

SEQ ID NO: 139073 - DNA, 22 bp, Artificial Sequence
  chemically synthesized
ttgttatcaattgccatagaat

SEQ ID NO: 139074 - DNA, 22 bp, Artificial Sequence
  chemically synthesized
ttatcaattgccatagaatgat

SEQ ID NO: 139075 - DNA, 22 bp, Artificial Sequence
  chemically synthesized
tcaattgccatagaatgattag

SEQ ID NO: 139076 - DNA, 22 bp, Artificial Sequence
  chemically synthesized
ccatagaatgattagttattgt

SEQ ID NO: 139077 - DNA, 22 bp, Artificial Sequence
  chemically synthesized
gttattgtgaatcaaatattta

SEQ ID NO: 139078 - DNA, 22 bp, Artificial Sequence
  chemically synthesized
ttgtgaatcaaatatttatctt

SEQ ID NO: 139079 - DNA, 22 bp, Artificial Sequence
  chemically synthesized
tgaatcaaatatttatcttgca

SEQ ID NO: 139080 - DNA, 22 bp, Artificial Sequence
  chemically synthesized
atcttgcaggtggcctctatac

SEQ ID NO: 139081 - DNA, 22 bp, Artificial Sequence
  chemically synthesized
tcttgcaggtggcctctatacc

SEQ ID NO: 139082 - DNA, 22 bp, Artificial Sequence
  chemically synthesized
gcaggtggcctctatacctaga

SEQ ID NO: 139083 - DNA, 22 bp, Artificial Sequence
  chemically synthesized
caggtggcctctatacctagaa

SEQ ID NO: 139084 - DNA, 22 bp, Artificial Sequence
  chemically synthesized
tatacctagaagcggcagaatc

SEQ ID NO: 139085 - DNA, 22 bp, Artificial Sequence
  chemically synthesized
tacctagaagcggcagaatcag

SEQ ID NO: 139086 - DNA, 22 bp, Artificial Sequence
  chemically synthesized
gaagcggcagaatcaggcttta

SEQ ID NO: 139087 - DNA, 22 bp, Artificial Sequence
  chemically synthesized
tattaatacatgtgtatagatt

SEQ ID NO: 139088 - DNA, 22 bp, Artificial Sequence
  chemically synthesized
attaatacatgtgtatagattt

SEQ ID NO: 139089 - DNA, 22 bp, Artificial Sequence
  chemically synthesized
ttaatacatgtgtatagatttt

SEQ ID NO: 139090 - DNA, 22 bp, Artificial Sequence
  chemically synthesized
atacatgtgtatagatttttag

SEQ ID NO: 139091 - DNA, 22 bp, Artificial Sequence
  chemically synthesized
ttaggatctatacacatgtatt

SEQ ID NO: 139092 - DNA, 22 bp, Artificial Sequence
  chemically synthesized
taggatctatacacatgtatta

SEQ ID NO: 139093 - DNA, 22 bp, Artificial Sequence
  chemically synthesized
aggatctatacacatgtattaa

SEQ ID NO: 139094 - DNA, 22 bp, Artificial Sequence
  chemically synthesized
ggatctatacacatgtattaat

SEQ ID NO: 139095 - DNA, 22 bp, Artificial Sequence
  chemically synthesized
tacacatgtattaatatgaaac

SEQ ID NO: 139096 - DNA, 22 bp, Artificial Sequence
  chemically synthesized
atatgaaacaaggatatggaag

SEQ ID NO: 139097 - DNA, 22 bp, Artificial Sequence
  chemically synthesized
gtttgccattttaaggcacccc

SEQ ID NO: 139098 - DNA, 22 bp, Artificial Sequence
  chemically synthesized
tttgccattttaaggcacccct

SEQ ID NO: 139099 - DNA, 22 bp, Artificial Sequence
  chemically synthesized
gccattttaaggcacccctgga

SEQ ID NO: 139100 - DNA, 22 bp, Artificial Sequence
  chemically synthesized
ccattttaaggcacccctggac

SEQ ID NO: 139101 - DNA, 22 bp, Artificial Sequence
  chemically synthesized
taaggcacccctggacagctag

SEQ ID NO: 139102 - DNA, 22 bp, Artificial Sequence
  chemically synthesized
aaggcacccctggacagctagg

SEQ ID NO: 139103 - DNA, 22 bp, Artificial Sequence
  chemically synthesized
aggcacccctggacagctaggt

SEQ ID NO: 139104 - DNA, 22 bp, Artificial Sequence
  chemically synthesized
gacagctaggtggcaaaaggcc

SEQ ID NO: 139105 - DNA, 22 bp, Artificial Sequence
  chemically synthesized
ggtggcaaaaggcctgtgctgt

SEQ ID NO: 139106 - DNA, 22 bp, Artificial Sequence
  chemically synthesized
tgctgttagaggacacatgctc

SEQ ID NO: 139107 - DNA, 22 bp, Artificial Sequence
  chemically synthesized
ttagaggacacatgctcacata

SEQ ID NO: 139108 - DNA, 22 bp, Artificial Sequence
  chemically synthesized
gaggacacatgctcacatacgg

SEQ ID NO: 139109 - DNA, 22 bp, Artificial Sequence
  chemically synthesized
acatacggggtcagatctgact

SEQ ID NO: 139110 - DNA, 22 bp, Artificial Sequence
  chemically synthesized
acttggggtgctactgggaagc

SEQ ID NO: 139111 - DNA, 22 bp, Artificial Sequence
  chemically synthesized
ggggtgctactgggaagctctc

SEQ ID NO: 139112 - DNA, 22 bp, Artificial Sequence
  chemically synthesized
gggtgctactgggaagctctca

SEQ ID NO: 139113 - DNA, 22 bp, Artificial Sequence
  chemically synthesized
ctgggaagctctcatcttaagg

SEQ ID NO: 139114 - DNA, 22 bp, Artificial Sequence
  chemically synthesized
ggaagctctcatcttaaggata

SEQ ID NO: 139115 - DNA, 22 bp, Artificial Sequence
  chemically synthesized
tcatcttaaggatacatctcag

SEQ ID NO: 139116 - DNA, 22 bp, Artificial Sequence
  chemically synthesized
atcttaaggatacatctcaggc

SEQ ID NO: 139117 - DNA, 22 bp, Artificial Sequence
  chemically synthesized
aaggatacatctcaggccagtc

SEQ ID NO: 139118 - DNA, 22 bp, Artificial Sequence
  chemically synthesized
aggatacatctcaggccagtct

SEQ ID NO: 139119 - DNA, 22 bp, Artificial Sequence
  chemically synthesized
aggccagtcttggtgcattagg

SEQ ID NO: 139120 - DNA, 22 bp, Artificial Sequence
  chemically synthesized
ggtgcattaggaagatgtaggc

SEQ ID NO: 139121 - DNA, 22 bp, Artificial Sequence
  chemically synthesized
gtgcattaggaagatgtaggca

SEQ ID NO: 139122 - DNA, 22 bp, Artificial Sequence
  chemically synthesized
ggaagatgtaggcaactctgat

SEQ ID NO: 139123 - DNA, 22 bp, Artificial Sequence
  chemically synthesized
tgatcctgagaggaaagaaaca

SEQ ID NO: 139124 - DNA, 22 bp, Artificial Sequence
  chemically synthesized
atcctgagaggaaagaaacatt

SEQ ID NO: 139125 - DNA, 22 bp, Artificial Sequence
  chemically synthesized
agaggaaagaaacattcctcca

SEQ ID NO: 139126 - DNA, 22 bp, Artificial Sequence
  chemically synthesized
ctccaggagagctaaaagggtt

SEQ ID NO: 139127 - DNA, 22 bp, Artificial Sequence
  chemically synthesized
caggagagctaaaagggttcac

SEQ ID NO: 139128 - DNA, 22 bp, Artificial Sequence
  chemically synthesized
aaagggttcacctgtgtgggta

SEQ ID NO: 139129 - DNA, 22 bp, Artificial Sequence
  chemically synthesized
acctgtgtgggtaactgtgaag

SEQ ID NO: 139130 - DNA, 22 bp, Artificial Sequence
  chemically synthesized
tgtgggtaactgtgaaggacta

SEQ ID NO: 139131 - DNA, 22 bp, Artificial Sequence
  chemically synthesized
tgaaggactacaagaggatgaa

SEQ ID NO: 139132 - DNA, 22 bp, Artificial Sequence
  chemically synthesized
caagaggatgaaaaacaatgac

SEQ ID NO: 139133 - DNA, 22 bp, Artificial Sequence
  chemically synthesized
gtgggagaaaaaacaggaggtc

SEQ ID NO: 139134 - DNA, 22 bp, Artificial Sequence
  chemically synthesized
tgggagaaaaaacaggaggtca

SEQ ID NO: 139135 - DNA, 22 bp, Artificial Sequence
  chemically synthesized
ccagaagaatggctttgaagct

SEQ ID NO: 139136 - DNA, 22 bp, Artificial Sequence
  chemically synthesized
cagaagaatggctttgaagctg

SEQ ID NO: 139137 - DNA, 22 bp, Artificial Sequence
  chemically synthesized
tgaagctggcttctgtaggagt

SEQ ID NO: 139138 - DNA, 22 bp, Artificial Sequence
  chemically synthesized
gaagctggcttctgtaggagtt

SEQ ID NO: 139139 - DNA, 22 bp, Artificial Sequence
  chemically synthesized
aagctggcttctgtaggagttc

SEQ ID NO: 139140 - DNA, 22 bp, Artificial Sequence
  chemically synthesized
gcttctgtaggagttcacagtg

SEQ ID NO: 139141 - DNA, 22 bp, Artificial Sequence
  chemically synthesized
ctgtaggagttcacagtggcaa

SEQ ID NO: 139142 - DNA, 22 bp, Artificial Sequence
  chemically synthesized
tgtaggagttcacagtggcaaa

SEQ ID NO: 139143 - DNA, 22 bp, Artificial Sequence
  chemically synthesized
taggagttcacagtggcaaaga

SEQ ID NO: 139144 - DNA, 22 bp, Artificial Sequence
  chemically synthesized
acagtggcaaagatgtttcaga

SEQ ID NO: 139145 - DNA, 22 bp, Artificial Sequence
  chemically synthesized
cagaaatgtgacatgacttaag

SEQ ID NO: 139146 - DNA, 22 bp, Artificial Sequence
  chemically synthesized
agaaatgtgacatgacttaagg

SEQ ID NO: 139147 - DNA, 22 bp, Artificial Sequence
  chemically synthesized
aaggaactatacaaaaaggaac

SEQ ID NO: 139148 - DNA, 22 bp, Artificial Sequence
  chemically synthesized
aggaactatacaaaaaggaaca

SEQ ID NO: 139149 - DNA, 22 bp, Artificial Sequence
  chemically synthesized
tacaaaaaggaacaaatttaag

SEQ ID NO: 139150 - DNA, 22 bp, Artificial Sequence
  chemically synthesized
aaggagaggcagataaattagt

SEQ ID NO: 139151 - DNA, 22 bp, Artificial Sequence
  chemically synthesized
aggagaggcagataaattagtt

SEQ ID NO: 139152 - DNA, 22 bp, Artificial Sequence
  chemically synthesized
gttcaacagacatgcaaggaat

SEQ ID NO: 139153 - DNA, 22 bp, Artificial Sequence
  chemically synthesized
aacagacatgcaaggaattttc

SEQ ID NO: 139154 - DNA, 22 bp, Artificial Sequence
  chemically synthesized
tcagatgaatgttatgtctcca

SEQ ID NO: 139155 - DNA, 22 bp, Artificial Sequence
  chemically synthesized
cagatgaatgttatgtctccac

SEQ ID NO: 139156 - DNA, 22 bp, Artificial Sequence
  chemically synthesized
agatgaatgttatgtctccact

SEQ ID NO: 139157 - DNA, 22 bp, Artificial Sequence
  chemically synthesized
tgtctccactgagcttcttgag

SEQ ID NO: 139158 - DNA, 22 bp, Artificial Sequence
  chemically synthesized
cactgagcttcttgaggttagc

SEQ ID NO: 139159 - DNA, 22 bp, Artificial Sequence
  chemically synthesized
agcttcttgaggttagcagctg

SEQ ID NO: 139160 - DNA, 22 bp, Artificial Sequence
  chemically synthesized
cttgaggttagcagctgtgagg

SEQ ID NO: 139161 - DNA, 22 bp, Artificial Sequence
  chemically synthesized
ttgaggttagcagctgtgaggg

SEQ ID NO: 139162 - DNA, 22 bp, Artificial Sequence
  chemically synthesized
gaggttagcagctgtgagggtt

SEQ ID NO: 139163 - DNA, 22 bp, Artificial Sequence
  chemically synthesized
aggttagcagctgtgagggttt

SEQ ID NO: 139164 - DNA, 22 bp, Artificial Sequence
  chemically synthesized
gcagctgtgagggttttgcagg

SEQ ID NO: 139165 - DNA, 22 bp, Artificial Sequence
  chemically synthesized
tgagggttttgcaggcccagga

SEQ ID NO: 139166 - DNA, 22 bp, Artificial Sequence
  chemically synthesized
tgcaggcccaggacccattaca

SEQ ID NO: 139167 - DNA, 22 bp, Artificial Sequence
  chemically synthesized
gcaggcccaggacccattacag

SEQ ID NO: 139168 - DNA, 22 bp, Artificial Sequence
  chemically synthesized
caggcccaggacccattacagg

SEQ ID NO: 139169 - DNA, 22 bp, Artificial Sequence
  chemically synthesized
caggacctcacgtatacttgac

SEQ ID NO: 139170 - DNA, 22 bp, Artificial Sequence
  chemically synthesized
acgtatacttgacactgttttt

SEQ ID NO: 139171 - DNA, 22 bp, Artificial Sequence
  chemically synthesized
gacactgttttttgtattcatt

SEQ ID NO: 139172 - DNA, 22 bp, Artificial Sequence
  chemically synthesized
acactgttttttgtattcattt

SEQ ID NO: 139173 - DNA, 22 bp, Artificial Sequence
  chemically synthesized
ttttttgtattcatttgtgaat

SEQ ID NO: 139174 - DNA, 22 bp, Artificial Sequence
  chemically synthesized
tttgtattcatttgtgaatgaa

SEQ ID NO: 139175 - DNA, 22 bp, Artificial Sequence
  chemically synthesized
ttgtattcatttgtgaatgaat

SEQ ID NO: 139176 - DNA, 22 bp, Artificial Sequence
  chemically synthesized
tgtattcatttgtgaatgaatg

SEQ ID NO: 139177 - DNA, 22 bp, Artificial Sequence
  chemically synthesized
gtattcatttgtgaatgaatga

SEQ ID NO: 139178 - DNA, 22 bp, Artificial Sequence
  chemically synthesized
tattcatttgtgaatgaatgac

SEQ ID NO: 139179 - DNA, 22 bp, Artificial Sequence
  chemically synthesized
atttgtgaatgaatgacctctt

SEQ ID NO: 139180 - DNA, 22 bp, Artificial Sequence
  chemically synthesized
gtgaatgaatgacctcttgtca

SEQ ID NO: 139181 - DNA, 22 bp, Artificial Sequence
  chemically synthesized
tgaatgaatgacctcttgtcag

SEQ ID NO: 139182 - DNA, 22 bp, Artificial Sequence
  chemically synthesized
ttgtcagtctactcggtttcgc

SEQ ID NO: 139183 - DNA, 22 bp, Artificial Sequence
  chemically synthesized
gtcagtctactcggtttcgctg

SEQ ID NO: 139184 - DNA, 22 bp, Artificial Sequence
  chemically synthesized
tcagtctactcggtttcgctgt

SEQ ID NO: 139185 - DNA, 22 bp, Artificial Sequence
  chemically synthesized
ctcggtttcgctgtgaatgaat

SEQ ID NO: 139186 - DNA, 22 bp, Artificial Sequence
  chemically synthesized
ggtttcgctgtgaatgaatgat

SEQ ID NO: 139187 - DNA, 22 bp, Artificial Sequence
  chemically synthesized
cgctgtgaatgaatgatgtctt

SEQ ID NO: 139188 - DNA, 22 bp, Artificial Sequence
  chemically synthesized
gctgtgaatgaatgatgtcttg

SEQ ID NO: 139189 - DNA, 22 bp, Artificial Sequence
  chemically synthesized
tgaatgaatgatgtcttgtcag

SEQ ID NO: 139190 - DNA, 22 bp, Artificial Sequence
  chemically synthesized
gtcagcctacttggtttcgcta

SEQ ID NO: 139191 - DNA, 22 bp, Artificial Sequence
  chemically synthesized
tcagcctacttggtttcgctaa

SEQ ID NO: 139192 - DNA, 22 bp, Artificial Sequence
  chemically synthesized
cttggtttcgctaagagcacag

SEQ ID NO: 139193 - DNA, 22 bp, Artificial Sequence
  chemically synthesized
ggtttcgctaagagcacagaga

SEQ ID NO: 139194 - DNA, 22 bp, Artificial Sequence
  chemically synthesized
gtttcgctaagagcacagagag

SEQ ID NO: 139195 - DNA, 22 bp, Artificial Sequence
  chemically synthesized
cgctaagagcacagagagaaga

SEQ ID NO: 139196 - DNA, 22 bp, Artificial Sequence
  chemically synthesized
gctaagagcacagagagaagat

SEQ ID NO: 139197 - DNA, 22 bp, Artificial Sequence
  chemically synthesized
agagcacagagagaagatttag

SEQ ID NO: 139198 - DNA, 22 bp, Artificial Sequence
  chemically synthesized
agtgatgctatgtaaaaacttc

SEQ ID NO: 139199 - DNA, 22 bp, Artificial Sequence
  chemically synthesized
gtgatgctatgtaaaaacttcc

SEQ ID NO: 139200 - DNA, 22 bp, Artificial Sequence
  chemically synthesized
tgtaaaaacttcctttttggtt

SEQ ID NO: 139201 - DNA, 22 bp, Artificial Sequence
  chemically synthesized
cctttttggttcaagtgtatgt

SEQ ID NO: 139202 - DNA, 22 bp, Artificial Sequence
  chemically synthesized
ctttttggttcaagtgtatgtt

SEQ ID NO: 139203 - DNA, 22 bp, Artificial Sequence
  chemically synthesized
tttggttcaagtgtatgtttgt

SEQ ID NO: 139204 - DNA, 22 bp, Artificial Sequence
  chemically synthesized
ttggttcaagtgtatgtttgtg

SEQ ID NO: 139205 - DNA, 22 bp, Artificial Sequence
  chemically synthesized
tggttcaagtgtatgtttgtga

SEQ ID NO: 139206 - DNA, 22 bp, Artificial Sequence
  chemically synthesized
ggttcaagtgtatgtttgtgat

SEQ ID NO: 139207 - DNA, 22 bp, Artificial Sequence
  chemically synthesized
gttcaagtgtatgtttgtgata

SEQ ID NO: 139208 - DNA, 22 bp, Artificial Sequence
  chemically synthesized
aagtgtatgtttgtgatagaaa

SEQ ID NO: 139209 - DNA, 22 bp, Artificial Sequence
  chemically synthesized
gtgatagaaatgaagacaggct

SEQ ID NO: 139210 - DNA, 22 bp, Artificial Sequence
  chemically synthesized
tgatagaaatgaagacaggcta

SEQ ID NO: 139211 - DNA, 22 bp, Artificial Sequence
  chemically synthesized
catgatgcatatctaacataaa

SEQ ID NO: 139212 - DNA, 22 bp, Artificial Sequence
  chemically synthesized
acataaacacaaacattaagaa

SEQ ID NO: 139213 - DNA, 22 bp, Artificial Sequence
  chemically synthesized
agaaaggaaatcaacctgaaga

SEQ ID NO: 139214 - DNA, 22 bp, Artificial Sequence
  chemically synthesized
aagagtatttatacagataaca

SEQ ID NO: 139215 - DNA, 22 bp, Artificial Sequence
  chemically synthesized
atacagataacaaaatacagag

SEQ ID NO: 139216 - DNA, 22 bp, Artificial Sequence
  chemically synthesized
tacagataacaaaatacagaga

SEQ ID NO: 139217 - DNA, 22 bp, Artificial Sequence
  chemically synthesized
aatgtgtaataactgtggcaca

SEQ ID NO: 139218 - DNA, 22 bp, Artificial Sequence
  chemically synthesized
tggcacaggctggaatatgagc

SEQ ID NO: 139219 - DNA, 22 bp, Artificial Sequence
  chemically synthesized
gaatatgagccatttaaatcac

SEQ ID NO: 139220 - DNA, 22 bp, Artificial Sequence
  chemically synthesized
aaatcacaaattaattagaaaa

SEQ ID NO: 139221 - DNA, 22 bp, Artificial Sequence
  chemically synthesized
aatcacaaattaattagaaaaa

SEQ ID NO: 139222 - DNA, 22 bp, Artificial Sequence
  chemically synthesized
attagaaaaaaaacagtgggga

SEQ ID NO: 139223 - DNA, 22 bp, Artificial Sequence
  chemically synthesized
gaaaaaaaacagtggggaaaaa

SEQ ID NO: 139224 - DNA, 22 bp, Artificial Sequence
  chemically synthesized
catggatgggtctagaaagact

SEQ ID NO: 139225 - DNA, 22 bp, Artificial Sequence
  chemically synthesized
gaaagactagcattgttttagg

SEQ ID NO: 139226 - DNA, 22 bp, Artificial Sequence
  chemically synthesized
gcattgttttaggttgagtggc

SEQ ID NO: 139227 - DNA, 22 bp, Artificial Sequence
  chemically synthesized
ttttaggttgagtggcagtgtt

SEQ ID NO: 139228 - DNA, 22 bp, Artificial Sequence
  chemically synthesized
taggttgagtggcagtgtttaa

SEQ ID NO: 139229 - DNA, 22 bp, Artificial Sequence
  chemically synthesized
aggttgagtggcagtgtttaaa

SEQ ID NO: 139230 - DNA, 22 bp, Artificial Sequence
  chemically synthesized
ggttgagtggcagtgtttaaag

SEQ ID NO: 139231 - DNA, 22 bp, Artificial Sequence
  chemically synthesized
agtggcagtgtttaaagggtga

SEQ ID NO: 139232 - DNA, 22 bp, Artificial Sequence
  chemically synthesized
aaagggtgatatcagactaaac

SEQ ID NO: 139233 - DNA, 22 bp, Artificial Sequence
  chemically synthesized
aagggtgatatcagactaaact

SEQ ID NO: 139234 - DNA, 22 bp, Artificial Sequence
  chemically synthesized
aacttgaaatatgtggctaaat

SEQ ID NO: 139235 - DNA, 22 bp, Artificial Sequence
  chemically synthesized
gaaatatgtggctaaataacta

SEQ ID NO: 139236 - DNA, 22 bp, Artificial Sequence
  chemically synthesized
aaatatgtggctaaataactag

SEQ ID NO: 139237 - DNA, 22 bp, Artificial Sequence
  chemically synthesized
aataactagaatactctttatt

SEQ ID NO: 139238 - DNA, 22 bp, Artificial Sequence
  chemically synthesized
gaatactctttattttttcgta

SEQ ID NO: 139239 - DNA, 22 bp, Artificial Sequence
  chemically synthesized
tttattttttcgtatcatgaat

SEQ ID NO: 139240 - DNA, 22 bp, Artificial Sequence
  chemically synthesized
tattttttcgtatcatgaatag

SEQ ID NO: 139241 - DNA, 22 bp, Artificial Sequence
  chemically synthesized
attttttcgtatcatgaatagc

SEQ ID NO: 139242 - DNA, 22 bp, Artificial Sequence
  chemically synthesized
ttttttcgtatcatgaatagca

SEQ ID NO: 139243 - DNA, 22 bp, Artificial Sequence
  chemically synthesized
tttcgtatcatgaatagcagat

SEQ ID NO: 139244 - DNA, 22 bp, Artificial Sequence
  chemically synthesized
ttcgtatcatgaatagcagata

SEQ ID NO: 139245 - DNA, 22 bp, Artificial Sequence
  chemically synthesized
tcgtatcatgaatagcagatat

SEQ ID NO: 139246 - DNA, 22 bp, Artificial Sequence
  chemically synthesized
cgtatcatgaatagcagatata

SEQ ID NO: 139247 - DNA, 22 bp, Artificial Sequence
  chemically synthesized
gtatcatgaatagcagatatag

SEQ ID NO: 139248 - DNA, 22 bp, Artificial Sequence
  chemically synthesized
gatggccccatgcttggtttaa

SEQ ID NO: 139249 - DNA, 22 bp, Artificial Sequence
  chemically synthesized
atggccccatgcttggtttaac

SEQ ID NO: 139250 - DNA, 22 bp, Artificial Sequence
  chemically synthesized
ggtttaacatccttgctgttcc

SEQ ID NO: 139251 - DNA, 22 bp, Artificial Sequence
  chemically synthesized
gtttaacatccttgctgttcct

SEQ ID NO: 139252 - DNA, 22 bp, Artificial Sequence
  chemically synthesized
aacatccttgctgttcctgaca

SEQ ID NO: 139253 - DNA, 22 bp, Artificial Sequence
  chemically synthesized
acatccttgctgttcctgacat

SEQ ID NO: 139254 - DNA, 22 bp, Artificial Sequence
  chemically synthesized
gctgttcctgacatgaaatcct

SEQ ID NO: 139255 - DNA, 22 bp, Artificial Sequence
  chemically synthesized
ctgttcctgacatgaaatcctt

SEQ ID NO: 139256 - DNA, 22 bp, Artificial Sequence
  chemically synthesized
ttcctgacatgaaatccttaat

SEQ ID NO: 139257 - DNA, 22 bp, Artificial Sequence
  chemically synthesized
ctgacatgaaatccttaatttt

SEQ ID NO: 139258 - DNA, 22 bp, Artificial Sequence
  chemically synthesized
acatgaaatccttaatttttga

SEQ ID NO: 139259 - DNA, 22 bp, Artificial Sequence
  chemically synthesized
aatttttgacaaaggggctatt

SEQ ID NO: 139260 - DNA, 22 bp, Artificial Sequence
  chemically synthesized
atttttgacaaaggggctattc

SEQ ID NO: 139261 - DNA, 22 bp, Artificial Sequence
  chemically synthesized
ttgacaaaggggctattcattt

SEQ ID NO: 139262 - DNA, 22 bp, Artificial Sequence
  chemically synthesized
tgacaaaggggctattcatttt

SEQ ID NO: 139263 - DNA, 22 bp, Artificial Sequence
  chemically synthesized
gacaaaggggctattcattttc

SEQ ID NO: 139264 - DNA, 22 bp, Artificial Sequence
  chemically synthesized
acaaaggggctattcattttca

SEQ ID NO: 139265 - DNA, 22 bp, Artificial Sequence
  chemically synthesized
ttcattttcattttatattggg

SEQ ID NO: 139266 - DNA, 22 bp, Artificial Sequence
  chemically synthesized
attttcattttatattgggcct

SEQ ID NO: 139267 - DNA, 22 bp, Artificial Sequence
  chemically synthesized
tcattttatattgggcctagaa

SEQ ID NO: 139268 - DNA, 22 bp, Artificial Sequence
  chemically synthesized
cattttatattgggcctagaaa

SEQ ID NO: 139269 - DNA, 22 bp, Artificial Sequence
  chemically synthesized
attttatattgggcctagaaat

SEQ ID NO: 139270 - DNA, 22 bp, Artificial Sequence
  chemically synthesized
tatattgggcctagaaattatg

SEQ ID NO: 139271 - DNA, 22 bp, Artificial Sequence
  chemically synthesized
atattgggcctagaaattatgt

SEQ ID NO: 139272 - DNA, 22 bp, Artificial Sequence
  chemically synthesized
tattgggcctagaaattatgta

SEQ ID NO: 139273 - DNA, 22 bp, Artificial Sequence
  chemically synthesized
ggcctagaaattatgtagatgg

SEQ ID NO: 139274 - DNA, 22 bp, Artificial Sequence
  chemically synthesized
gaaattatgtagatggtcctga

SEQ ID NO: 139275 - DNA, 22 bp, Artificial Sequence
  chemically synthesized
tgtagatggtcctgaggaaaag

SEQ ID NO: 139276 - DNA, 22 bp, Artificial Sequence
  chemically synthesized
aggaaaagtttatagcttgtct

SEQ ID NO: 139277 - DNA, 22 bp, Artificial Sequence
  chemically synthesized
atagcttgtctatttctctctc

SEQ ID NO: 139278 - DNA, 22 bp, Artificial Sequence
  chemically synthesized
tagcttgtctatttctctctct

SEQ ID NO: 139279 - DNA, 22 bp, Artificial Sequence
  chemically synthesized
gtctatttctctctctaacata

SEQ ID NO: 139280 - DNA, 22 bp, Artificial Sequence
  chemically synthesized
tctatttctctctctaacatag

SEQ ID NO: 139281 - DNA, 22 bp, Artificial Sequence
  chemically synthesized
tttctctctctaacatagttgt

SEQ ID NO: 139282 - DNA, 22 bp, Artificial Sequence
  chemically synthesized
ctctctctaacatagttgtcag

SEQ ID NO: 139283 - DNA, 22 bp, Artificial Sequence
  chemically synthesized
tctctctaacatagttgtcagc

SEQ ID NO: 139284 - DNA, 22 bp, Artificial Sequence
  chemically synthesized
tctctaacatagttgtcagcac

SEQ ID NO: 139285 - DNA, 22 bp, Artificial Sequence
  chemically synthesized
tctaacatagttgtcagcacaa

SEQ ID NO: 139286 - DNA, 22 bp, Artificial Sequence
  chemically synthesized
taacatagttgtcagcacaatg

SEQ ID NO: 139287 - DNA, 22 bp, Artificial Sequence
  chemically synthesized
acatagttgtcagcacaatgcc

SEQ ID NO: 139288 - DNA, 22 bp, Artificial Sequence
  chemically synthesized
tcagcacaatgcctaggctata

SEQ ID NO: 139289 - DNA, 22 bp, Artificial Sequence
  chemically synthesized
ggctataggaagtactcaaagc

SEQ ID NO: 139290 - DNA, 22 bp, Artificial Sequence
  chemically synthesized
taggaagtactcaaagcttgtt

SEQ ID NO: 139291 - DNA, 22 bp, Artificial Sequence
  chemically synthesized
aaagcttgttaaattgaattct

SEQ ID NO: 139292 - DNA, 22 bp, Artificial Sequence
  chemically synthesized
gttaaattgaattctatccttc

SEQ ID NO: 139293 - DNA, 22 bp, Artificial Sequence
  chemically synthesized
ttaaattgaattctatccttct

SEQ ID NO: 139294 - DNA, 22 bp, Artificial Sequence
  chemically synthesized
aattgaattctatccttcttat

SEQ ID NO: 139295 - DNA, 22 bp, Artificial Sequence
  chemically synthesized
aattctatccttcttattcaat

SEQ ID NO: 139296 - DNA, 22 bp, Artificial Sequence
  chemically synthesized
tatccttcttattcaattctac

SEQ ID NO: 139297 - DNA, 22 bp, Artificial Sequence
  chemically synthesized
tccttcttattcaattctacac

SEQ ID NO: 139298 - DNA, 22 bp, Artificial Sequence
  chemically synthesized
cttattcaattctacacatgga

SEQ ID NO: 139299 - DNA, 22 bp, Artificial Sequence
  chemically synthesized
ttattcaattctacacatggag

SEQ ID NO: 139300 - DNA, 22 bp, Artificial Sequence
  chemically synthesized
attcaattctacacatggagga

SEQ ID NO: 139301 - DNA, 22 bp, Artificial Sequence
  chemically synthesized
ttcaattctacacatggaggaa

SEQ ID NO: 139302 - DNA, 22 bp, Artificial Sequence
  chemically synthesized
aattctacacatggaggaaaaa

SEQ ID NO: 139303 - DNA, 22 bp, Artificial Sequence
  chemically synthesized
tacacatggaggaaaaactcat

SEQ ID NO: 139304 - DNA, 22 bp, Artificial Sequence
  chemically synthesized
cacatggaggaaaaactcatca

SEQ ID NO: 139305 - DNA, 22 bp, Artificial Sequence
  chemically synthesized
atcagggatggaggcacgcctc

SEQ ID NO: 139306 - DNA, 22 bp, Artificial Sequence
  chemically synthesized
taaggaaggcaggtgtggctct

SEQ ID NO: 139307 - DNA, 22 bp, Artificial Sequence
  chemically synthesized
aggaaggcaggtgtggctctgc

SEQ ID NO: 139308 - DNA, 22 bp, Artificial Sequence
  chemically synthesized
tgcagtgtgattgggtacttgc

SEQ ID NO: 139309 - DNA, 22 bp, Artificial Sequence
  chemically synthesized
cagtgtgattgggtacttgcag

SEQ ID NO: 139310 - DNA, 22 bp, Artificial Sequence
  chemically synthesized
ggtacttgcaggacgaagggtg

SEQ ID NO: 139311 - DNA, 22 bp, Artificial Sequence
  chemically synthesized
gcaggacgaagggtggggtggg

SEQ ID NO: 139312 - DNA, 22 bp, Artificial Sequence
  chemically synthesized
caggacgaagggtggggtggga

SEQ ID NO: 139313 - DNA, 22 bp, Artificial Sequence
  chemically synthesized
accttccattcctagtgcagag

SEQ ID NO: 139314 - DNA, 22 bp, Artificial Sequence
  chemically synthesized
ccattcctagtgcagaggtcac

SEQ ID NO: 139315 - DNA, 22 bp, Artificial Sequence
  chemically synthesized
cattcctagtgcagaggtcaca

SEQ ID NO: 139316 - DNA, 22 bp, Artificial Sequence
  chemically synthesized
ctagtgcagaggtcacagccta

SEQ ID NO: 139317 - DNA, 22 bp, Artificial Sequence
  chemically synthesized
gtgcagaggtcacagcctaaac

SEQ ID NO: 139318 - DNA, 22 bp, Artificial Sequence
  chemically synthesized
aacatcaaattccttgaggtgc

SEQ ID NO: 139319 - DNA, 22 bp, Artificial Sequence
  chemically synthesized
cttgaggtgcggtggctcactc

SEQ ID NO: 139320 - DNA, 22 bp, Artificial Sequence
  chemically synthesized
gaggtgcggtggctcactcctg

SEQ ID NO: 139321 - DNA, 22 bp, Artificial Sequence
  chemically synthesized
aggtgcggtggctcactcctgt

SEQ ID NO: 139322 - DNA, 22 bp, Artificial Sequence
  chemically synthesized
actcctgtaatcacagcagttt

SEQ ID NO: 139323 - DNA, 22 bp, Artificial Sequence
  chemically synthesized
ctgtaatcacagcagtttggga

SEQ ID NO: 139324 - DNA, 22 bp, Artificial Sequence
  chemically synthesized
taatcacagcagtttgggacgc

SEQ ID NO: 139325 - DNA, 22 bp, Artificial Sequence
  chemically synthesized
gggacgccaaggtgggcagatc

SEQ ID NO: 139326 - DNA, 22 bp, Artificial Sequence
  chemically synthesized
ggacgccaaggtgggcagatca

SEQ ID NO: 139327 - DNA, 22 bp, Artificial Sequence
  chemically synthesized
gaggtcaggagttggacaccag

SEQ ID NO: 139328 - DNA, 22 bp, Artificial Sequence
  chemically synthesized
aggtcaggagttggacaccagc

SEQ ID NO: 139329 - DNA, 22 bp, Artificial Sequence
  chemically synthesized
gacaccagcccagccaacatag

SEQ ID NO: 139330 - DNA, 22 bp, Artificial Sequence
  chemically synthesized
gtctctgcttaaaaatataaaa

SEQ ID NO: 139331 - DNA, 22 bp, Artificial Sequence
  chemically synthesized
tgcttaaaaatataaaaattag

SEQ ID NO: 139332 - DNA, 22 bp, Artificial Sequence
  chemically synthesized
cttaaaaatataaaaattagct

SEQ ID NO: 139333 - DNA, 22 bp, Artificial Sequence
  chemically synthesized
aaaaatataaaaattagctgga

SEQ ID NO: 139334 - DNA, 22 bp, Artificial Sequence
  chemically synthesized
aaaatataaaaattagctggac

SEQ ID NO: 139335 - DNA, 22 bp, Artificial Sequence
  chemically synthesized
gctggacgtggtgacgggagcc

SEQ ID NO: 139336 - DNA, 22 bp, Artificial Sequence
  chemically synthesized
gacgtggtgacgggagcctgta

SEQ ID NO: 139337 - DNA, 22 bp, Artificial Sequence
  chemically synthesized
taatccaactacttgggaggct

SEQ ID NO: 139338 - DNA, 22 bp, Artificial Sequence
  chemically synthesized
cttgggaggctgaggcaggaga

SEQ ID NO: 139339 - DNA, 22 bp, Artificial Sequence
  chemically synthesized
gggaggctgaggcaggagaatc

SEQ ID NO: 139340 - DNA, 22 bp, Artificial Sequence
  chemically synthesized
ggaggctgaggcaggagaatcg

SEQ ID NO: 139341 - DNA, 22 bp, Artificial Sequence
  chemically synthesized
aggcaggagaatcgcttgaacc

SEQ ID NO: 139342 - DNA, 22 bp, Artificial Sequence
  chemically synthesized
gaaccggggaggtggagtttgc

SEQ ID NO: 139343 - DNA, 22 bp, Artificial Sequence
  chemically synthesized
aaccggggaggtggagtttgca

SEQ ID NO: 139344 - DNA, 22 bp, Artificial Sequence
  chemically synthesized
gcactgagcagagatcatgcca

SEQ ID NO: 139345 - DNA, 22 bp, Artificial Sequence
  chemically synthesized
cactgagcagagatcatgccat

SEQ ID NO: 139346 - DNA, 22 bp, Artificial Sequence
  chemically synthesized
agcagagatcatgccattgcac

SEQ ID NO: 139347 - DNA, 22 bp, Artificial Sequence
  chemically synthesized
cactccagcctccagagcgaga

SEQ ID NO: 139348 - DNA, 22 bp, Artificial Sequence
  chemically synthesized
cagcctccagagcgagactctg

SEQ ID NO: 139349 - DNA, 22 bp, Artificial Sequence
  chemically synthesized
cagagcgagactctgtctaaag

SEQ ID NO: 139350 - DNA, 22 bp, Artificial Sequence
  chemically synthesized
tgtctaaagaaaaacgaaaaca

SEQ ID NO: 139351 - DNA, 22 bp, Artificial Sequence
  chemically synthesized
tctaaagaaaaacgaaaacaaa

SEQ ID NO: 139352 - DNA, 22 bp, Artificial Sequence
  chemically synthesized
aagaaaaacgaaaacaaacaaa

SEQ ID NO: 139353 - DNA, 22 bp, Artificial Sequence
  chemically synthesized
cctgaccgaacagaattctgtc

SEQ ID NO: 139354 - DNA, 22 bp, Artificial Sequence
  chemically synthesized
accgaacagaattctgtctgat

SEQ ID NO: 139355 - DNA, 22 bp, Artificial Sequence
  chemically synthesized
tgtctgattgttctctgactta

SEQ ID NO: 139356 - DNA, 22 bp, Artificial Sequence
  chemically synthesized
tctgattgttctctgacttatc

SEQ ID NO: 139357 - DNA, 22 bp, Artificial Sequence
  chemically synthesized
attgttctctgacttatctacc

SEQ ID NO: 139358 - DNA, 22 bp, Artificial Sequence
  chemically synthesized
ttctctgacttatctaccattt

SEQ ID NO: 139359 - DNA, 22 bp, Artificial Sequence
  chemically synthesized
tctgacttatctaccattttcc

SEQ ID NO: 139360 - DNA, 22 bp, Artificial Sequence
  chemically synthesized
tgacttatctaccattttccct

SEQ ID NO: 139361 - DNA, 22 bp, Artificial Sequence
  chemically synthesized
acttatctaccattttccctcc

SEQ ID NO: 139362 - DNA, 22 bp, Artificial Sequence
  chemically synthesized
atctaccattttccctccttaa

SEQ ID NO: 139363 - DNA, 22 bp, Artificial Sequence
  chemically synthesized
tctaccattttccctccttaaa

SEQ ID NO: 139364 - DNA, 22 bp, Artificial Sequence
  chemically synthesized
ccattttccctccttaaagaaa

SEQ ID NO: 139365 - DNA, 22 bp, Artificial Sequence
  chemically synthesized
tccctccttaaagaaactgtga

SEQ ID NO: 139366 - DNA, 22 bp, Artificial Sequence
  chemically synthesized
ccctccttaaagaaactgtgaa

SEQ ID NO: 139367 - DNA, 22 bp, Artificial Sequence
  chemically synthesized
cctccttaaagaaactgtgaac

SEQ ID NO: 139368 - DNA, 22 bp, Artificial Sequence
  chemically synthesized
cttaaagaaactgtgaacttcc

SEQ ID NO: 139369 - DNA, 22 bp, Artificial Sequence
  chemically synthesized
aaagaaactgtgaacttccttc

SEQ ID NO: 139370 - DNA, 22 bp, Artificial Sequence
  chemically synthesized
aagaaactgtgaacttccttca

SEQ ID NO: 139371 - DNA, 22 bp, Artificial Sequence
  chemically synthesized
tgaacttccttcagctagaggg

SEQ ID NO: 139372 - DNA, 22 bp, Artificial Sequence
  chemically synthesized
ccttcagctagaggggcctggc

SEQ ID NO: 139373 - DNA, 22 bp, Artificial Sequence
  chemically synthesized
cttcagctagaggggcctggct

SEQ ID NO: 139374 - DNA, 22 bp, Artificial Sequence
  chemically synthesized
cagctagaggggcctggctcag

SEQ ID NO: 139375 - DNA, 22 bp, Artificial Sequence
  chemically synthesized
agctagaggggcctggctcaga

SEQ ID NO: 139376 - DNA, 22 bp, Artificial Sequence
  chemically synthesized
gaggggcctggctcagaagcct

SEQ ID NO: 139377 - DNA, 22 bp, Artificial Sequence
  chemically synthesized
gctcagaagcctctggtcagca

SEQ ID NO: 139378 - DNA, 22 bp, Artificial Sequence
  chemically synthesized
agaagcctctggtcagcatcca

SEQ ID NO: 139379 - DNA, 22 bp, Artificial Sequence
  chemically synthesized
tggtcagcatccaagaaatact

SEQ ID NO: 139380 - DNA, 22 bp, Artificial Sequence
  chemically synthesized
gtcagcatccaagaaatacttg

SEQ ID NO: 139381 - DNA, 22 bp, Artificial Sequence
  chemically synthesized
gatgtcactttggctaaaggta

SEQ ID NO: 139382 - DNA, 22 bp, Artificial Sequence
  chemically synthesized
atgtcactttggctaaaggtat

SEQ ID NO: 139383 - DNA, 22 bp, Artificial Sequence
  chemically synthesized
tggctaaaggtatgatgtgtag

SEQ ID NO: 139384 - DNA, 22 bp, Artificial Sequence
  chemically synthesized
ggctaaaggtatgatgtgtaga

SEQ ID NO: 139385 - DNA, 22 bp, Artificial Sequence
  chemically synthesized
gctaaaggtatgatgtgtagac

SEQ ID NO: 139386 - DNA, 22 bp, Artificial Sequence
  chemically synthesized
aaggtatgatgtgtagacaagc

SEQ ID NO: 139387 - DNA, 22 bp, Artificial Sequence
  chemically synthesized
cagagatggtttctcatttcca

SEQ ID NO: 139388 - DNA, 22 bp, Artificial Sequence
  chemically synthesized
ctcatttccatatccacccacc

SEQ ID NO: 139389 - DNA, 22 bp, Artificial Sequence
  chemically synthesized
tcatttccatatccacccaccc

SEQ ID NO: 139390 - DNA, 22 bp, Artificial Sequence
  chemically synthesized
atttccatatccacccacccag

SEQ ID NO: 139391 - DNA, 22 bp, Artificial Sequence
  chemically synthesized
ccatatccacccacccagcttt

SEQ ID NO: 139392 - DNA, 22 bp, Artificial Sequence
  chemically synthesized
catatccacccacccagctttc

SEQ ID NO: 139393 - DNA, 22 bp, Artificial Sequence
  chemically synthesized
tccaattttaaagccaattctg

SEQ ID NO: 139394 - DNA, 22 bp, Artificial Sequence
  chemically synthesized
ccaattttaaagccaattctga

SEQ ID NO: 139395 - DNA, 22 bp, Artificial Sequence
  chemically synthesized
caattttaaagccaattctgag

SEQ ID NO: 139396 - DNA, 22 bp, Artificial Sequence
  chemically synthesized
taaagccaattctgaggtagag

SEQ ID NO: 139397 - DNA, 22 bp, Artificial Sequence
  chemically synthesized
aaagccaattctgaggtagaga

SEQ ID NO: 139398 - DNA, 22 bp, Artificial Sequence
  chemically synthesized
aagccaattctgaggtagagac

SEQ ID NO: 139399 - DNA, 22 bp, Artificial Sequence
  chemically synthesized
tgaggtagagactgtgatgaac

SEQ ID NO: 139400 - DNA, 22 bp, Artificial Sequence
  chemically synthesized
aggtagagactgtgatgaacaa

SEQ ID NO: 139401 - DNA, 22 bp, Artificial Sequence
  chemically synthesized
tgatgaacaaacaccttgacaa

SEQ ID NO: 139402 - DNA, 22 bp, Artificial Sequence
  chemically synthesized
gacaaaattcaacccaaagact

SEQ ID NO: 139403 - DNA, 22 bp, Artificial Sequence
  chemically synthesized
acaaaattcaacccaaagactc

SEQ ID NO: 139404 - DNA, 22 bp, Artificial Sequence
  chemically synthesized
aacccaaagactcactttgcct

SEQ ID NO: 139405 - DNA, 22 bp, Artificial Sequence
  chemically synthesized
actttgcctagcttcaaaatcc

SEQ ID NO: 139406 - DNA, 22 bp, Artificial Sequence
  chemically synthesized
tgcctagcttcaaaatccttac

SEQ ID NO: 139407 - DNA, 22 bp, Artificial Sequence
  chemically synthesized
gcctagcttcaaaatccttact

SEQ ID NO: 139408 - DNA, 22 bp, Artificial Sequence
  chemically synthesized
cctagcttcaaaatccttactc

SEQ ID NO: 139409 - DNA, 22 bp, Artificial Sequence
  chemically synthesized
gcttcaaaatccttactctgac

SEQ ID NO: 139410 - DNA, 22 bp, Artificial Sequence
  chemically synthesized
caaaatccttactctgacatat

SEQ ID NO: 139411 - DNA, 22 bp, Artificial Sequence
  chemically synthesized
aaaatccttactctgacatata

SEQ ID NO: 139412 - DNA, 22 bp, Artificial Sequence
  chemically synthesized
actctgacatatactcacagcc

SEQ ID NO: 139413 - DNA, 22 bp, Artificial Sequence
  chemically synthesized
ctctgacatatactcacagcca

SEQ ID NO: 139414 - DNA, 22 bp, Artificial Sequence
  chemically synthesized
tgacatatactcacagccagaa

SEQ ID NO: 139415 - DNA, 22 bp, Artificial Sequence
  chemically synthesized
acatatactcacagccagaaat

SEQ ID NO: 139416 - DNA, 22 bp, Artificial Sequence
  chemically synthesized
acagccagaaattagcatgcac

SEQ ID NO: 139417 - DNA, 22 bp, Artificial Sequence
  chemically synthesized
gcatgcactagagtgtgcatga

SEQ ID NO: 139418 - DNA, 22 bp, Artificial Sequence
  chemically synthesized
gagtgtgcatgagtgcaacaca

SEQ ID NO: 139419 - DNA, 22 bp, Artificial Sequence
  chemically synthesized
catattctctgtcagaaaatcc

SEQ ID NO: 139420 - DNA, 22 bp, Artificial Sequence
  chemically synthesized
tctgtcagaaaatcctgttggt

SEQ ID NO: 139421 - DNA, 22 bp, Artificial Sequence
  chemically synthesized
tgtcagaaaatcctgttggttt

SEQ ID NO: 139422 - DNA, 22 bp, Artificial Sequence
  chemically synthesized
tcagaaaatcctgttggttttt

SEQ ID NO: 139423 - DNA, 22 bp, Artificial Sequence
  chemically synthesized
ttggtttttcgtgaaaggatgt

SEQ ID NO: 139424 - DNA, 22 bp, Artificial Sequence
  chemically synthesized
gtttttcgtgaaaggatgtttt

SEQ ID NO: 139425 - DNA, 22 bp, Artificial Sequence
  chemically synthesized
ttcgtgaaaggatgttttcaga

SEQ ID NO: 139426 - DNA, 22 bp, Artificial Sequence
  chemically synthesized
tcgtgaaaggatgttttcagag

SEQ ID NO: 139427 - DNA, 22 bp, Artificial Sequence
  chemically synthesized
cgtgaaaggatgttttcagagg

SEQ ID NO: 139428 - DNA, 22 bp, Artificial Sequence
  chemically synthesized
gtgaaaggatgttttcagaggc

SEQ ID NO: 139429 - DNA, 22 bp, Artificial Sequence
  chemically synthesized
tcagaggctgaccccttgcctt

SEQ ID NO: 139430 - DNA, 22 bp, Artificial Sequence
  chemically synthesized
cagaggctgaccccttgccttc

SEQ ID NO: 139431 - DNA, 22 bp, Artificial Sequence
  chemically synthesized
agaggctgaccccttgccttca

SEQ ID NO: 139432 - DNA, 22 bp, Artificial Sequence
  chemically synthesized
accccttgccttcacctccaat

SEQ ID NO: 139433 - DNA, 22 bp, Artificial Sequence
  chemically synthesized
gccttcacctccaatgctacca

SEQ ID NO: 139434 - DNA, 22 bp, Artificial Sequence
  chemically synthesized
ccttcacctccaatgctaccac

SEQ ID NO: 139435 - DNA, 22 bp, Artificial Sequence
  chemically synthesized
cacctccaatgctaccactctg

SEQ ID NO: 139436 - DNA, 22 bp, Artificial Sequence
  chemically synthesized
acctccaatgctaccactctgg

SEQ ID NO: 139437 - DNA, 22 bp, Artificial Sequence
  chemically synthesized
caatgctaccactctggtctaa

SEQ ID NO: 139438 - DNA, 22 bp, Artificial Sequence
  chemically synthesized
ccactctggtctaagtcactgt

SEQ ID NO: 139439 - DNA, 22 bp, Artificial Sequence
  chemically synthesized
tggtctaagtcactgtcaccac

SEQ ID NO: 139440 - DNA, 22 bp, Artificial Sequence
  chemically synthesized
gtctaagtcactgtcaccacca

SEQ ID NO: 139441 - DNA, 22 bp, Artificial Sequence
  chemically synthesized
agtcactgtcaccaccacctaa

SEQ ID NO: 139442 - DNA, 22 bp, Artificial Sequence
  chemically synthesized
tcaccaccacctaaattatagc

SEQ ID NO: 139443 - DNA, 22 bp, Artificial Sequence
  chemically synthesized
aattatagctgttgactcataa

SEQ ID NO: 139444 - DNA, 22 bp, Artificial Sequence
  chemically synthesized
tagctgttgactcataacaatc

SEQ ID NO: 139445 - DNA, 22 bp, Artificial Sequence
  chemically synthesized
ttgactcataacaatcttcctg

SEQ ID NO: 139446 - DNA, 22 bp, Artificial Sequence
  chemically synthesized
actcataacaatcttcctgctt

SEQ ID NO: 139447 - DNA, 22 bp, Artificial Sequence
  chemically synthesized
ataacaatcttcctgcttctac

SEQ ID NO: 139448 - DNA, 22 bp, Artificial Sequence
  chemically synthesized
cctgcttctaccactgccccac

SEQ ID NO: 139449 - DNA, 22 bp, Artificial Sequence
  chemically synthesized
ctgcttctaccactgccccact

SEQ ID NO: 139450 - DNA, 22 bp, Artificial Sequence
  chemically synthesized
cttctaccactgccccactaca

SEQ ID NO: 139451 - DNA, 22 bp, Artificial Sequence
  chemically synthesized
ctaccactgccccactacaatt

SEQ ID NO: 139452 - DNA, 22 bp, Artificial Sequence
  chemically synthesized
taccactgccccactacaattt

SEQ ID NO: 139453 - DNA, 22 bp, Artificial Sequence
  chemically synthesized
ccactgccccactacaatttct

SEQ ID NO: 139454 - DNA, 22 bp, Artificial Sequence
  chemically synthesized
ccccactacaatttcttcccaa

SEQ ID NO: 139455 - DNA, 22 bp, Artificial Sequence
  chemically synthesized
caatttcttcccaatatactat

SEQ ID NO: 139456 - DNA, 22 bp, Artificial Sequence
  chemically synthesized
cttcccaatatactatccaaat

SEQ ID NO: 139457 - DNA, 22 bp, Artificial Sequence
  chemically synthesized
ttcccaatatactatccaaatt

SEQ ID NO: 139458 - DNA, 22 bp, Artificial Sequence
  chemically synthesized
cccaatatactatccaaattag

SEQ ID NO: 139459 - DNA, 22 bp, Artificial Sequence
  chemically synthesized
ccaatatactatccaaattagt

SEQ ID NO: 139460 - DNA, 22 bp, Artificial Sequence
  chemically synthesized
tccaaattagtcttttcaaaat

SEQ ID NO: 139461 - DNA, 22 bp, Artificial Sequence
  chemically synthesized
gtcttttcaaaatgtaagtcat

SEQ ID NO: 139462 - DNA, 22 bp, Artificial Sequence
  chemically synthesized
ttcaaaatgtaagtcatatatg

SEQ ID NO: 139463 - DNA, 22 bp, Artificial Sequence
  chemically synthesized
tcaaaatgtaagtcatatatgg

SEQ ID NO: 139464 - DNA, 22 bp, Artificial Sequence
  chemically synthesized
caaaatgtaagtcatatatggt

SEQ ID NO: 139465 - DNA, 22 bp, Artificial Sequence
  chemically synthesized
aaaatgtaagtcatatatggtc

SEQ ID NO: 139466 - DNA, 22 bp, Artificial Sequence
  chemically synthesized
tttgttcaaagtcttctgatag

SEQ ID NO: 139467 - DNA, 22 bp, Artificial Sequence
  chemically synthesized
tgttcaaagtcttctgatagtt

SEQ ID NO: 139468 - DNA, 22 bp, Artificial Sequence
  chemically synthesized
gttcaaagtcttctgatagttt

SEQ ID NO: 139469 - DNA, 22 bp, Artificial Sequence
  chemically synthesized
ttcaaagtcttctgatagtttc

SEQ ID NO: 139470 - DNA, 22 bp, Artificial Sequence
  chemically synthesized
aaagtcttctgatagtttccta

SEQ ID NO: 139471 - DNA, 22 bp, Artificial Sequence
  chemically synthesized
ctgatagtttcctatatcattt

SEQ ID NO: 139472 - DNA, 22 bp, Artificial Sequence
  chemically synthesized
tgatagtttcctatatcattta

SEQ ID NO: 139473 - DNA, 22 bp, Artificial Sequence
  chemically synthesized
atagtttcctatatcatttata

SEQ ID NO: 139474 - DNA, 22 bp, Artificial Sequence
  chemically synthesized
cctatatcatttataataaaac

SEQ ID NO: 139475 - DNA, 22 bp, Artificial Sequence
  chemically synthesized
ctatatcatttataataaaacc

SEQ ID NO: 139476 - DNA, 22 bp, Artificial Sequence
  chemically synthesized
tatcatttataataaaaccaaa

SEQ ID NO: 139477 - DNA, 22 bp, Artificial Sequence
  chemically synthesized
ataataaaaccaaatccttaca

SEQ ID NO: 139478 - DNA, 22 bp, Artificial Sequence
  chemically synthesized
taataaaaccaaatccttacaa

SEQ ID NO: 139479 - DNA, 22 bp, Artificial Sequence
  chemically synthesized
acaattctctacaatagttgtt

SEQ ID NO: 139480 - DNA, 22 bp, Artificial Sequence
  chemically synthesized
caattctctacaatagttgttc

SEQ ID NO: 139481 - DNA, 22 bp, Artificial Sequence
  chemically synthesized
tctacaatagttgttcatgcat

SEQ ID NO: 139482 - DNA, 22 bp, Artificial Sequence
  chemically synthesized
tacaatagttgttcatgcatat

SEQ ID NO: 139483 - DNA, 22 bp, Artificial Sequence
  chemically synthesized
caatagttgttcatgcatatat

SEQ ID NO: 139484 - DNA, 22 bp, Artificial Sequence
  chemically synthesized
ttcatgcatatattatgtttat

SEQ ID NO: 139485 - DNA, 22 bp, Artificial Sequence
  chemically synthesized
atgcatatattatgtttattac

SEQ ID NO: 139486 - DNA, 22 bp, Artificial Sequence
  chemically synthesized
tgtttattacagatacatatat

SEQ ID NO: 139487 - DNA, 22 bp, Artificial Sequence
  chemically synthesized
attacagatacatatatatagc

SEQ ID NO: 139488 - DNA, 22 bp, Artificial Sequence
  chemically synthesized
ttacagatacatatatatagct

SEQ ID NO: 139489 - DNA, 22 bp, Artificial Sequence
  chemically synthesized
cagatacatatatatagctctc

SEQ ID NO: 139490 - DNA, 22 bp, Artificial Sequence
  chemically synthesized
tcatataaataaatatatatat

SEQ ID NO: 139491 - DNA, 22 bp, Artificial Sequence
  chemically synthesized
atataaataaatatatatattt

SEQ ID NO: 139492 - DNA, 22 bp, Artificial Sequence
  chemically synthesized
atgtgtatgtgtgtagagtgtt

SEQ ID NO: 139493 - DNA, 22 bp, Artificial Sequence
  chemically synthesized
tgtgtatgtgtgtagagtgttt

SEQ ID NO: 139494 - DNA, 22 bp, Artificial Sequence
  chemically synthesized
tttcttacaactctatgatgta

SEQ ID NO: 139495 - DNA, 22 bp, Artificial Sequence
  chemically synthesized
ttcttacaactctatgatgtag

SEQ ID NO: 139496 - DNA, 22 bp, Artificial Sequence
  chemically synthesized
tcttacaactctatgatgtagg

SEQ ID NO: 139497 - DNA, 22 bp, Artificial Sequence
  chemically synthesized
cttacaactctatgatgtaggt

SEQ ID NO: 139498 - DNA, 22 bp, Artificial Sequence
  chemically synthesized
ttacaactctatgatgtaggta

SEQ ID NO: 139499 - DNA, 22 bp, Artificial Sequence
  chemically synthesized
acaactctatgatgtaggtatt

SEQ ID NO: 139500 - DNA, 22 bp, Artificial Sequence
  chemically synthesized
caactctatgatgtaggtatta

SEQ ID NO: 139501 - DNA, 22 bp, Artificial Sequence
  chemically synthesized
tatgatgtaggtattattagtg

SEQ ID NO: 139502 - DNA, 22 bp, Artificial Sequence
  chemically synthesized
tgatgtaggtattattagtgtc

SEQ ID NO: 139503 - DNA, 22 bp, Artificial Sequence
  chemically synthesized
ttagtgtcccaaattttataat

SEQ ID NO: 139504 - DNA, 22 bp, Artificial Sequence
  chemically synthesized
gtgtcccaaattttataattta

SEQ ID NO: 139505 - DNA, 22 bp, Artificial Sequence
  chemically synthesized
tataatttaggacttctatgat

SEQ ID NO: 139506 - DNA, 22 bp, Artificial Sequence
  chemically synthesized
ataatttaggacttctatgatc

SEQ ID NO: 139507 - DNA, 22 bp, Artificial Sequence
  chemically synthesized
taatttaggacttctatgatct

SEQ ID NO: 139508 - DNA, 22 bp, Artificial Sequence
  chemically synthesized
aggacttctatgatctcatctt

SEQ ID NO: 139509 - DNA, 22 bp, Artificial Sequence
  chemically synthesized
ggacttctatgatctcatcttt

SEQ ID NO: 139510 - DNA, 22 bp, Artificial Sequence
  chemically synthesized
ctatgatctcatcttttattct

SEQ ID NO: 139511 - DNA, 22 bp, Artificial Sequence
  chemically synthesized
tatgatctcatcttttattctc

SEQ ID NO: 139512 - DNA, 22 bp, Artificial Sequence
  chemically synthesized
tgatctcatcttttattctccc

SEQ ID NO: 139513 - DNA, 22 bp, Artificial Sequence
  chemically synthesized
atcttttattctccccttcacc

SEQ ID NO: 139514 - DNA, 22 bp, Artificial Sequence
  chemically synthesized
ttattctccccttcaccgaatc

SEQ ID NO: 139515 - DNA, 22 bp, Artificial Sequence
  chemically synthesized
tattctccccttcaccgaatct

SEQ ID NO: 139516 - DNA, 22 bp, Artificial Sequence
  chemically synthesized
attctccccttcaccgaatctc

SEQ ID NO: 139517 - DNA, 22 bp, Artificial Sequence
  chemically synthesized
ttctccccttcaccgaatctca

SEQ ID NO: 139518 - DNA, 22 bp, Artificial Sequence
  chemically synthesized
tccccttcaccgaatctcatcc

SEQ ID NO: 139519 - DNA, 22 bp, Artificial Sequence
  chemically synthesized
cccttcaccgaatctcatccta

SEQ ID NO: 139520 - DNA, 22 bp, Artificial Sequence
  chemically synthesized
caccgaatctcatcctacattg

SEQ ID NO: 139521 - DNA, 22 bp, Artificial Sequence
  chemically synthesized
accgaatctcatcctacattgg

SEQ ID NO: 139522 - DNA, 22 bp, Artificial Sequence
  chemically synthesized
atcctacattggccttattgat

SEQ ID NO: 139523 - DNA, 22 bp, Artificial Sequence
  chemically synthesized
cattggccttattgatattcct

SEQ ID NO: 139524 - DNA, 22 bp, Artificial Sequence
  chemically synthesized
gccttattgatattccttgaaa

SEQ ID NO: 139525 - DNA, 22 bp, Artificial Sequence
  chemically synthesized
attgatattccttgaaaattct

SEQ ID NO: 139526 - DNA, 22 bp, Artificial Sequence
  chemically synthesized
ttgatattccttgaaaattcta

SEQ ID NO: 139527 - DNA, 22 bp, Artificial Sequence
  chemically synthesized
atattccttgaaaattctaagc

SEQ ID NO: 139528 - DNA, 22 bp, Artificial Sequence
  chemically synthesized
cttgaaaattctaagcatctta

SEQ ID NO: 139529 - DNA, 22 bp, Artificial Sequence
  chemically synthesized
gaaaattctaagcatcttacat

SEQ ID NO: 139530 - DNA, 22 bp, Artificial Sequence
  chemically synthesized
aaaattctaagcatcttacatc

SEQ ID NO: 139531 - DNA, 22 bp, Artificial Sequence
  chemically synthesized
taagcatcttacatctttaggg

SEQ ID NO: 139532 - DNA, 22 bp, Artificial Sequence
  chemically synthesized
agcatcttacatctttagggta

SEQ ID NO: 139533 - DNA, 22 bp, Artificial Sequence
  chemically synthesized
acatctttagggtatttacatt

SEQ ID NO: 139534 - DNA, 22 bp, Artificial Sequence
  chemically synthesized
catctttagggtatttacattt

SEQ ID NO: 139535 - DNA, 22 bp, Artificial Sequence
  chemically synthesized
tagggtatttacatttgccatt

SEQ ID NO: 139536 - DNA, 22 bp, Artificial Sequence
  chemically synthesized
agggtatttacatttgccattc

SEQ ID NO: 139537 - DNA, 22 bp, Artificial Sequence
  chemically synthesized
gggtatttacatttgccattcc

SEQ ID NO: 139538 - DNA, 22 bp, Artificial Sequence
  chemically synthesized
acatttgccattccctatgccc

SEQ ID NO: 139539 - DNA, 22 bp, Artificial Sequence
  chemically synthesized
catttgccattccctatgccct

SEQ ID NO: 139540 - DNA, 22 bp, Artificial Sequence
  chemically synthesized
gccattccctatgccctaaata

SEQ ID NO: 139541 - DNA, 22 bp, Artificial Sequence
  chemically synthesized
ccattccctatgccctaaatat

SEQ ID NO: 139542 - DNA, 22 bp, Artificial Sequence
  chemically synthesized
cctatgccctaaatatttaatc

SEQ ID NO: 139543 - DNA, 22 bp, Artificial Sequence
  chemically synthesized
tgccctaaatatttaatcatag

SEQ ID NO: 139544 - DNA, 22 bp, Artificial Sequence
  chemically synthesized
aatatttaatcatagtttcata

SEQ ID NO: 139545 - DNA, 22 bp, Artificial Sequence
  chemically synthesized
aatcatagtttcatataaatgg

SEQ ID NO: 139546 - DNA, 22 bp, Artificial Sequence
  chemically synthesized
atcatagtttcatataaatggg

SEQ ID NO: 139547 - DNA, 22 bp, Artificial Sequence
  chemically synthesized
catataaatgggttcctcatca

SEQ ID NO: 139548 - DNA, 22 bp, Artificial Sequence
  chemically synthesized
atataaatgggttcctcatcat

SEQ ID NO: 139549 - DNA, 22 bp, Artificial Sequence
  chemically synthesized
ctcatcatctatgggtactctc

SEQ ID NO: 139550 - DNA, 22 bp, Artificial Sequence
  chemically synthesized
atcatctatgggtactctctca

SEQ ID NO: 139551 - DNA, 22 bp, Artificial Sequence
  chemically synthesized
tgggtactctctcaggtgttaa

SEQ ID NO: 139552 - DNA, 22 bp, Artificial Sequence
  chemically synthesized
tctcaggtgttaactttatagt

SEQ ID NO: 139553 - DNA, 22 bp, Artificial Sequence
  chemically synthesized
tcaggtgttaactttatagtga

SEQ ID NO: 139554 - DNA, 22 bp, Artificial Sequence
  chemically synthesized
aggtgttaactttatagtgagg

SEQ ID NO: 139555 - DNA, 22 bp, Artificial Sequence
  chemically synthesized
actttatagtgaggactttcct

SEQ ID NO: 139556 - DNA, 22 bp, Artificial Sequence
  chemically synthesized
tatagtgaggactttcctgcca

SEQ ID NO: 139557 - DNA, 22 bp, Artificial Sequence
  chemically synthesized
atagtgaggactttcctgccat

SEQ ID NO: 139558 - DNA, 22 bp, Artificial Sequence
  chemically synthesized
tagtgaggactttcctgccata

SEQ ID NO: 139559 - DNA, 22 bp, Artificial Sequence
  chemically synthesized
tcctgccatactacttaaagta

SEQ ID NO: 139560 - DNA, 22 bp, Artificial Sequence
  chemically synthesized
cctgccatactacttaaagtag

SEQ ID NO: 139561 - DNA, 22 bp, Artificial Sequence
  chemically synthesized
ctgccatactacttaaagtagc

SEQ ID NO: 139562 - DNA, 22 bp, Artificial Sequence
  chemically synthesized
ccatactacttaaagtagcgat

SEQ ID NO: 139563 - DNA, 22 bp, Artificial Sequence
  chemically synthesized
cttaaagtagcgataccctttc

SEQ ID NO: 139564 - DNA, 22 bp, Artificial Sequence
  chemically synthesized
aaagtagcgataccctttcacc

SEQ ID NO: 139565 - DNA, 22 bp, Artificial Sequence
  chemically synthesized
aagtagcgataccctttcaccc

SEQ ID NO: 139566 - DNA, 22 bp, Artificial Sequence
  chemically synthesized
tcaccctgtcctaatcacactc

SEQ ID NO: 139567 - DNA, 22 bp, Artificial Sequence
  chemically synthesized
caccctgtcctaatcacactct

SEQ ID NO: 139568 - DNA, 22 bp, Artificial Sequence
  chemically synthesized
accctgtcctaatcacactctg

SEQ ID NO: 139569 - DNA, 22 bp, Artificial Sequence
  chemically synthesized
tcctaatcacactctggccttc

SEQ ID NO: 139570 - DNA, 22 bp, Artificial Sequence
  chemically synthesized
atcacactctggccttcatttc

SEQ ID NO: 139571 - DNA, 22 bp, Artificial Sequence
  chemically synthesized
tggccttcatttcagttttttt

SEQ ID NO: 139572 - DNA, 22 bp, Artificial Sequence
  chemically synthesized
gccttcatttcagttttttttt

SEQ ID NO: 139573 - DNA, 22 bp, Artificial Sequence
  chemically synthesized
catttcagttttttttttttct

SEQ ID NO: 139574 - DNA, 22 bp, Artificial Sequence
  chemically synthesized
atttcagttttttttttttctc

SEQ ID NO: 139575 - DNA, 22 bp, Artificial Sequence
  chemically synthesized
cagttttttttttttctccata

SEQ ID NO: 139576 - DNA, 22 bp, Artificial Sequence
  chemically synthesized
agttttttttttttctccatag

SEQ ID NO: 139577 - DNA, 22 bp, Artificial Sequence
  chemically synthesized
tttttttttctccatagcacct

SEQ ID NO: 139578 - DNA, 22 bp, Artificial Sequence
  chemically synthesized
ttttttttctccatagcaccta

SEQ ID NO: 139579 - DNA, 22 bp, Artificial Sequence
  chemically synthesized
tttttttctccatagcacctaa

SEQ ID NO: 139580 - DNA, 22 bp, Artificial Sequence
  chemically synthesized
ttttttctccatagcacctaat

SEQ ID NO: 139581 - DNA, 22 bp, Artificial Sequence
  chemically synthesized
tttttctccatagcacctaatc

SEQ ID NO: 139582 - DNA, 22 bp, Artificial Sequence
  chemically synthesized
ttttctccatagcacctaatct

SEQ ID NO: 139583 - DNA, 22 bp, Artificial Sequence
  chemically synthesized
tttctccatagcacctaatctc

SEQ ID NO: 139584 - DNA, 22 bp, Artificial Sequence
  chemically synthesized
ttctccatagcacctaatctca

SEQ ID NO: 139585 - DNA, 22 bp, Artificial Sequence
  chemically synthesized
tctccatagcacctaatctcat

SEQ ID NO: 139586 - DNA, 22 bp, Artificial Sequence
  chemically synthesized
ctccatagcacctaatctcatt

SEQ ID NO: 139587 - DNA, 22 bp, Artificial Sequence
  chemically synthesized
tccatagcacctaatctcattg

SEQ ID NO: 139588 - DNA, 22 bp, Artificial Sequence
  chemically synthesized
catagcacctaatctcattggt

SEQ ID NO: 139589 - DNA, 22 bp, Artificial Sequence
  chemically synthesized
atctcattggtatataacatgt

SEQ ID NO: 139590 - DNA, 22 bp, Artificial Sequence
  chemically synthesized
attggtatataacatgtttcat

SEQ ID NO: 139591 - DNA, 22 bp, Artificial Sequence
  chemically synthesized
gtatataacatgtttcatttgc

SEQ ID NO: 139592 - DNA, 22 bp, Artificial Sequence
  chemically synthesized
catttgcttatttaatgtcaag

SEQ ID NO: 139593 - DNA, 22 bp, Artificial Sequence
  chemically synthesized
atttgcttatttaatgtcaagc

SEQ ID NO: 139594 - DNA, 22 bp, Artificial Sequence
  chemically synthesized
gcttatttaatgtcaagctctt

SEQ ID NO: 139595 - DNA, 22 bp, Artificial Sequence
  chemically synthesized
cttatttaatgtcaagctcttt

SEQ ID NO: 139596 - DNA, 22 bp, Artificial Sequence
  chemically synthesized
atttaatgtcaagctctttcca

SEQ ID NO: 139597 - DNA, 22 bp, Artificial Sequence
  chemically synthesized
tttaatgtcaagctctttccac

SEQ ID NO: 139598 - DNA, 22 bp, Artificial Sequence
  chemically synthesized
aatgtcaagctctttccactat

SEQ ID NO: 139599 - DNA, 22 bp, Artificial Sequence
  chemically synthesized
atgtcaagctctttccactatc

SEQ ID NO: 139600 - DNA, 22 bp, Artificial Sequence
  chemically synthesized
tttccactatcaagtccatgaa

SEQ ID NO: 139601 - DNA, 22 bp, Artificial Sequence
  chemically synthesized
tccactatcaagtccatgaaaa

SEQ ID NO: 139602 - DNA, 22 bp, Artificial Sequence
  chemically synthesized
ccactatcaagtccatgaaaac

SEQ ID NO: 139603 - DNA, 22 bp, Artificial Sequence
  chemically synthesized
cactatcaagtccatgaaaaca

SEQ ID NO: 139604 - DNA, 22 bp, Artificial Sequence
  chemically synthesized
tcaagtccatgaaaacaggaac

SEQ ID NO: 139605 - DNA, 22 bp, Artificial Sequence
  chemically synthesized
tattcctctattctgtttttgt

SEQ ID NO: 139606 - DNA, 22 bp, Artificial Sequence
  chemically synthesized
attcctctattctgtttttgtg

SEQ ID NO: 139607 - DNA, 22 bp, Artificial Sequence
  chemically synthesized
ttcctctattctgtttttgtgc

SEQ ID NO: 139608 - DNA, 22 bp, Artificial Sequence
  chemically synthesized
ctctattctgtttttgtgctgt

SEQ ID NO: 139609 - DNA, 22 bp, Artificial Sequence
  chemically synthesized
tattctgtttttgtgctgtatt

SEQ ID NO: 139610 - DNA, 22 bp, Artificial Sequence
  chemically synthesized
ttctgtttttgtgctgtattct

SEQ ID NO: 139611 - DNA, 22 bp, Artificial Sequence
  chemically synthesized
tgtttttgtgctgtattcttag

SEQ ID NO: 139612 - DNA, 22 bp, Artificial Sequence
  chemically synthesized
tttttgtgctgtattcttagca

SEQ ID NO: 139613 - DNA, 22 bp, Artificial Sequence
  chemically synthesized
ttgtgctgtattcttagcaatt

SEQ ID NO: 139614 - DNA, 22 bp, Artificial Sequence
  chemically synthesized
tgtgctgtattcttagcaattt

SEQ ID NO: 139615 - DNA, 22 bp, Artificial Sequence
  chemically synthesized
gtgctgtattcttagcaatttt

SEQ ID NO: 139616 - DNA, 22 bp, Artificial Sequence
  chemically synthesized
tgctgtattcttagcaatttta

SEQ ID NO: 139617 - DNA, 22 bp, Artificial Sequence
  chemically synthesized
tattcttagcaattttacaatt

SEQ ID NO: 139618 - DNA, 22 bp, Artificial Sequence
  chemically synthesized
ttagcaattttacaattttgaa

SEQ ID NO: 139619 - DNA, 22 bp, Artificial Sequence
  chemically synthesized
agcaattttacaattttgaatg

SEQ ID NO: 139620 - DNA, 22 bp, Artificial Sequence
  chemically synthesized
gcaattttacaattttgaatga

SEQ ID NO: 139621 - DNA, 22 bp, Artificial Sequence
  chemically synthesized
tacaattttgaatgaatgaatg

SEQ ID NO: 139622 - DNA, 22 bp, Artificial Sequence
  chemically synthesized
acaattttgaatgaatgaatga

SEQ ID NO: 139623 - DNA, 22 bp, Artificial Sequence
  chemically synthesized
caattttgaatgaatgaatgag

SEQ ID NO: 139624 - DNA, 22 bp, Artificial Sequence
  chemically synthesized
tgaatgaatgaatgagcagtca

SEQ ID NO: 139625 - DNA, 22 bp, Artificial Sequence
  chemically synthesized
gaatgaatgaatgagcagtcaa

SEQ ID NO: 139626 - DNA, 22 bp, Artificial Sequence
  chemically synthesized
aatgaatgaatgagcagtcaaa

SEQ ID NO: 139627 - DNA, 22 bp, Artificial Sequence
  chemically synthesized
taattaaaaggatgtatgctga

SEQ ID NO: 139628 - DNA, 22 bp, Artificial Sequence
  chemically synthesized
aaaggatgtatgctgacacatc

SEQ ID NO: 139629 - DNA, 22 bp, Artificial Sequence
  chemically synthesized
acacatccactgctatgcacac

SEQ ID NO: 139630 - DNA, 22 bp, Artificial Sequence
  chemically synthesized
ctatgcacacacaaagaaatca

SEQ ID NO: 139631 - DNA, 22 bp, Artificial Sequence
  chemically synthesized
tgcacacacaaagaaatcagtg

SEQ ID NO: 139632 - DNA, 22 bp, Artificial Sequence
  chemically synthesized
gaagtgctaagcctgcatagag

SEQ ID NO: 139633 - DNA, 22 bp, Artificial Sequence
  chemically synthesized
agcctgcatagagctagttagc

SEQ ID NO: 139634 - DNA, 22 bp, Artificial Sequence
  chemically synthesized
catagagctagttagccctccg

SEQ ID NO: 139635 - DNA, 22 bp, Artificial Sequence
  chemically synthesized
gttagccctccgcaggcagagc

SEQ ID NO: 139636 - DNA, 22 bp, Artificial Sequence
  chemically synthesized
gccctccgcaggcagagccttg

SEQ ID NO: 139637 - DNA, 22 bp, Artificial Sequence
  chemically synthesized
cgcaggcagagccttgatggga

SEQ ID NO: 139638 - DNA, 22 bp, Artificial Sequence
  chemically synthesized
gatgggattactgagttctaga

SEQ ID NO: 139639 - DNA, 22 bp, Artificial Sequence
  chemically synthesized
atgggattactgagttctagaa

SEQ ID NO: 139640 - DNA, 22 bp, Artificial Sequence
  chemically synthesized
ctgagttctagaattggactca

SEQ ID NO: 139641 - DNA, 22 bp, Artificial Sequence
  chemically synthesized
agttctagaattggactcattt

SEQ ID NO: 139642 - DNA, 22 bp, Artificial Sequence
  chemically synthesized
tagaattggactcatttgtttt

SEQ ID NO: 139643 - DNA, 22 bp, Artificial Sequence
  chemically synthesized
gaattggactcatttgttttgt

SEQ ID NO: 139644 - DNA, 22 bp, Artificial Sequence
  chemically synthesized
gactcatttgttttgtaggctg

SEQ ID NO: 139645 - DNA, 22 bp, Artificial Sequence
  chemically synthesized
atttgttttgtaggctgagatt

SEQ ID NO: 139646 - DNA, 22 bp, Artificial Sequence
  chemically synthesized
gttttgtaggctgagatttgct

SEQ ID NO: 139647 - DNA, 22 bp, Artificial Sequence
  chemically synthesized
ttttgtaggctgagatttgctc

SEQ ID NO: 139648 - DNA, 22 bp, Artificial Sequence
  chemically synthesized
tgtaggctgagatttgctcttg

SEQ ID NO: 139649 - DNA, 22 bp, Artificial Sequence
  chemically synthesized
gtaggctgagatttgctcttga

SEQ ID NO: 139650 - DNA, 22 bp, Artificial Sequence
  chemically synthesized
taggctgagatttgctcttgaa

SEQ ID NO: 139651 - DNA, 22 bp, Artificial Sequence
  chemically synthesized
agatttgctcttgaaaacttgt

SEQ ID NO: 139652 - DNA, 22 bp, Artificial Sequence
  chemically synthesized
gctcttgaaaacttgttctgac

SEQ ID NO: 139653 - DNA, 22 bp, Artificial Sequence
  chemically synthesized
ctcttgaaaacttgttctgacc

SEQ ID NO: 139654 - DNA, 22 bp, Artificial Sequence
  chemically synthesized
ttgaaaacttgttctgaccaaa

SEQ ID NO: 139655 - DNA, 22 bp, Artificial Sequence
  chemically synthesized
gaaaacttgttctgaccaaaat

SEQ ID NO: 139656 - DNA, 22 bp, Artificial Sequence
  chemically synthesized
aaaacttgttctgaccaaaata

SEQ ID NO: 139657 - DNA, 22 bp, Artificial Sequence
  chemically synthesized
gttctgaccaaaataaaaggct

SEQ ID NO: 139658 - DNA, 22 bp, Artificial Sequence
  chemically synthesized
ttctgaccaaaataaaaggctc

SEQ ID NO: 139659 - DNA, 22 bp, Artificial Sequence
  chemically synthesized
tgaccaaaataaaaggctcaaa

SEQ ID NO: 139660 - DNA, 22 bp, Artificial Sequence
  chemically synthesized
accaaaataaaaggctcaaaag

SEQ ID NO: 139661 - DNA, 22 bp, Artificial Sequence
  chemically synthesized
aaaagatgaatatcgaaaccag

SEQ ID NO: 139662 - DNA, 22 bp, Artificial Sequence
  chemically synthesized
tttacactggaatttataacta

SEQ ID NO: 139663 - DNA, 22 bp, Artificial Sequence
  chemically synthesized
ttacactggaatttataactag

SEQ ID NO: 139664 - DNA, 22 bp, Artificial Sequence
  chemically synthesized
tacactggaatttataactaga

SEQ ID NO: 139665 - DNA, 22 bp, Artificial Sequence
  chemically synthesized
acactggaatttataactagag

SEQ ID NO: 139666 - DNA, 22 bp, Artificial Sequence
  chemically synthesized
cactggaatttataactagagc

SEQ ID NO: 139667 - DNA, 22 bp, Artificial Sequence
  chemically synthesized
gaatttataactagagcactca

SEQ ID NO: 139668 - DNA, 22 bp, Artificial Sequence
  chemically synthesized
ataactagagcactcatgttta

SEQ ID NO: 139669 - DNA, 22 bp, Artificial Sequence
  chemically synthesized
taactagagcactcatgtttat

SEQ ID NO: 139670 - DNA, 22 bp, Artificial Sequence
  chemically synthesized
gagcactcatgtttatgtaagc

SEQ ID NO: 139671 - DNA, 22 bp, Artificial Sequence
  chemically synthesized
atgtttatgtaagcaattaatt

SEQ ID NO: 139672 - DNA, 22 bp, Artificial Sequence
  chemically synthesized
atgtaagcaattaattgtttca

SEQ ID NO: 139673 - DNA, 22 bp, Artificial Sequence
  chemically synthesized
tgtaagcaattaattgtttcat

SEQ ID NO: 139674 - DNA, 22 bp, Artificial Sequence
  chemically synthesized
attgtttcatcagtcaggtaaa

SEQ ID NO: 139675 - DNA, 22 bp, Artificial Sequence
  chemically synthesized
tttcatcagtcaggtaaaagta

SEQ ID NO: 139676 - DNA, 22 bp, Artificial Sequence
  chemically synthesized
catcagtcaggtaaaagtaaag

SEQ ID NO: 139677 - DNA, 22 bp, Artificial Sequence
  chemically synthesized
atcagtcaggtaaaagtaaaga

SEQ ID NO: 139678 - DNA, 22 bp, Artificial Sequence
  chemically synthesized
tgccaaggcaggtagcctaatg

SEQ ID NO: 139679 - DNA, 22 bp, Artificial Sequence
  chemically synthesized
atgcaatatgccactaaagtaa

SEQ ID NO: 139680 - DNA, 22 bp, Artificial Sequence
  chemically synthesized
aagtaaacattatttcataggt

SEQ ID NO: 139681 - DNA, 22 bp, Artificial Sequence
  chemically synthesized
tttcataggtgtcagatatggc

SEQ ID NO: 139682 - DNA, 22 bp, Artificial Sequence
  chemically synthesized
cataggtgtcagatatggctta

SEQ ID NO: 139683 - DNA, 22 bp, Artificial Sequence
  chemically synthesized
ataggtgtcagatatggcttat

SEQ ID NO: 139684 - DNA, 22 bp, Artificial Sequence
  chemically synthesized
attcatccatcttcatgggaag

SEQ ID NO: 139685 - DNA, 22 bp, Artificial Sequence
  chemically synthesized
ttcatccatcttcatgggaagg

SEQ ID NO: 139686 - DNA, 22 bp, Artificial Sequence
  chemically synthesized
atccatcttcatgggaaggatg

SEQ ID NO: 139687 - DNA, 22 bp, Artificial Sequence
  chemically synthesized
catgggaaggatggccttggcc

SEQ ID NO: 139688 - DNA, 22 bp, Artificial Sequence
  chemically synthesized
atgggaaggatggccttggcct

SEQ ID NO: 139689 - DNA, 22 bp, Artificial Sequence
  chemically synthesized
ggcctggacatcagtgttatgt

SEQ ID NO: 139690 - DNA, 22 bp, Artificial Sequence
  chemically synthesized
gcctggacatcagtgttatgtg

SEQ ID NO: 139691 - DNA, 22 bp, Artificial Sequence
  chemically synthesized
gacatcagtgttatgtgaggtt

SEQ ID NO: 139692 - DNA, 22 bp, Artificial Sequence
  chemically synthesized
tgtgaggttcaaaacacctcta

SEQ ID NO: 139693 - DNA, 22 bp, Artificial Sequence
  chemically synthesized
aaaacacctctaggctataagg

SEQ ID NO: 139694 - DNA, 22 bp, Artificial Sequence
  chemically synthesized
taggctataaggcaacagagct

SEQ ID NO: 139695 - DNA, 22 bp, Artificial Sequence
  chemically synthesized
ggctataaggcaacagagctcc

SEQ ID NO: 139696 - DNA, 22 bp, Artificial Sequence
  chemically synthesized
taaggcaacagagctccttttt

SEQ ID NO: 139697 - DNA, 22 bp, Artificial Sequence
  chemically synthesized
cttttttttttttctgtgcttt

SEQ ID NO: 139698 - DNA, 22 bp, Artificial Sequence
  chemically synthesized
ttttttttttctgtgctttcct

SEQ ID NO: 139699 - DNA, 22 bp, Artificial Sequence
  chemically synthesized
tttttttttctgtgctttcctg

SEQ ID NO: 139700 - DNA, 22 bp, Artificial Sequence
  chemically synthesized
ttttttttctgtgctttcctgg

SEQ ID NO: 139701 - DNA, 22 bp, Artificial Sequence
  chemically synthesized
tttttttctgtgctttcctggc

SEQ ID NO: 139702 - DNA, 22 bp, Artificial Sequence
  chemically synthesized
ttttttctgtgctttcctggct

SEQ ID NO: 139703 - DNA, 22 bp, Artificial Sequence
  chemically synthesized
tttttctgtgctttcctggctg

SEQ ID NO: 139704 - DNA, 22 bp, Artificial Sequence
  chemically synthesized
ttttctgtgctttcctggctgt

SEQ ID NO: 139705 - DNA, 22 bp, Artificial Sequence
  chemically synthesized
tttctgtgctttcctggctgtc

SEQ ID NO: 139706 - DNA, 22 bp, Artificial Sequence
  chemically synthesized
ttctgtgctttcctggctgtcc

SEQ ID NO: 139707 - DNA, 22 bp, Artificial Sequence
  chemically synthesized
tctgtgctttcctggctgtcca

SEQ ID NO: 139708 - DNA, 22 bp, Artificial Sequence
  chemically synthesized
ctgtgctttcctggctgtccaa

SEQ ID NO: 139709 - DNA, 22 bp, Artificial Sequence
  chemically synthesized
tgtgctttcctggctgtccaaa

SEQ ID NO: 139710 - DNA, 22 bp, Artificial Sequence
  chemically synthesized
tgctttcctggctgtccaaatc

SEQ ID NO: 139711 - DNA, 22 bp, Artificial Sequence
  chemically synthesized
tcctggctgtccaaatctctaa

SEQ ID NO: 139712 - DNA, 22 bp, Artificial Sequence
  chemically synthesized
cctggctgtccaaatctctaat

SEQ ID NO: 139713 - DNA, 22 bp, Artificial Sequence
  chemically synthesized
ctggctgtccaaatctctaatg

SEQ ID NO: 139714 - DNA, 22 bp, Artificial Sequence
  chemically synthesized
gctgtccaaatctctaatgata

SEQ ID NO: 139715 - DNA, 22 bp, Artificial Sequence
  chemically synthesized
tccaaatctctaatgataagca

SEQ ID NO: 139716 - DNA, 22 bp, Artificial Sequence
  chemically synthesized
taatgataagcatacttctatt

SEQ ID NO: 139717 - DNA, 22 bp, Artificial Sequence
  chemically synthesized
atgataagcatacttctattca

SEQ ID NO: 139718 - DNA, 22 bp, Artificial Sequence
  chemically synthesized
ctattcaatgagaatattctgt

SEQ ID NO: 139719 - DNA, 22 bp, Artificial Sequence
  chemically synthesized
tattcaatgagaatattctgta

SEQ ID NO: 139720 - DNA, 22 bp, Artificial Sequence
  chemically synthesized
ttcaatgagaatattctgtaag

SEQ ID NO: 139721 - DNA, 22 bp, Artificial Sequence
  chemically synthesized
aatgagaatattctgtaagatt

SEQ ID NO: 139722 - DNA, 22 bp, Artificial Sequence
  chemically synthesized
tgtaagattatagttaagaatt

SEQ ID NO: 139723 - DNA, 22 bp, Artificial Sequence
  chemically synthesized
taagattatagttaagaattgt

SEQ ID NO: 139724 - DNA, 22 bp, Artificial Sequence
  chemically synthesized
tagttaagaattgtgggagcca

SEQ ID NO: 139725 - DNA, 22 bp, Artificial Sequence
  chemically synthesized
agaattgtgggagccattccgt

SEQ ID NO: 139726 - DNA, 22 bp, Artificial Sequence
  chemically synthesized
tgggagccattccgtctcttat

SEQ ID NO: 139727 - DNA, 22 bp, Artificial Sequence
  chemically synthesized
cgtctcttatagttaaatttga

SEQ ID NO: 139728 - DNA, 22 bp, Artificial Sequence
  chemically synthesized
ttatagttaaatttgagcttct

SEQ ID NO: 139729 - DNA, 22 bp, Artificial Sequence
  chemically synthesized
atagttaaatttgagcttcttt

SEQ ID NO: 139730 - DNA, 22 bp, Artificial Sequence
  chemically synthesized
tagttaaatttgagcttctttt

SEQ ID NO: 139731 - DNA, 22 bp, Artificial Sequence
  chemically synthesized
aatttgagcttcttttatgatc

SEQ ID NO: 139732 - DNA, 22 bp, Artificial Sequence
  chemically synthesized
gagcttcttttatgatcactgt

SEQ ID NO: 139733 - DNA, 22 bp, Artificial Sequence
  chemically synthesized
agcttcttttatgatcactgtt

SEQ ID NO: 139734 - DNA, 22 bp, Artificial Sequence
  chemically synthesized
cttttatgatcactgttttttt

SEQ ID NO: 139735 - DNA, 22 bp, Artificial Sequence
  chemically synthesized
ttttatgatcactgttttttta

SEQ ID NO: 139736 - DNA, 22 bp, Artificial Sequence
  chemically synthesized
ttatgatcactgtttttttaat

SEQ ID NO: 139737 - DNA, 22 bp, Artificial Sequence
  chemically synthesized
tatgatcactgtttttttaata

SEQ ID NO: 139738 - DNA, 22 bp, Artificial Sequence
  chemically synthesized
atgatcactgtttttttaatat

SEQ ID NO: 139739 - DNA, 22 bp, Artificial Sequence
  chemically synthesized
tgatcactgtttttttaatatg

SEQ ID NO: 139740 - DNA, 22 bp, Artificial Sequence
  chemically synthesized
tttttttaatatgctttaagtt

SEQ ID NO: 139741 - DNA, 22 bp, Artificial Sequence
  chemically synthesized
ttttaatatgctttaagttctg

SEQ ID NO: 139742 - DNA, 22 bp, Artificial Sequence
  chemically synthesized
tttaatatgctttaagttctgg

SEQ ID NO: 139743 - DNA, 22 bp, Artificial Sequence
  chemically synthesized
ttaatatgctttaagttctggg

SEQ ID NO: 139744 - DNA, 22 bp, Artificial Sequence
  chemically synthesized
taatatgctttaagttctgggg

SEQ ID NO: 139745 - DNA, 22 bp, Artificial Sequence
  chemically synthesized
aatatgctttaagttctggggt

SEQ ID NO: 139746 - DNA, 22 bp, Artificial Sequence
  chemically synthesized
atatgctttaagttctggggta

SEQ ID NO: 139747 - DNA, 22 bp, Artificial Sequence
  chemically synthesized
taagttctggggtacatgtgcc

SEQ ID NO: 139748 - DNA, 22 bp, Artificial Sequence
  chemically synthesized
aagttctggggtacatgtgcca

SEQ ID NO: 139749 - DNA, 22 bp, Artificial Sequence
  chemically synthesized
agttctggggtacatgtgccat

SEQ ID NO: 139750 - DNA, 22 bp, Artificial Sequence
  chemically synthesized
tggggtacatgtgccatggtgg

SEQ ID NO: 139751 - DNA, 22 bp, Artificial Sequence
  chemically synthesized
gggtacatgtgccatggtggtt

SEQ ID NO: 139752 - DNA, 22 bp, Artificial Sequence
  chemically synthesized
gctgcacccatcaacccgtcat

SEQ ID NO: 139753 - DNA, 22 bp, Artificial Sequence
  chemically synthesized
ctgcacccatcaacccgtcatc

SEQ ID NO: 139754 - DNA, 22 bp, Artificial Sequence
  chemically synthesized
cacccatcaacccgtcatctac

SEQ ID NO: 139755 - DNA, 22 bp, Artificial Sequence
  chemically synthesized
cattaggtatttctcctaatgc

SEQ ID NO: 139756 - DNA, 22 bp, Artificial Sequence
  chemically synthesized
ggtatttctcctaatgctatcc

SEQ ID NO: 139757 - DNA, 22 bp, Artificial Sequence
  chemically synthesized
ctcctaatgctatccttcccct

SEQ ID NO: 139758 - DNA, 22 bp, Artificial Sequence
  chemically synthesized
tcctaatgctatccttccccta

SEQ ID NO: 139759 - DNA, 22 bp, Artificial Sequence
  chemically synthesized
ctaatgctatccttcccctagc

SEQ ID NO: 139760 - DNA, 22 bp, Artificial Sequence
  chemically synthesized
atgctatccttcccctagcccc

SEQ ID NO: 139761 - DNA, 22 bp, Artificial Sequence
  chemically synthesized
tccttcccctagccccccaccc

SEQ ID NO: 139762 - DNA, 22 bp, Artificial Sequence
  chemically synthesized
cccctagccccccacccccaac

SEQ ID NO: 139763 - DNA, 22 bp, Artificial Sequence
  chemically synthesized
ccctagccccccacccccaaca

SEQ ID NO: 139764 - DNA, 22 bp, Artificial Sequence
  chemically synthesized
gccccccacccccaacaggccc

SEQ ID NO: 139765 - DNA, 22 bp, Artificial Sequence
  chemically synthesized
ccctccctgtgtccatggatca

SEQ ID NO: 139766 - DNA, 22 bp, Artificial Sequence
  chemically synthesized
cctgtgtccatggatcactggt

SEQ ID NO: 139767 - DNA, 22 bp, Artificial Sequence
  chemically synthesized
tgtccatggatcactggttttt

SEQ ID NO: 139768 - DNA, 22 bp, Artificial Sequence
  chemically synthesized
gtttttttttgttttttttttt

SEQ ID NO: 139769 - DNA, 22 bp, Artificial Sequence
  chemically synthesized
ttttttgttttttttttttttt

SEQ ID NO: 139770 - DNA, 22 bp, Artificial Sequence
  chemically synthesized
tttttgtttttttttttttttt

SEQ ID NO: 139771 - DNA, 22 bp, Artificial Sequence
  chemically synthesized
ttttgtttttttttttttttta

SEQ ID NO: 139772 - DNA, 22 bp, Artificial Sequence
  chemically synthesized
tttgttttttttttttttttaa

SEQ ID NO: 139773 - DNA, 22 bp, Artificial Sequence
  chemically synthesized
ttgttttttttttttttttaaa

SEQ ID NO: 139774 - DNA, 22 bp, Artificial Sequence
  chemically synthesized
tgttttttttttttttttaaag

SEQ ID NO: 139775 - DNA, 22 bp, Artificial Sequence
  chemically synthesized
gttttttttttttttttaaagt

SEQ ID NO: 139776 - DNA, 22 bp, Artificial Sequence
  chemically synthesized
ttttttttttttttttaaagtc

SEQ ID NO: 139777 - DNA, 22 bp, Artificial Sequence
  chemically synthesized
tttttttttttttaaagtctca

SEQ ID NO: 139778 - DNA, 22 bp, Artificial Sequence
  chemically synthesized
ttttttttttttaaagtctcag

SEQ ID NO: 139779 - DNA, 22 bp, Artificial Sequence
  chemically synthesized
tttttttttttaaagtctcagt

SEQ ID NO: 139780 - DNA, 22 bp, Artificial Sequence
  chemically synthesized
ttttttttttaaagtctcagtt

SEQ ID NO: 139781 - DNA, 22 bp, Artificial Sequence
  chemically synthesized
tttttttttaaagtctcagtta

SEQ ID NO: 139782 - DNA, 22 bp, Artificial Sequence
  chemically synthesized
ttttttttaaagtctcagttaa

SEQ ID NO: 139783 - DNA, 22 bp, Artificial Sequence
  chemically synthesized
tttttttaaagtctcagttaaa

SEQ ID NO: 139784 - DNA, 22 bp, Artificial Sequence
  chemically synthesized
ttttttaaagtctcagttaaat

SEQ ID NO: 139785 - DNA, 22 bp, Artificial Sequence
  chemically synthesized
tttttaaagtctcagttaaatt

SEQ ID NO: 139786 - DNA, 22 bp, Artificial Sequence
  chemically synthesized
ttttaaagtctcagttaaattt

SEQ ID NO: 139787 - DNA, 22 bp, Artificial Sequence
  chemically synthesized
tttaaagtctcagttaaatttt

SEQ ID NO: 139788 - DNA, 22 bp, Artificial Sequence
  chemically synthesized
ttaaagtctcagttaaattttt

SEQ ID NO: 139789 - DNA, 22 bp, Artificial Sequence
  chemically synthesized
taaagtctcagttaaatttttg

SEQ ID NO: 139790 - DNA, 22 bp, Artificial Sequence
  chemically synthesized
aaagtctcagttaaatttttgg

SEQ ID NO: 139791 - DNA, 22 bp, Artificial Sequence
  chemically synthesized
aagtctcagttaaatttttgga

SEQ ID NO: 139792 - DNA, 22 bp, Artificial Sequence
  chemically synthesized
agttaaatttttggaatgtaat

SEQ ID NO: 139793 - DNA, 22 bp, Artificial Sequence
  chemically synthesized
aatttttggaatgtaatttatt

SEQ ID NO: 139794 - DNA, 22 bp, Artificial Sequence
  chemically synthesized
ttggaatgtaatttattttcct

SEQ ID NO: 139795 - DNA, 22 bp, Artificial Sequence
  chemically synthesized
tggaatgtaatttattttcctg

SEQ ID NO: 139796 - DNA, 22 bp, Artificial Sequence
  chemically synthesized
ggaatgtaatttattttcctgg

SEQ ID NO: 139797 - DNA, 22 bp, Artificial Sequence
  chemically synthesized
gaatgtaatttattttcctggt

SEQ ID NO: 139798 - DNA, 22 bp, Artificial Sequence
  chemically synthesized
attttcctggtatcctaggact

SEQ ID NO: 139799 - DNA, 22 bp, Artificial Sequence
  chemically synthesized
ttttcctggtatcctaggactt

SEQ ID NO: 139800 - DNA, 22 bp, Artificial Sequence
  chemically synthesized
tcctggtatcctaggacttgca

SEQ ID NO: 139801 - DNA, 22 bp, Artificial Sequence
  chemically synthesized
cctggtatcctaggacttgcaa

SEQ ID NO: 139802 - DNA, 22 bp, Artificial Sequence
  chemically synthesized
ctggtatcctaggacttgcaag

SEQ ID NO: 139803 - DNA, 22 bp, Artificial Sequence
  chemically synthesized
gtatcctaggacttgcaagtta

SEQ ID NO: 139804 - DNA, 22 bp, Artificial Sequence
  chemically synthesized
ggacttgcaagttatctggtca

SEQ ID NO: 139805 - DNA, 22 bp, Artificial Sequence
  chemically synthesized
gcaagttatctggtcactttag

SEQ ID NO: 139806 - DNA, 22 bp, Artificial Sequence
  chemically synthesized
caagttatctggtcactttagc

SEQ ID NO: 139807 - DNA, 22 bp, Artificial Sequence
  chemically synthesized
tctggtcactttagccctcacg

SEQ ID NO: 139808 - DNA, 22 bp, Artificial Sequence
  chemically synthesized
gtcactttagccctcacgtttt

SEQ ID NO: 139809 - DNA, 22 bp, Artificial Sequence
  chemically synthesized
tagccctcacgttttgatgata

SEQ ID NO: 139810 - DNA, 22 bp, Artificial Sequence
  chemically synthesized
agccctcacgttttgatgataa

SEQ ID NO: 139811 - DNA, 22 bp, Artificial Sequence
  chemically synthesized
gccctcacgttttgatgataat

SEQ ID NO: 139812 - DNA, 22 bp, Artificial Sequence
  chemically synthesized
acgttttgatgataatcacata

SEQ ID NO: 139813 - DNA, 22 bp, Artificial Sequence
  chemically synthesized
tgatgataatcacatatttgta

SEQ ID NO: 139814 - DNA, 22 bp, Artificial Sequence
  chemically synthesized
gatgataatcacatatttgtaa

SEQ ID NO: 139815 - DNA, 22 bp, Artificial Sequence
  chemically synthesized
atgataatcacatatttgtaaa

SEQ ID NO: 139816 - DNA, 22 bp, Artificial Sequence
  chemically synthesized
gtaaacacaacacacacacaca

SEQ ID NO: 139817 - DNA, 22 bp, Artificial Sequence
  chemically synthesized
taaacacaacacacacacacac

SEQ ID NO: 139818 - DNA, 22 bp, Artificial Sequence
  chemically synthesized
atcgggcatttctgagcaacta

SEQ ID NO: 139819 - DNA, 22 bp, Artificial Sequence
  chemically synthesized
tcgggcatttctgagcaactaa

SEQ ID NO: 139820 - DNA, 22 bp, Artificial Sequence
  chemically synthesized
ctgagcaactaatcatgcagga

SEQ ID NO: 139821 - DNA, 22 bp, Artificial Sequence
  chemically synthesized
tgagcaactaatcatgcaggac

SEQ ID NO: 139822 - DNA, 22 bp, Artificial Sequence
  chemically synthesized
agcaactaatcatgcaggactc

SEQ ID NO: 139823 - DNA, 22 bp, Artificial Sequence
  chemically synthesized
atcatgcaggactctcaaacac

SEQ ID NO: 139824 - DNA, 22 bp, Artificial Sequence
  chemically synthesized
tcaaacactaacctatagcctt

SEQ ID NO: 139825 - DNA, 22 bp, Artificial Sequence
  chemically synthesized
aaacactaacctatagcctttt

SEQ ID NO: 139826 - DNA, 22 bp, Artificial Sequence
  chemically synthesized
acctatagccttttctatgtat

SEQ ID NO: 139827 - DNA, 22 bp, Artificial Sequence
  chemically synthesized
tagccttttctatgtatctact

SEQ ID NO: 139828 - DNA, 22 bp, Artificial Sequence
  chemically synthesized
ttctatgtatctacttgtgtag

SEQ ID NO: 139829 - DNA, 22 bp, Artificial Sequence
  chemically synthesized
tctatgtatctacttgtgtaga

SEQ ID NO: 139830 - DNA, 22 bp, Artificial Sequence
  chemically synthesized
ctatgtatctacttgtgtagaa

SEQ ID NO: 139831 - DNA, 22 bp, Artificial Sequence
  chemically synthesized
tatgtatctacttgtgtagaaa

SEQ ID NO: 139832 - DNA, 22 bp, Artificial Sequence
  chemically synthesized
tgtatctacttgtgtagaaacc

SEQ ID NO: 139833 - DNA, 22 bp, Artificial Sequence
  chemically synthesized
cttgtgtagaaaccaagcgtgg

SEQ ID NO: 139834 - DNA, 22 bp, Artificial Sequence
  chemically synthesized
gtgtagaaaccaagcgtgggga

SEQ ID NO: 139835 - DNA, 22 bp, Artificial Sequence
  chemically synthesized
tgtagaaaccaagcgtggggac

SEQ ID NO: 139836 - DNA, 22 bp, Artificial Sequence
  chemically synthesized
agaaggcaatagcaggagcatt

SEQ ID NO: 139837 - DNA, 22 bp, Artificial Sequence
  chemically synthesized
tgactctcactgcctttagcta

SEQ ID NO: 139838 - DNA, 22 bp, Artificial Sequence
  chemically synthesized
actctcactgcctttagctagg

SEQ ID NO: 139839 - DNA, 22 bp, Artificial Sequence
  chemically synthesized
tcactgcctttagctaggcccc

SEQ ID NO: 139840 - DNA, 22 bp, Artificial Sequence
  chemically synthesized
actgcctttagctaggcccctc

SEQ ID NO: 139841 - DNA, 22 bp, Artificial Sequence
  chemically synthesized
cctttagctaggcccctccctc

SEQ ID NO: 139842 - DNA, 22 bp, Artificial Sequence
  chemically synthesized
tagctaggcccctccctcatca

SEQ ID NO: 139843 - DNA, 22 bp, Artificial Sequence
  chemically synthesized
agctaggcccctccctcatcac

SEQ ID NO: 139844 - DNA, 22 bp, Artificial Sequence
  chemically synthesized
gctaggcccctccctcatcaca

SEQ ID NO: 139845 - DNA, 22 bp, Artificial Sequence
  chemically synthesized
ggcccctccctcatcacagctc

SEQ ID NO: 139846 - DNA, 22 bp, Artificial Sequence
  chemically synthesized
cctcatcacagctcagcatagt

SEQ ID NO: 139847 - DNA, 22 bp, Artificial Sequence
  chemically synthesized
atcacagctcagcatagtcctg

SEQ ID NO: 139848 - DNA, 22 bp, Artificial Sequence
  chemically synthesized
agcatagtcctgagctcttatc

SEQ ID NO: 139849 - DNA, 22 bp, Artificial Sequence
  chemically synthesized
agctcttatctatatccacaca

SEQ ID NO: 139850 - DNA, 22 bp, Artificial Sequence
  chemically synthesized
ttatctatatccacacacagtt

SEQ ID NO: 139851 - DNA, 22 bp, Artificial Sequence
  chemically synthesized
atctatatccacacacagtttc

SEQ ID NO: 139852 - DNA, 22 bp, Artificial Sequence
  chemically synthesized
tctatatccacacacagtttct

SEQ ID NO: 139853 - DNA, 22 bp, Artificial Sequence
  chemically synthesized
tatccacacacagtttctgacg

SEQ ID NO: 139854 - DNA, 22 bp, Artificial Sequence
  chemically synthesized
ctgacgctgcccagctatcacc

SEQ ID NO: 139855 - DNA, 22 bp, Artificial Sequence
  chemically synthesized
tgacgctgcccagctatcacca

SEQ ID NO: 139856 - DNA, 22 bp, Artificial Sequence
  chemically synthesized
acgctgcccagctatcaccatc

SEQ ID NO: 139857 - DNA, 22 bp, Artificial Sequence
  chemically synthesized
cccagctatcaccatcccaagt

SEQ ID NO: 139858 - DNA, 22 bp, Artificial Sequence
  chemically synthesized
tcaccatcccaagtctaaagaa

SEQ ID NO: 139859 - DNA, 22 bp, Artificial Sequence
  chemically synthesized
aagaaaaaaataatgggtttgc

SEQ ID NO: 139860 - DNA, 22 bp, Artificial Sequence
  chemically synthesized
gcccatctctgttgattagaaa

SEQ ID NO: 139861 - DNA, 22 bp, Artificial Sequence
  chemically synthesized
cccatctctgttgattagaaaa

SEQ ID NO: 139862 - DNA, 22 bp, Artificial Sequence
  chemically synthesized
tgttgattagaaaacaaaacaa

SEQ ID NO: 139863 - DNA, 22 bp, Artificial Sequence
  chemically synthesized
ttgattagaaaacaaaacaaaa

SEQ ID NO: 139864 - DNA, 22 bp, Artificial Sequence
  chemically synthesized
attagaaaacaaaacaaaataa

SEQ ID NO: 139865 - DNA, 22 bp, Artificial Sequence
  chemically synthesized
gaaaacaaaacaaaataaaata

SEQ ID NO: 139866 - DNA, 22 bp, Artificial Sequence
  chemically synthesized
agctcccagaaaacatgactaa

SEQ ID NO: 139867 - DNA, 22 bp, Artificial Sequence
  chemically synthesized
ccagaaaacatgactaaaccag

SEQ ID NO: 139868 - DNA, 22 bp, Artificial Sequence
  chemically synthesized
aaccagcaagaagaagaaaata

SEQ ID NO: 139869 - DNA, 22 bp, Artificial Sequence
  chemically synthesized
gtgacactagtgtctgaatgag

SEQ ID NO: 139870 - DNA, 22 bp, Artificial Sequence
  chemically synthesized
gtgtctgaatgaggcttgagta

SEQ ID NO: 139871 - DNA, 22 bp, Artificial Sequence
  chemically synthesized
aatgaggcttgagtacagaaaa

SEQ ID NO: 139872 - DNA, 22 bp, Artificial Sequence
  chemically synthesized
gagtacagaaaagaggctctag

SEQ ID NO: 139873 - DNA, 22 bp, Artificial Sequence
  chemically synthesized
agtacagaaaagaggctctagc

SEQ ID NO: 139874 - DNA, 22 bp, Artificial Sequence
  chemically synthesized
tagcagcatagtggtttagagg

SEQ ID NO: 139875 - DNA, 22 bp, Artificial Sequence
  chemically synthesized
gcagcatagtggtttagaggag

SEQ ID NO: 139876 - DNA, 22 bp, Artificial Sequence
  chemically synthesized
agaggagatgtttctttccttc

SEQ ID NO: 139877 - DNA, 22 bp, Artificial Sequence
  chemically synthesized
gaggagatgtttctttccttca

SEQ ID NO: 139878 - DNA, 22 bp, Artificial Sequence
  chemically synthesized
ctttccttcacagatgccttag

SEQ ID NO: 139879 - DNA, 22 bp, Artificial Sequence
  chemically synthesized
tttccttcacagatgccttagc

SEQ ID NO: 139880 - DNA, 22 bp, Artificial Sequence
  chemically synthesized
tccttcacagatgccttagcct

SEQ ID NO: 139881 - DNA, 22 bp, Artificial Sequence
  chemically synthesized
ccttcacagatgccttagcctc

SEQ ID NO: 139882 - DNA, 22 bp, Artificial Sequence
  chemically synthesized
cttcacagatgccttagcctca

SEQ ID NO: 139883 - DNA, 22 bp, Artificial Sequence
  chemically synthesized
cacagatgccttagcctcaata

SEQ ID NO: 139884 - DNA, 22 bp, Artificial Sequence
  chemically synthesized
acagatgccttagcctcaataa

SEQ ID NO: 139885 - DNA, 22 bp, Artificial Sequence
  chemically synthesized
agcctcaataagcttgcggttg

SEQ ID NO: 139886 - DNA, 22 bp, Artificial Sequence
  chemically synthesized
gcctcaataagcttgcggttgt

SEQ ID NO: 139887 - DNA, 22 bp, Artificial Sequence
  chemically synthesized
aataagcttgcggttgtggaag

SEQ ID NO: 139888 - DNA, 22 bp, Artificial Sequence
  chemically synthesized
gcggttgtggaagtttactttc

SEQ ID NO: 139889 - DNA, 22 bp, Artificial Sequence
  chemically synthesized
cggttgtggaagtttactttca

SEQ ID NO: 139890 - DNA, 22 bp, Artificial Sequence
  chemically synthesized
tggaagtttactttcagaacaa

SEQ ID NO: 139891 - DNA, 22 bp, Artificial Sequence
  chemically synthesized
actttcagaacaaactcctgtg

SEQ ID NO: 139892 - DNA, 22 bp, Artificial Sequence
  chemically synthesized
ctttcagaacaaactcctgtgg

SEQ ID NO: 139893 - DNA, 22 bp, Artificial Sequence
  chemically synthesized
tcagaacaaactcctgtggggc

SEQ ID NO: 139894 - DNA, 22 bp, Artificial Sequence
  chemically synthesized
cagaacaaactcctgtggggct

SEQ ID NO: 139895 - DNA, 22 bp, Artificial Sequence
  chemically synthesized
agaacaaactcctgtggggcta

SEQ ID NO: 139896 - DNA, 22 bp, Artificial Sequence
  chemically synthesized
ctgtggggctagaattattgat

SEQ ID NO: 139897 - DNA, 22 bp, Artificial Sequence
  chemically synthesized
tggggctagaattattgatggc

SEQ ID NO: 139898 - DNA, 22 bp, Artificial Sequence
  chemically synthesized
gaattattgatggctaaaagaa

SEQ ID NO: 139899 - DNA, 22 bp, Artificial Sequence
  chemically synthesized
ttgatggctaaaagaagcccgg

SEQ ID NO: 139900 - DNA, 22 bp, Artificial Sequence
  chemically synthesized
atggctaaaagaagcccggggg

SEQ ID NO: 139901 - DNA, 22 bp, Artificial Sequence
  chemically synthesized
aaagaagcccgggggagggaaa

SEQ ID NO: 139902 - DNA, 22 bp, Artificial Sequence
  chemically synthesized
agcatcctcacccttagtgaca

SEQ ID NO: 139903 - DNA, 22 bp, Artificial Sequence
  chemically synthesized
acccttagtgacacaaaacaga

SEQ ID NO: 139904 - DNA, 22 bp, Artificial Sequence
  chemically synthesized
agtgacacaaaacagagggggc

SEQ ID NO: 139905 - DNA, 22 bp, Artificial Sequence
  chemically synthesized
gtgacacaaaacagagggggcc

SEQ ID NO: 139906 - DNA, 22 bp, Artificial Sequence
  chemically synthesized
gttttccatatttcctcatgat

SEQ ID NO: 139907 - DNA, 22 bp, Artificial Sequence
  chemically synthesized
tccatatttcctcatgatggat

SEQ ID NO: 139908 - DNA, 22 bp, Artificial Sequence
  chemically synthesized
ccatatttcctcatgatggatg

SEQ ID NO: 139909 - DNA, 22 bp, Artificial Sequence
  chemically synthesized
catatttcctcatgatggatga

SEQ ID NO: 139910 - DNA, 22 bp, Artificial Sequence
  chemically synthesized
cctcatgatggatgatctcgtt

SEQ ID NO: 139911 - DNA, 22 bp, Artificial Sequence
  chemically synthesized
ctcatgatggatgatctcgtta

SEQ ID NO: 139912 - DNA, 22 bp, Artificial Sequence
  chemically synthesized
atgatggatgatctcgttaatg

SEQ ID NO: 139913 - DNA, 22 bp, Artificial Sequence
  chemically synthesized
gttaatgaaggtggtctgacga

SEQ ID NO: 139914 - DNA, 22 bp, Artificial Sequence
  chemically synthesized
atgaaggtggtctgacgagatc

SEQ ID NO: 139915 - DNA, 22 bp, Artificial Sequence
  chemically synthesized
acgagatcattgcttcttccat

SEQ ID NO: 139916 - DNA, 22 bp, Artificial Sequence
  chemically synthesized
cttcttccatttaagccttgct

SEQ ID NO: 139917 - DNA, 22 bp, Artificial Sequence
  chemically synthesized
cttccatttaagccttgctcac

SEQ ID NO: 139918 - DNA, 22 bp, Artificial Sequence
  chemically synthesized
ttccatttaagccttgctcact

SEQ ID NO: 139919 - DNA, 22 bp, Artificial Sequence
  chemically synthesized
ccatttaagccttgctcacttg

SEQ ID NO: 139920 - DNA, 22 bp, Artificial Sequence
  chemically synthesized
catttaagccttgctcacttgc

SEQ ID NO: 139921 - DNA, 22 bp, Artificial Sequence
  chemically synthesized
aagccttgctcacttgccaatc

SEQ ID NO: 139922 - DNA, 22 bp, Artificial Sequence
  chemically synthesized
agccttgctcacttgccaatcc

SEQ ID NO: 139923 - DNA, 22 bp, Artificial Sequence
  chemically synthesized
gctcacttgccaatcctcagtt

SEQ ID NO: 139924 - DNA, 22 bp, Artificial Sequence
  chemically synthesized
ctcacttgccaatcctcagttt

SEQ ID NO: 139925 - DNA, 22 bp, Artificial Sequence
  chemically synthesized
acttgccaatcctcagttttaa

SEQ ID NO: 139926 - DNA, 22 bp, Artificial Sequence
  chemically synthesized
gccaatcctcagttttaacctt

SEQ ID NO: 139927 - DNA, 22 bp, Artificial Sequence
  chemically synthesized
ccaatcctcagttttaaccttc

SEQ ID NO: 139928 - DNA, 22 bp, Artificial Sequence
  chemically synthesized
agttttaaccttctccagagaa

SEQ ID NO: 139929 - DNA, 22 bp, Artificial Sequence
  chemically synthesized
taaccttctccagagaaataca

SEQ ID NO: 139930 - DNA, 22 bp, Artificial Sequence
  chemically synthesized
aaccttctccagagaaatacac

SEQ ID NO: 139931 - DNA, 22 bp, Artificial Sequence
  chemically synthesized
accttctccagagaaatacaca

SEQ ID NO: 139932 - DNA, 22 bp, Artificial Sequence
  chemically synthesized
ctccagagaaatacacattttt

SEQ ID NO: 139933 - DNA, 22 bp, Artificial Sequence
  chemically synthesized
tccagagaaatacacatttttt

SEQ ID NO: 139934 - DNA, 22 bp, Artificial Sequence
  chemically synthesized
cagagaaatacacattttttat

SEQ ID NO: 139935 - DNA, 22 bp, Artificial Sequence
  chemically synthesized
tttattcaggaaacatactatg

SEQ ID NO: 139936 - DNA, 22 bp, Artificial Sequence
  chemically synthesized
ttattcaggaaacatactatgt

SEQ ID NO: 139937 - DNA, 22 bp, Artificial Sequence
  chemically synthesized
tattcaggaaacatactatgtt

SEQ ID NO: 139938 - DNA, 22 bp, Artificial Sequence
  chemically synthesized
attcaggaaacatactatgtta

SEQ ID NO: 139939 - DNA, 22 bp, Artificial Sequence
  chemically synthesized
ttcaggaaacatactatgttat

SEQ ID NO: 139940 - DNA, 22 bp, Artificial Sequence
  chemically synthesized
aggaaacatactatgttatagt

SEQ ID NO: 139941 - DNA, 22 bp, Artificial Sequence
  chemically synthesized
tgttatagtttcaatactaaat

SEQ ID NO: 139942 - DNA, 22 bp, Artificial Sequence
  chemically synthesized
tagtttcaatactaaataatca

SEQ ID NO: 139943 - DNA, 22 bp, Artificial Sequence
  chemically synthesized
caatactaaataatcaaagtac

SEQ ID NO: 139944 - DNA, 22 bp, Artificial Sequence
  chemically synthesized
aatactaaataatcaaagtact

SEQ ID NO: 139945 - DNA, 22 bp, Artificial Sequence
  chemically synthesized
aataatcaaagtactgaagata

SEQ ID NO: 139946 - DNA, 22 bp, Artificial Sequence
  chemically synthesized
aagatagcatgcataggcaaga

SEQ ID NO: 139947 - DNA, 22 bp, Artificial Sequence
  chemically synthesized
agctttatgttgctgttgtttc

SEQ ID NO: 139948 - DNA, 22 bp, Artificial Sequence
  chemically synthesized
gctttatgttgctgttgtttca

SEQ ID NO: 139949 - DNA, 22 bp, Artificial Sequence
  chemically synthesized
tatgttgctgttgtttcagaat

SEQ ID NO: 139950 - DNA, 22 bp, Artificial Sequence
  chemically synthesized
atgttgctgttgtttcagaatt

SEQ ID NO: 139951 - DNA, 22 bp, Artificial Sequence
  chemically synthesized
tgttgctgttgtttcagaattt

SEQ ID NO: 139952 - DNA, 22 bp, Artificial Sequence
  chemically synthesized
ctgttgtttcagaatttaaaaa

SEQ ID NO: 139953 - DNA, 22 bp, Artificial Sequence
  chemically synthesized
ttgtttcagaatttaaaaaaga

SEQ ID NO: 139954 - DNA, 22 bp, Artificial Sequence
  chemically synthesized
tttcagaatttaaaaaagatca

SEQ ID NO: 139955 - DNA, 22 bp, Artificial Sequence
  chemically synthesized
cagaatttaaaaaagatcacca

SEQ ID NO: 139956 - DNA, 22 bp, Artificial Sequence
  chemically synthesized
agaatttaaaaaagatcaccaa

SEQ ID NO: 139957 - DNA, 22 bp, Artificial Sequence
  chemically synthesized
aaaaaagatcaccaagtcaagg

SEQ ID NO: 139958 - DNA, 22 bp, Artificial Sequence
  chemically synthesized
aaaaagatcaccaagtcaagga

SEQ ID NO: 139959 - DNA, 22 bp, Artificial Sequence
  chemically synthesized
ctcagttctagcactagaggtg

SEQ ID NO: 139960 - DNA, 22 bp, Artificial Sequence
  chemically synthesized
tcagttctagcactagaggtgg

SEQ ID NO: 139961 - DNA, 22 bp, Artificial Sequence
  chemically synthesized
agttctagcactagaggtggaa

SEQ ID NO: 139962 - DNA, 22 bp, Artificial Sequence
  chemically synthesized
tagcactagaggtggaatctta

SEQ ID NO: 139963 - DNA, 22 bp, Artificial Sequence
  chemically synthesized
gcactagaggtggaatcttagc

SEQ ID NO: 139964 - DNA, 22 bp, Artificial Sequence
  chemically synthesized
gaggtggaatcttagcatataa

SEQ ID NO: 139965 - DNA, 22 bp, Artificial Sequence
  chemically synthesized
agcatataatcagaggtttttc

SEQ ID NO: 139966 - DNA, 22 bp, Artificial Sequence
  chemically synthesized
gcatataatcagaggtttttca

SEQ ID NO: 139967 - DNA, 22 bp, Artificial Sequence
  chemically synthesized
ttcaaaatttctagacataaga

SEQ ID NO: 139968 - DNA, 22 bp, Artificial Sequence
  chemically synthesized
tcaaaatttctagacataagat

SEQ ID NO: 139969 - DNA, 22 bp, Artificial Sequence
  chemically synthesized
caaaatttctagacataagatt

SEQ ID NO: 139970 - DNA, 22 bp, Artificial Sequence
  chemically synthesized
aaaatttctagacataagattc

SEQ ID NO: 139971 - DNA, 22 bp, Artificial Sequence
  chemically synthesized
ctagacataagattcaaagccc

SEQ ID NO: 139972 - DNA, 22 bp, Artificial Sequence
  chemically synthesized
tagacataagattcaaagccct

SEQ ID NO: 139973 - DNA, 22 bp, Artificial Sequence
  chemically synthesized
gacataagattcaaagccctgc

SEQ ID NO: 139974 - DNA, 22 bp, Artificial Sequence
  chemically synthesized
aaagccctgcacttaaaatagt

SEQ ID NO: 139975 - DNA, 22 bp, Artificial Sequence
  chemically synthesized
cacttaaaatagtctcatttga

SEQ ID NO: 139976 - DNA, 22 bp, Artificial Sequence
  chemically synthesized
aaaatagtctcatttgaattaa

SEQ ID NO: 139977 - DNA, 22 bp, Artificial Sequence
  chemically synthesized
aaatagtctcatttgaattaac

SEQ ID NO: 139978 - DNA, 22 bp, Artificial Sequence
  chemically synthesized
atttgaattaactctttatata

SEQ ID NO: 139979 - DNA, 22 bp, Artificial Sequence
  chemically synthesized
gaattaactctttatataaatt

SEQ ID NO: 139980 - DNA, 22 bp, Artificial Sequence
  chemically synthesized
aattaactctttatataaattg

SEQ ID NO: 139981 - DNA, 22 bp, Artificial Sequence
  chemically synthesized
actctttatataaattgaaagc

SEQ ID NO: 139982 - DNA, 22 bp, Artificial Sequence
  chemically synthesized
tttatataaattgaaagcacat

SEQ ID NO: 139983 - DNA, 22 bp, Artificial Sequence
  chemically synthesized
tatataaattgaaagcacattc

SEQ ID NO: 139984 - DNA, 22 bp, Artificial Sequence
  chemically synthesized
atataaattgaaagcacattct

SEQ ID NO: 139985 - DNA, 22 bp, Artificial Sequence
  chemically synthesized
tataaattgaaagcacattctg

SEQ ID NO: 139986 - DNA, 22 bp, Artificial Sequence
  chemically synthesized
aaagcacattctgaactacttc

SEQ ID NO: 139987 - DNA, 22 bp, Artificial Sequence
  chemically synthesized
tgaactacttcagagtattgtt

SEQ ID NO: 139988 - DNA, 22 bp, Artificial Sequence
  chemically synthesized
aactacttcagagtattgtttt

SEQ ID NO: 139989 - DNA, 22 bp, Artificial Sequence
  chemically synthesized
cttcagagtattgttttatttc

SEQ ID NO: 139990 - DNA, 22 bp, Artificial Sequence
  chemically synthesized
cagagtattgttttatttctat

SEQ ID NO: 139991 - DNA, 22 bp, Artificial Sequence
  chemically synthesized
agagtattgttttatttctatg

SEQ ID NO: 139992 - DNA, 22 bp, Artificial Sequence
  chemically synthesized
ttttatttctatgttcttagtt

SEQ ID NO: 139993 - DNA, 22 bp, Artificial Sequence
  chemically synthesized
tatttctatgttcttagttcat

SEQ ID NO: 139994 - DNA, 22 bp, Artificial Sequence
  chemically synthesized
atttctatgttcttagttcata

SEQ ID NO: 139995 - DNA, 22 bp, Artificial Sequence
  chemically synthesized
tttctatgttcttagttcataa

SEQ ID NO: 139996 - DNA, 22 bp, Artificial Sequence
  chemically synthesized
ctatgttcttagttcataaata

SEQ ID NO: 139997 - DNA, 22 bp, Artificial Sequence
  chemically synthesized
tatgttcttagttcataaatac

SEQ ID NO: 139998 - DNA, 22 bp, Artificial Sequence
  chemically synthesized
tgttcttagttcataaatacat

SEQ ID NO: 139999 - DNA, 22 bp, Artificial Sequence
  chemically synthesized
ttagttcataaatacattaggc

SEQ ID NO: 140000 - DNA, 22 bp, Artificial Sequence
  chemically synthesized
agttcataaatacattaggcaa

SEQ ID NO: 140001 - DNA, 22 bp, Artificial Sequence
  chemically synthesized
gttcataaatacattaggcaat

SEQ ID NO: 140002 - DNA, 22 bp, Artificial Sequence
  chemically synthesized
ataaatacattaggcaatgcaa

SEQ ID NO: 140003 - DNA, 22 bp, Artificial Sequence
  chemically synthesized
ggcaatgcaatttaattaaaaa

SEQ ID NO: 140004 - DNA, 22 bp, Artificial Sequence
  chemically synthesized
aattaaaaaaacccaagaattt

SEQ ID NO: 140005 - DNA, 22 bp, Artificial Sequence
  chemically synthesized
attaaaaaaacccaagaatttc

SEQ ID NO: 140006 - DNA, 22 bp, Artificial Sequence
  chemically synthesized
aaaaaacccaagaatttcttag

SEQ ID NO: 140007 - DNA, 22 bp, Artificial Sequence
  chemically synthesized
cttagaattttaatcatgaaaa

SEQ ID NO: 140008 - DNA, 22 bp, Artificial Sequence
  chemically synthesized
ttagaattttaatcatgaaaat

SEQ ID NO: 140009 - DNA, 22 bp, Artificial Sequence
  chemically synthesized
agaattttaatcatgaaaataa

SEQ ID NO: 140010 - DNA, 22 bp, Artificial Sequence
  chemically synthesized
gaattttaatcatgaaaataaa

SEQ ID NO: 140011 - DNA, 22 bp, Artificial Sequence
  chemically synthesized
taatcatgaaaataaatgaagg

SEQ ID NO: 140012 - DNA, 22 bp, Artificial Sequence
  chemically synthesized
aatcatgaaaataaatgaaggc

SEQ ID NO: 140013 - DNA, 22 bp, Artificial Sequence
  chemically synthesized
atcatgaaaataaatgaaggca

SEQ ID NO: 140014 - DNA, 22 bp, Artificial Sequence
  chemically synthesized
tacttactcaaggtcccaaaag

SEQ ID NO: 140015 - DNA, 22 bp, Artificial Sequence
  chemically synthesized
acttactcaaggtcccaaaagg

SEQ ID NO: 140016 - DNA, 22 bp, Artificial Sequence
  chemically synthesized
cttactcaaggtcccaaaaggt

SEQ ID NO: 140017 - DNA, 22 bp, Artificial Sequence
  chemically synthesized
actcaaggtcccaaaaggtcaa

SEQ ID NO: 140018 - DNA, 22 bp, Artificial Sequence
  chemically synthesized
ctcaaggtcccaaaaggtcaaa

SEQ ID NO: 140019 - DNA, 22 bp, Artificial Sequence
  chemically synthesized
aaggtcccaaaaggtcaaagaa

SEQ ID NO: 140020 - DNA, 22 bp, Artificial Sequence
  chemically synthesized
tatttcagcggaaaatgggata

SEQ ID NO: 140021 - DNA, 22 bp, Artificial Sequence
  chemically synthesized
cagcggaaaatgggatatttat

SEQ ID NO: 140022 - DNA, 22 bp, Artificial Sequence
  chemically synthesized
agcggaaaatgggatatttatg

SEQ ID NO: 140023 - DNA, 22 bp, Artificial Sequence
  chemically synthesized
atgagttttctaagttgacaga

SEQ ID NO: 140024 - DNA, 22 bp, Artificial Sequence
  chemically synthesized
tgagttttctaagttgacagac

SEQ ID NO: 140025 - DNA, 22 bp, Artificial Sequence
  chemically synthesized
tctaagttgacagactcaagtt

SEQ ID NO: 140026 - DNA, 22 bp, Artificial Sequence
  chemically synthesized
ctaagttgacagactcaagttt

SEQ ID NO: 140027 - DNA, 22 bp, Artificial Sequence
  chemically synthesized
taagttgacagactcaagtttt

SEQ ID NO: 140028 - DNA, 22 bp, Artificial Sequence
  chemically synthesized
agttgacagactcaagttttaa

SEQ ID NO: 140029 - DNA, 22 bp, Artificial Sequence
  chemically synthesized
acagactcaagttttaaccttc

SEQ ID NO: 140030 - DNA, 22 bp, Artificial Sequence
  chemically synthesized
aagttttaaccttcagtgccca

SEQ ID NO: 140031 - DNA, 22 bp, Artificial Sequence
  chemically synthesized
taaccttcagtgcccatcatgt

SEQ ID NO: 140032 - DNA, 22 bp, Artificial Sequence
  chemically synthesized
aaccttcagtgcccatcatgta

SEQ ID NO: 140033 - DNA, 22 bp, Artificial Sequence
  chemically synthesized
accttcagtgcccatcatgtag

SEQ ID NO: 140034 - DNA, 22 bp, Artificial Sequence
  chemically synthesized
cagtgcccatcatgtaggaaag

SEQ ID NO: 140035 - DNA, 22 bp, Artificial Sequence
  chemically synthesized
agtgcccatcatgtaggaaagt

SEQ ID NO: 140036 - DNA, 22 bp, Artificial Sequence
  chemically synthesized
gctgattctggctttctactcc

SEQ ID NO: 140037 - DNA, 22 bp, Artificial Sequence
  chemically synthesized
attctggctttctactcctttt

SEQ ID NO: 140038 - DNA, 22 bp, Artificial Sequence
  chemically synthesized
tggctttctactcctttttccc

SEQ ID NO: 140039 - DNA, 22 bp, Artificial Sequence
  chemically synthesized
gctttctactcctttttcccat

SEQ ID NO: 140040 - DNA, 22 bp, Artificial Sequence
  chemically synthesized
tctactcctttttcccattaaa

SEQ ID NO: 140041 - DNA, 22 bp, Artificial Sequence
  chemically synthesized
ctactcctttttcccattaaag

SEQ ID NO: 140042 - DNA, 22 bp, Artificial Sequence
  chemically synthesized
tactcctttttcccattaaaga

SEQ ID NO: 140043 - DNA, 22 bp, Artificial Sequence
  chemically synthesized
ctcctttttcccattaaagatc

SEQ ID NO: 140044 - DNA, 22 bp, Artificial Sequence
  chemically synthesized
ctttttcccattaaagatccct

SEQ ID NO: 140045 - DNA, 22 bp, Artificial Sequence
  chemically synthesized
tttcccattaaagatccctcct

SEQ ID NO: 140046 - DNA, 22 bp, Artificial Sequence
  chemically synthesized
ttcccattaaagatccctcctg

SEQ ID NO: 140047 - DNA, 22 bp, Artificial Sequence
  chemically synthesized
tcccattaaagatccctcctgc

SEQ ID NO: 140048 - DNA, 22 bp, Artificial Sequence
  chemically synthesized
cccattaaagatccctcctgct

SEQ ID NO: 140049 - DNA, 22 bp, Artificial Sequence
  chemically synthesized
ccattaaagatccctcctgctt

SEQ ID NO: 140050 - DNA, 22 bp, Artificial Sequence
  chemically synthesized
aagatccctcctgcttaattaa

SEQ ID NO: 140051 - DNA, 22 bp, Artificial Sequence
  chemically synthesized
ctgcttaattaacattcacaag

SEQ ID NO: 140052 - DNA, 22 bp, Artificial Sequence
  chemically synthesized
cttaattaacattcacaagtaa

SEQ ID NO: 140053 - DNA, 22 bp, Artificial Sequence
  chemically synthesized
aattaacattcacaagtaactc

SEQ ID NO: 140054 - DNA, 22 bp, Artificial Sequence
  chemically synthesized
attaacattcacaagtaactct

SEQ ID NO: 140055 - DNA, 22 bp, Artificial Sequence
  chemically synthesized
acattcacaagtaactctggtt

SEQ ID NO: 140056 - DNA, 22 bp, Artificial Sequence
  chemically synthesized
acaagtaactctggttgtactt

SEQ ID NO: 140057 - DNA, 22 bp, Artificial Sequence
  chemically synthesized
tggttgtactttaggcacagtg

SEQ ID NO: 140058 - DNA, 22 bp, Artificial Sequence
  chemically synthesized
gttgtactttaggcacagtggc

SEQ ID NO: 140059 - DNA, 22 bp, Artificial Sequence
  chemically synthesized
tactttaggcacagtggctccc

SEQ ID NO: 140060 - DNA, 22 bp, Artificial Sequence
  chemically synthesized
taggcacagtggctcccgaggt

SEQ ID NO: 140061 - DNA, 22 bp, Artificial Sequence
  chemically synthesized
aggcacagtggctcccgaggtc

SEQ ID NO: 140062 - DNA, 22 bp, Artificial Sequence
  chemically synthesized
ggcacagtggctcccgaggtca

SEQ ID NO: 140063 - DNA, 22 bp, Artificial Sequence
  chemically synthesized
ccgaggtcagtcacacaatagg

SEQ ID NO: 140064 - DNA, 22 bp, Artificial Sequence
  chemically synthesized
tgctccaagttgccagagagag

SEQ ID NO: 140065 - DNA, 22 bp, Artificial Sequence
  chemically synthesized
caagttgccagagagagagatt

SEQ ID NO: 140066 - DNA, 22 bp, Artificial Sequence
  chemically synthesized
ccagagagagagattactcttg

SEQ ID NO: 140067 - DNA, 22 bp, Artificial Sequence
  chemically synthesized
ctcttgagaatgagcctcagcc

SEQ ID NO: 140068 - DNA, 22 bp, Artificial Sequence
  chemically synthesized
ttgagaatgagcctcagccctg

SEQ ID NO: 140069 - DNA, 22 bp, Artificial Sequence
  chemically synthesized
gagaatgagcctcagccctggc

SEQ ID NO: 140070 - DNA, 22 bp, Artificial Sequence
  chemically synthesized
agaatgagcctcagccctggct

SEQ ID NO: 140071 - DNA, 22 bp, Artificial Sequence
  chemically synthesized
agccctggctcaaactcacctg

SEQ ID NO: 140072 - DNA, 22 bp, Artificial Sequence
  chemically synthesized
gctcaaactcacctgcaaactt

SEQ ID NO: 140073 - DNA, 22 bp, Artificial Sequence
  chemically synthesized
aaactcacctgcaaacttcgtg

SEQ ID NO: 140074 - DNA, 22 bp, Artificial Sequence
  chemically synthesized
acctgcaaacttcgtgagagat

SEQ ID NO: 140075 - DNA, 22 bp, Artificial Sequence
  chemically synthesized
caaacttcgtgagagatgaggc

SEQ ID NO: 140076 - DNA, 22 bp, Artificial Sequence
  chemically synthesized
cgtgagagatgaggcagaggta

SEQ ID NO: 140077 - DNA, 22 bp, Artificial Sequence
  chemically synthesized
gtgagagatgaggcagaggtac

SEQ ID NO: 140078 - DNA, 22 bp, Artificial Sequence
  chemically synthesized
cgaaagcaacagttagaagcta

SEQ ID NO: 140079 - DNA, 22 bp, Artificial Sequence
  chemically synthesized
gaagctaaatgatgagaacaca

SEQ ID NO: 140080 - DNA, 22 bp, Artificial Sequence
  chemically synthesized
aatgatgagaacacatggactc

SEQ ID NO: 140081 - DNA, 22 bp, Artificial Sequence
  chemically synthesized
atagagggaaacaacgcatact

SEQ ID NO: 140082 - DNA, 22 bp, Artificial Sequence
  chemically synthesized
gggcctatcagagggtggaggg

SEQ ID NO: 140083 - DNA, 22 bp, Artificial Sequence
  chemically synthesized
tcagagggtggagggtgagaga

SEQ ID NO: 140084 - DNA, 22 bp, Artificial Sequence
  chemically synthesized
atggatgctaagcgtaatacct

SEQ ID NO: 140085 - DNA, 22 bp, Artificial Sequence
  chemically synthesized
agcgtaatacctgagtgatgag

SEQ ID NO: 140086 - DNA, 22 bp, Artificial Sequence
  chemically synthesized
agtgatgagatcatctatacaa

SEQ ID NO: 140087 - DNA, 22 bp, Artificial Sequence
  chemically synthesized
tacaacaaacccccttgacatt

SEQ ID NO: 140088 - DNA, 22 bp, Artificial Sequence
  chemically synthesized
gacattcatttatctatgtaac

SEQ ID NO: 140089 - DNA, 22 bp, Artificial Sequence
  chemically synthesized
acattcatttatctatgtaaca

SEQ ID NO: 140090 - DNA, 22 bp, Artificial Sequence
  chemically synthesized
atttatctatgtaacaaacctg

SEQ ID NO: 140091 - DNA, 22 bp, Artificial Sequence
  chemically synthesized
atctatgtaacaaacctgcaca

SEQ ID NO: 140092 - DNA, 22 bp, Artificial Sequence
  chemically synthesized
tctatgtaacaaacctgcacat

SEQ ID NO: 140093 - DNA, 22 bp, Artificial Sequence
  chemically synthesized
tgtaacaaacctgcacatcctg

SEQ ID NO: 140094 - DNA, 22 bp, Artificial Sequence
  chemically synthesized
cacatcctgtacatgtacccct

SEQ ID NO: 140095 - DNA, 22 bp, Artificial Sequence
  chemically synthesized
tacatgtacccctgaacttaaa

SEQ ID NO: 140096 - DNA, 22 bp, Artificial Sequence
  chemically synthesized
aacttaaaataaaagttgaaaa

SEQ ID NO: 140097 - DNA, 22 bp, Artificial Sequence
  chemically synthesized
aaaataaaagttgaaaacaaga

SEQ ID NO: 140098 - DNA, 22 bp, Artificial Sequence
  chemically synthesized
aaataaaagttgaaaacaagaa

SEQ ID NO: 140099 - DNA, 22 bp, Artificial Sequence
  chemically synthesized
aaaacaagaaagcaacagtttg

SEQ ID NO: 140100 - DNA, 22 bp, Artificial Sequence
  chemically synthesized
gaacacttgttatggtctattc

SEQ ID NO: 140101 - DNA, 22 bp, Artificial Sequence
  chemically synthesized
aacacttgttatggtctattct

SEQ ID NO: 140102 - DNA, 22 bp, Artificial Sequence
  chemically synthesized
gttatggtctattctctcattc

SEQ ID NO: 140103 - DNA, 22 bp, Artificial Sequence
  chemically synthesized
ttatggtctattctctcattct

SEQ ID NO: 140104 - DNA, 22 bp, Artificial Sequence
  chemically synthesized
tggtctattctctcattcttta

SEQ ID NO: 140105 - DNA, 22 bp, Artificial Sequence
  chemically synthesized
ttctctcattctttacaattac

SEQ ID NO: 140106 - DNA, 22 bp, Artificial Sequence
  chemically synthesized
tctcattctttacaattacact

SEQ ID NO: 140107 - DNA, 22 bp, Artificial Sequence
  chemically synthesized
tcattctttacaattacactag

SEQ ID NO: 140108 - DNA, 22 bp, Artificial Sequence
  chemically synthesized
attctttacaattacactagaa

SEQ ID NO: 140109 - DNA, 22 bp, Artificial Sequence
  chemically synthesized
tttacaattacactagaaaata

SEQ ID NO: 140110 - DNA, 22 bp, Artificial Sequence
  chemically synthesized
tacaattacactagaaaatagc

SEQ ID NO: 140111 - DNA, 22 bp, Artificial Sequence
  chemically synthesized
acaattacactagaaaatagcc

SEQ ID NO: 140112 - DNA, 22 bp, Artificial Sequence
  chemically synthesized
caattacactagaaaatagcca

SEQ ID NO: 140113 - DNA, 22 bp, Artificial Sequence
  chemically synthesized
cactagaaaatagccacaggct

SEQ ID NO: 140114 - DNA, 22 bp, Artificial Sequence
  chemically synthesized
gaaaatagccacaggcttcctg

SEQ ID NO: 140115 - DNA, 22 bp, Artificial Sequence
  chemically synthesized
cctgcaaggcagccacagaatt

SEQ ID NO: 140116 - DNA, 22 bp, Artificial Sequence
  chemically synthesized
ctgcaaggcagccacagaattt

SEQ ID NO: 140117 - DNA, 22 bp, Artificial Sequence
  chemically synthesized
caaggcagccacagaatttatg

SEQ ID NO: 140118 - DNA, 22 bp, Artificial Sequence
  chemically synthesized
atgacttgtgatatccaagtca

SEQ ID NO: 140119 - DNA, 22 bp, Artificial Sequence
  chemically synthesized
tgacttgtgatatccaagtcat

SEQ ID NO: 140120 - DNA, 22 bp, Artificial Sequence
  chemically synthesized
gtgatatccaagtcattcctgg

SEQ ID NO: 140121 - DNA, 22 bp, Artificial Sequence
  chemically synthesized
tgatatccaagtcattcctgga

SEQ ID NO: 140122 - DNA, 22 bp, Artificial Sequence
  chemically synthesized
ctggataatgcaaaatctaaca

SEQ ID NO: 140123 - DNA, 22 bp, Artificial Sequence
  chemically synthesized
gataatgcaaaatctaacacaa

SEQ ID NO: 140124 - DNA, 22 bp, Artificial Sequence
  chemically synthesized
acacaaaatctagtagaatcat

SEQ ID NO: 140125 - DNA, 22 bp, Artificial Sequence
  chemically synthesized
gtagaatcatttgcttacatct

SEQ ID NO: 140126 - DNA, 22 bp, Artificial Sequence
  chemically synthesized
gcttacatctatttttgttctg

SEQ ID NO: 140127 - DNA, 22 bp, Artificial Sequence
  chemically synthesized
cttacatctatttttgttctga

SEQ ID NO: 140128 - DNA, 22 bp, Artificial Sequence
  chemically synthesized
acatctatttttgttctgagaa

SEQ ID NO: 140129 - DNA, 22 bp, Artificial Sequence
  chemically synthesized
catctatttttgttctgagaat

SEQ ID NO: 140130 - DNA, 22 bp, Artificial Sequence
  chemically synthesized
tttttgttctgagaatatagat

SEQ ID NO: 140131 - DNA, 22 bp, Artificial Sequence
  chemically synthesized
ttgttctgagaatatagattta

SEQ ID NO: 140132 - DNA, 22 bp, Artificial Sequence
  chemically synthesized
tgttctgagaatatagatttag

SEQ ID NO: 140133 - DNA, 22 bp, Artificial Sequence
  chemically synthesized
gttctgagaatatagatttaga

SEQ ID NO: 140134 - DNA, 22 bp, Artificial Sequence
  chemically synthesized
ttctgagaatatagatttagat

SEQ ID NO: 140135 - DNA, 22 bp, Artificial Sequence
  chemically synthesized
tgagaatatagatttagataca

SEQ ID NO: 140136 - DNA, 22 bp, Artificial Sequence
  chemically synthesized
agaatatagatttagatacata

SEQ ID NO: 140137 - DNA, 22 bp, Artificial Sequence
  chemically synthesized
agatacataatggaagcagaat

SEQ ID NO: 140138 - DNA, 22 bp, Artificial Sequence
  chemically synthesized
gatacataatggaagcagaata

SEQ ID NO: 140139 - DNA, 22 bp, Artificial Sequence
  chemically synthesized
aaaatctggctaatttagaatc

SEQ ID NO: 140140 - DNA, 22 bp, Artificial Sequence
  chemically synthesized
aaatctggctaatttagaatcc

SEQ ID NO: 140141 - DNA, 22 bp, Artificial Sequence
  chemically synthesized
gctaatttagaatcctaagcag

SEQ ID NO: 140142 - DNA, 22 bp, Artificial Sequence
  chemically synthesized
atttagaatcctaagcagctct

SEQ ID NO: 140143 - DNA, 22 bp, Artificial Sequence
  chemically synthesized
agaatcctaagcagctcttttc

SEQ ID NO: 140144 - DNA, 22 bp, Artificial Sequence
  chemically synthesized
gaatcctaagcagctcttttcc

SEQ ID NO: 140145 - DNA, 22 bp, Artificial Sequence
  chemically synthesized
agcagctcttttcctatcagtg

SEQ ID NO: 140146 - DNA, 22 bp, Artificial Sequence
  chemically synthesized
ttttcctatcagtggtttacaa

SEQ ID NO: 140147 - DNA, 22 bp, Artificial Sequence
  chemically synthesized
ttcctatcagtggtttacaagc

SEQ ID NO: 140148 - DNA, 22 bp, Artificial Sequence
  chemically synthesized
tcctatcagtggtttacaagcc

SEQ ID NO: 140149 - DNA, 22 bp, Artificial Sequence
  chemically synthesized
cctatcagtggtttacaagcct

SEQ ID NO: 140150 - DNA, 22 bp, Artificial Sequence
  chemically synthesized
ctatcagtggtttacaagcctt

SEQ ID NO: 140151 - DNA, 22 bp, Artificial Sequence
  chemically synthesized
tcagtggtttacaagccttgtt

SEQ ID NO: 140152 - DNA, 22 bp, Artificial Sequence
  chemically synthesized
acaagccttgtttatatttttc

SEQ ID NO: 140153 - DNA, 22 bp, Artificial Sequence
  chemically synthesized
caagccttgtttatatttttcc

SEQ ID NO: 140154 - DNA, 22 bp, Artificial Sequence
  chemically synthesized
gtttatatttttcctattttaa

SEQ ID NO: 140155 - DNA, 22 bp, Artificial Sequence
  chemically synthesized
tttatatttttcctattttaaa

SEQ ID NO: 140156 - DNA, 22 bp, Artificial Sequence
  chemically synthesized
atatttttcctattttaaaaat

SEQ ID NO: 140157 - DNA, 22 bp, Artificial Sequence
  chemically synthesized
tatttttcctattttaaaaata

SEQ ID NO: 140158 - DNA, 22 bp, Artificial Sequence
  chemically synthesized
ttcctattttaaaaataaaaat

SEQ ID NO: 140159 - DNA, 22 bp, Artificial Sequence
  chemically synthesized
tcctattttaaaaataaaaata

SEQ ID NO: 140160 - DNA, 22 bp, Artificial Sequence
  chemically synthesized
cctattttaaaaataaaaataa

SEQ ID NO: 140161 - DNA, 22 bp, Artificial Sequence
  chemically synthesized
ctattttaaaaataaaaataaa

SEQ ID NO: 140162 - DNA, 22 bp, Artificial Sequence
  chemically synthesized
ttttaaaaataaaaataaagta

SEQ ID NO: 140163 - DNA, 22 bp, Artificial Sequence
  chemically synthesized
taaaaataaaaataaagtaagt

SEQ ID NO: 140164 - DNA, 22 bp, Artificial Sequence
  chemically synthesized
aaaaataaaaataaagtaagtt

SEQ ID NO: 140165 - DNA, 22 bp, Artificial Sequence
  chemically synthesized
aaaataaaaataaagtaagtta

SEQ ID NO: 140166 - DNA, 22 bp, Artificial Sequence
  chemically synthesized
tttgtggtaaagaatattcatt

SEQ ID NO: 140167 - DNA, 22 bp, Artificial Sequence
  chemically synthesized
gtggtaaagaatattcattaaa

SEQ ID NO: 140168 - DNA, 22 bp, Artificial Sequence
  chemically synthesized
tggtaaagaatattcattaaag

SEQ ID NO: 140169 - DNA, 22 bp, Artificial Sequence
  chemically synthesized
attaaagtatttatttcttaga

SEQ ID NO: 140170 - DNA, 22 bp, Artificial Sequence
  chemically synthesized
aagtatttatttcttagataat

SEQ ID NO: 140171 - DNA, 22 bp, Artificial Sequence
  chemically synthesized
atttcttagataataccatgaa

SEQ ID NO: 140172 - DNA, 22 bp, Artificial Sequence
  chemically synthesized
tttcttagataataccatgaaa

SEQ ID NO: 140173 - DNA, 22 bp, Artificial Sequence
  chemically synthesized
cttagataataccatgaaaaac

SEQ ID NO: 140174 - DNA, 22 bp, Artificial Sequence
  chemically synthesized
ttagataataccatgaaaaaca

SEQ ID NO: 140175 - DNA, 22 bp, Artificial Sequence
  chemically synthesized
agataataccatgaaaaacatt

SEQ ID NO: 140176 - DNA, 22 bp, Artificial Sequence
  chemically synthesized
gataataccatgaaaaacattc

SEQ ID NO: 140177 - DNA, 22 bp, Artificial Sequence
  chemically synthesized
agtgaagtgaagggcctacttt

SEQ ID NO: 140178 - DNA, 22 bp, Artificial Sequence
  chemically synthesized
ctttacttaacaagaatctaat

SEQ ID NO: 140179 - DNA, 22 bp, Artificial Sequence
  chemically synthesized
tacttaacaagaatctaattta

SEQ ID NO: 140180 - DNA, 22 bp, Artificial Sequence
  chemically synthesized
acttaacaagaatctaatttat

SEQ ID NO: 140181 - DNA, 22 bp, Artificial Sequence
  chemically synthesized
cttaacaagaatctaatttata

SEQ ID NO: 140182 - DNA, 22 bp, Artificial Sequence
  chemically synthesized
aacaagaatctaatttatataa

SEQ ID NO: 140183 - DNA, 22 bp, Artificial Sequence
  chemically synthesized
acaagaatctaatttatataat

SEQ ID NO: 140184 - DNA, 22 bp, Artificial Sequence
  chemically synthesized
atttatataatttttcatacta

SEQ ID NO: 140185 - DNA, 22 bp, Artificial Sequence
  chemically synthesized
atataatttttcatactaatag

SEQ ID NO: 140186 - DNA, 22 bp, Artificial Sequence
  chemically synthesized
tataatttttcatactaatagc

SEQ ID NO: 140187 - DNA, 22 bp, Artificial Sequence
  chemically synthesized
ttcatactaatagcatctaaga

SEQ ID NO: 140188 - DNA, 22 bp, Artificial Sequence
  chemically synthesized
tcatactaatagcatctaagaa

SEQ ID NO: 140189 - DNA, 22 bp, Artificial Sequence
  chemically synthesized
catactaatagcatctaagaac

SEQ ID NO: 140190 - DNA, 22 bp, Artificial Sequence
  chemically synthesized
atactaatagcatctaagaaca

SEQ ID NO: 140191 - DNA, 22 bp, Artificial Sequence
  chemically synthesized
atagcatctaagaacagtacaa

SEQ ID NO: 140192 - DNA, 22 bp, Artificial Sequence
  chemically synthesized
agaacagtacaatatttgactc

SEQ ID NO: 140193 - DNA, 22 bp, Artificial Sequence
  chemically synthesized
gactcttcaggttaaacatatg

SEQ ID NO: 140194 - DNA, 22 bp, Artificial Sequence
  chemically synthesized
actcttcaggttaaacatatgt

SEQ ID NO: 140195 - DNA, 22 bp, Artificial Sequence
  chemically synthesized
ttcaggttaaacatatgtcata

SEQ ID NO: 140196 - DNA, 22 bp, Artificial Sequence
  chemically synthesized
caggttaaacatatgtcataaa

SEQ ID NO: 140197 - DNA, 22 bp, Artificial Sequence
  chemically synthesized
aggttaaacatatgtcataaat

SEQ ID NO: 140198 - DNA, 22 bp, Artificial Sequence
  chemically synthesized
aacatatgtcataaattagcca

SEQ ID NO: 140199 - DNA, 22 bp, Artificial Sequence
  chemically synthesized
gccagaaagatttaagaaaata

SEQ ID NO: 140200 - DNA, 22 bp, Artificial Sequence
  chemically synthesized
aagaaaatattggatgtttcct

SEQ ID NO: 140201 - DNA, 22 bp, Artificial Sequence
  chemically synthesized
agaaaatattggatgtttcctt

SEQ ID NO: 140202 - DNA, 22 bp, Artificial Sequence
  chemically synthesized
gatgtttccttgtttaaattag

SEQ ID NO: 140203 - DNA, 22 bp, Artificial Sequence
  chemically synthesized
ccttgtttaaattaggcatctt

SEQ ID NO: 140204 - DNA, 22 bp, Artificial Sequence
  chemically synthesized
cttgtttaaattaggcatctta

SEQ ID NO: 140205 - DNA, 22 bp, Artificial Sequence
  chemically synthesized
gtttaaattaggcatcttacag

SEQ ID NO: 140206 - DNA, 22 bp, Artificial Sequence
  chemically synthesized
tttaaattaggcatcttacagt

SEQ ID NO: 140207 - DNA, 22 bp, Artificial Sequence
  chemically synthesized
aaattaggcatcttacagtttt

SEQ ID NO: 140208 - DNA, 22 bp, Artificial Sequence
  chemically synthesized
aattaggcatcttacagttttt

SEQ ID NO: 140209 - DNA, 22 bp, Artificial Sequence
  chemically synthesized
ggcatcttacagtttttagaat

SEQ ID NO: 140210 - DNA, 22 bp, Artificial Sequence
  chemically synthesized
acagtttttagaatcctgcata

SEQ ID NO: 140211 - DNA, 22 bp, Artificial Sequence
  chemically synthesized
cagtttttagaatcctgcatag

SEQ ID NO: 140212 - DNA, 22 bp, Artificial Sequence
  chemically synthesized
ttagaatcctgcatagaactta

SEQ ID NO: 140213 - DNA, 22 bp, Artificial Sequence
  chemically synthesized
tagaatcctgcatagaacttaa

SEQ ID NO: 140214 - DNA, 22 bp, Artificial Sequence
  chemically synthesized
agaatcctgcatagaacttaag

SEQ ID NO: 140215 - DNA, 22 bp, Artificial Sequence
  chemically synthesized
gaatcctgcatagaacttaaga

SEQ ID NO: 140216 - DNA, 22 bp, Artificial Sequence
  chemically synthesized
catagaacttaagaaattacaa

SEQ ID NO: 140217 - DNA, 22 bp, Artificial Sequence
  chemically synthesized
aagaaattacaaatgctaaagc

SEQ ID NO: 140218 - DNA, 22 bp, Artificial Sequence
  chemically synthesized
agaaattacaaatgctaaagca

SEQ ID NO: 140219 - DNA, 22 bp, Artificial Sequence
  chemically synthesized
caaatgctaaagcaaacccaaa

SEQ ID NO: 140220 - DNA, 22 bp, Artificial Sequence
  chemically synthesized
aagcaaacccaaacaggcagga

SEQ ID NO: 140221 - DNA, 22 bp, Artificial Sequence
  chemically synthesized
atcttcatcgaatttgggtgtt

SEQ ID NO: 140222 - DNA, 22 bp, Artificial Sequence
  chemically synthesized
catcgaatttgggtgtttcttt

SEQ ID NO: 140223 - DNA, 22 bp, Artificial Sequence
  chemically synthesized
atcgaatttgggtgtttctttc

SEQ ID NO: 140224 - DNA, 22 bp, Artificial Sequence
  chemically synthesized
gggtgtttctttctaaaagtcc

SEQ ID NO: 140225 - DNA, 22 bp, Artificial Sequence
  chemically synthesized
ggtgtttctttctaaaagtcct

SEQ ID NO: 140226 - DNA, 22 bp, Artificial Sequence
  chemically synthesized
ctttctaaaagtcctttatact

SEQ ID NO: 140227 - DNA, 22 bp, Artificial Sequence
  chemically synthesized
tttctaaaagtcctttatactt

SEQ ID NO: 140228 - DNA, 22 bp, Artificial Sequence
  chemically synthesized
tctaaaagtcctttatacttaa

SEQ ID NO: 140229 - DNA, 22 bp, Artificial Sequence
  chemically synthesized
ctaaaagtcctttatacttaaa

SEQ ID NO: 140230 - DNA, 22 bp, Artificial Sequence
  chemically synthesized
taaaagtcctttatacttaaat

SEQ ID NO: 140231 - DNA, 22 bp, Artificial Sequence
  chemically synthesized
aaagtcctttatacttaaatgt

SEQ ID NO: 140232 - DNA, 22 bp, Artificial Sequence
  chemically synthesized
tatacttaaatgtcttaagaca

SEQ ID NO: 140233 - DNA, 22 bp, Artificial Sequence
  chemically synthesized
atacttaaatgtcttaagacat

SEQ ID NO: 140234 - DNA, 22 bp, Artificial Sequence
  chemically synthesized
tacttaaatgtcttaagacata

SEQ ID NO: 140235 - DNA, 22 bp, Artificial Sequence
  chemically synthesized
aaatgtcttaagacatacatag

SEQ ID NO: 140236 - DNA, 22 bp, Artificial Sequence
  chemically synthesized
aatgtcttaagacatacataga

SEQ ID NO: 140237 - DNA, 22 bp, Artificial Sequence
  chemically synthesized
aagacatacatagattttattt

SEQ ID NO: 140238 - DNA, 22 bp, Artificial Sequence
  chemically synthesized
agacatacatagattttatttt

SEQ ID NO: 140239 - DNA, 22 bp, Artificial Sequence
  chemically synthesized
tattttactaattttaattata

SEQ ID NO: 140240 - DNA, 22 bp, Artificial Sequence
  chemically synthesized
attttactaattttaattatat

SEQ ID NO: 140241 - DNA, 22 bp, Artificial Sequence
  chemically synthesized
ttttactaattttaattatata

SEQ ID NO: 140242 - DNA, 22 bp, Artificial Sequence
  chemically synthesized
tactaattttaattatatagac

SEQ ID NO: 140243 - DNA, 22 bp, Artificial Sequence
  chemically synthesized
actaattttaattatatagaca

SEQ ID NO: 140244 - DNA, 22 bp, Artificial Sequence
  chemically synthesized
ctaattttaattatatagacaa

SEQ ID NO: 140245 - DNA, 22 bp, Artificial Sequence
  chemically synthesized
attttaattatatagacaataa

SEQ ID NO: 140246 - DNA, 22 bp, Artificial Sequence
  chemically synthesized
taattatatagacaataaatga

SEQ ID NO: 140247 - DNA, 22 bp, Artificial Sequence
  chemically synthesized
aattatatagacaataaatgaa

SEQ ID NO: 140248 - DNA, 22 bp, Artificial Sequence
  chemically synthesized
attatatagacaataaatgaat

SEQ ID NO: 140249 - DNA, 22 bp, Artificial Sequence
  chemically synthesized
tatagacaataaatgaatattc

SEQ ID NO: 140250 - DNA, 22 bp, Artificial Sequence
  chemically synthesized
ttactgattactttttctgact

SEQ ID NO: 140251 - DNA, 22 bp, Artificial Sequence
  chemically synthesized
actgattactttttctgactgt

SEQ ID NO: 140252 - DNA, 22 bp, Artificial Sequence
  chemically synthesized
ctgattactttttctgactgtc

SEQ ID NO: 140253 - DNA, 22 bp, Artificial Sequence
  chemically synthesized
attactttttctgactgtctaa

SEQ ID NO: 140254 - DNA, 22 bp, Artificial Sequence
  chemically synthesized
ctttttctgactgtctaatctt

SEQ ID NO: 140255 - DNA, 22 bp, Artificial Sequence
  chemically synthesized
tttctgactgtctaatctttct

SEQ ID NO: 140256 - DNA, 22 bp, Artificial Sequence
  chemically synthesized
ttctgactgtctaatctttctg

SEQ ID NO: 140257 - DNA, 22 bp, Artificial Sequence
  chemically synthesized
tctgactgtctaatctttctga

SEQ ID NO: 140258 - DNA, 22 bp, Artificial Sequence
  chemically synthesized
ctgactgtctaatctttctgat

SEQ ID NO: 140259 - DNA, 22 bp, Artificial Sequence
  chemically synthesized
tgactgtctaatctttctgatc

SEQ ID NO: 140260 - DNA, 22 bp, Artificial Sequence
  chemically synthesized
actgtctaatctttctgatcta

SEQ ID NO: 140261 - DNA, 22 bp, Artificial Sequence
  chemically synthesized
tctaatctttctgatctatcct

SEQ ID NO: 140262 - DNA, 22 bp, Artificial Sequence
  chemically synthesized
atctttctgatctatcctggat

SEQ ID NO: 140263 - DNA, 22 bp, Artificial Sequence
  chemically synthesized
tctgatctatcctggatggcca

SEQ ID NO: 140264 - DNA, 22 bp, Artificial Sequence
  chemically synthesized
ctgatctatcctggatggccat

SEQ ID NO: 140265 - DNA, 22 bp, Artificial Sequence
  chemically synthesized
tgatctatcctggatggccata

SEQ ID NO: 140266 - DNA, 22 bp, Artificial Sequence
  chemically synthesized
atctatcctggatggccataac

SEQ ID NO: 140267 - DNA, 22 bp, Artificial Sequence
  chemically synthesized
tcctggatggccataacactta

SEQ ID NO: 140268 - DNA, 22 bp, Artificial Sequence
  chemically synthesized
gatggccataacacttatctct

SEQ ID NO: 140269 - DNA, 22 bp, Artificial Sequence
  chemically synthesized
atctctctgaactttgggcttt

SEQ ID NO: 140270 - DNA, 22 bp, Artificial Sequence
  chemically synthesized
tctctctgaactttgggctttt

SEQ ID NO: 140271 - DNA, 22 bp, Artificial Sequence
  chemically synthesized
tctgaactttgggcttttaata

SEQ ID NO: 140272 - DNA, 22 bp, Artificial Sequence
  chemically synthesized
tgaactttgggcttttaatata

SEQ ID NO: 140273 - DNA, 22 bp, Artificial Sequence
  chemically synthesized
aactttgggcttttaatatagg

SEQ ID NO: 140274 - DNA, 22 bp, Artificial Sequence
  chemically synthesized
tgggcttttaatataggaaaga

SEQ ID NO: 140275 - DNA, 22 bp, Artificial Sequence
  chemically synthesized
gggcttttaatataggaaagaa

SEQ ID NO: 140276 - DNA, 22 bp, Artificial Sequence
  chemically synthesized
ggcttttaatataggaaagaaa

SEQ ID NO: 140277 - DNA, 22 bp, Artificial Sequence
  chemically synthesized
ttaatataggaaagaaaagcaa

SEQ ID NO: 140278 - DNA, 22 bp, Artificial Sequence
  chemically synthesized
taatataggaaagaaaagcaat

SEQ ID NO: 140279 - DNA, 22 bp, Artificial Sequence
  chemically synthesized
aatataggaaagaaaagcaata

SEQ ID NO: 140280 - DNA, 22 bp, Artificial Sequence
  chemically synthesized
atataggaaagaaaagcaataa

SEQ ID NO: 140281 - DNA, 22 bp, Artificial Sequence
  chemically synthesized
ttcatggtatctcatatgataa

SEQ ID NO: 140282 - DNA, 22 bp, Artificial Sequence
  chemically synthesized
tcatggtatctcatatgataaa

SEQ ID NO: 140283 - DNA, 22 bp, Artificial Sequence
  chemically synthesized
catggtatctcatatgataaac

SEQ ID NO: 140284 - DNA, 22 bp, Artificial Sequence
  chemically synthesized
atggtatctcatatgataaaca

SEQ ID NO: 140285 - DNA, 22 bp, Artificial Sequence
  chemically synthesized
atatgataaacaaataaaatgc

SEQ ID NO: 140286 - DNA, 22 bp, Artificial Sequence
  chemically synthesized
aaaaatgagcaggtgaagcaat

SEQ ID NO: 140287 - DNA, 22 bp, Artificial Sequence
  chemically synthesized
aaaatgagcaggtgaagcaatt

SEQ ID NO: 140288 - DNA, 22 bp, Artificial Sequence
  chemically synthesized
atcttgaaccaacaagcatcga

SEQ ID NO: 140289 - DNA, 22 bp, Artificial Sequence
  chemically synthesized
tcttgaaccaacaagcatcgaa

SEQ ID NO: 140290 - DNA, 22 bp, Artificial Sequence
  chemically synthesized
gaaccaacaagcatcgaagcaa

SEQ ID NO: 140291 - DNA, 22 bp, Artificial Sequence
  chemically synthesized
aaccaacaagcatcgaagcaat

SEQ ID NO: 140292 - DNA, 22 bp, Artificial Sequence
  chemically synthesized
cccgcagcctacctgacttctg

SEQ ID NO: 140293 - DNA, 22 bp, Artificial Sequence
  chemically synthesized
cctgacttctgagtcaggattt

SEQ ID NO: 140294 - DNA, 22 bp, Artificial Sequence
  chemically synthesized
acttctgagtcaggatttataa

SEQ ID NO: 140295 - DNA, 22 bp, Artificial Sequence
  chemically synthesized
ctgagtcaggatttataagcct

SEQ ID NO: 140296 - DNA, 22 bp, Artificial Sequence
  chemically synthesized
tgagtcaggatttataagcctt

SEQ ID NO: 140297 - DNA, 22 bp, Artificial Sequence
  chemically synthesized
agtcaggatttataagccttgt

SEQ ID NO: 140298 - DNA, 22 bp, Artificial Sequence
  chemically synthesized
ataagccttgttactgagacac

SEQ ID NO: 140299 - DNA, 22 bp, Artificial Sequence
  chemically synthesized
taagccttgttactgagacaca

SEQ ID NO: 140300 - DNA, 22 bp, Artificial Sequence
  chemically synthesized
gttactgagacacaaacctggg

SEQ ID NO: 140301 - DNA, 22 bp, Artificial Sequence
  chemically synthesized
ttactgagacacaaacctgggc

SEQ ID NO: 140302 - DNA, 22 bp, Artificial Sequence
  chemically synthesized
ctgagacacaaacctgggcctt

SEQ ID NO: 140303 - DNA, 22 bp, Artificial Sequence
  chemically synthesized
agacacaaacctgggcctttca

SEQ ID NO: 140304 - DNA, 22 bp, Artificial Sequence
  chemically synthesized
ggcctttcaatgctataacctt

SEQ ID NO: 140305 - DNA, 22 bp, Artificial Sequence
  chemically synthesized
tcaatgctataacctttcttga

SEQ ID NO: 140306 - DNA, 22 bp, Artificial Sequence
  chemically synthesized
caatgctataacctttcttgaa

SEQ ID NO: 140307 - DNA, 22 bp, Artificial Sequence
  chemically synthesized
aatgctataacctttcttgaag

SEQ ID NO: 140308 - DNA, 22 bp, Artificial Sequence
  chemically synthesized
taacctttcttgaagctcctcc

SEQ ID NO: 140309 - DNA, 22 bp, Artificial Sequence
  chemically synthesized
tcttgaagctcctccctaccac

SEQ ID NO: 140310 - DNA, 22 bp, Artificial Sequence
  chemically synthesized
cttgaagctcctccctaccacc

SEQ ID NO: 140311 - DNA, 22 bp, Artificial Sequence
  chemically synthesized
ttgaagctcctccctaccacct

SEQ ID NO: 140312 - DNA, 22 bp, Artificial Sequence
  chemically synthesized
gaagctcctccctaccaccttt

SEQ ID NO: 140313 - DNA, 22 bp, Artificial Sequence
  chemically synthesized
aagctcctccctaccaccttta

SEQ ID NO: 140314 - DNA, 22 bp, Artificial Sequence
  chemically synthesized
ctccctaccacctttagccata

SEQ ID NO: 140315 - DNA, 22 bp, Artificial Sequence
  chemically synthesized
cctaccacctttagccataagg

SEQ ID NO: 140316 - DNA, 22 bp, Artificial Sequence
  chemically synthesized
ccacctttagccataaggaaac

SEQ ID NO: 140317 - DNA, 22 bp, Artificial Sequence
  chemically synthesized
tagccataaggaaacatggaat

SEQ ID NO: 140318 - DNA, 22 bp, Artificial Sequence
  chemically synthesized
agccataaggaaacatggaatg

SEQ ID NO: 140319 - DNA, 22 bp, Artificial Sequence
  chemically synthesized
gccataaggaaacatggaatgg

SEQ ID NO: 140320 - DNA, 22 bp, Artificial Sequence
  chemically synthesized
gatgcaagccaggtctggaacc

SEQ ID NO: 140321 - DNA, 22 bp, Artificial Sequence
  chemically synthesized
gaaccataggcagtaaggagag

SEQ ID NO: 140322 - DNA, 22 bp, Artificial Sequence
  chemically synthesized
tgcaactggctccgagggagca

SEQ ID NO: 140323 - DNA, 22 bp, Artificial Sequence
  chemically synthesized
caactggctccgagggagcagg

SEQ ID NO: 140324 - DNA, 22 bp, Artificial Sequence
  chemically synthesized
gctccgagggagcaggagagga

SEQ ID NO: 140325 - DNA, 22 bp, Artificial Sequence
  chemically synthesized
cgagggagcaggagaggatcaa

SEQ ID NO: 140326 - DNA, 22 bp, Artificial Sequence
  chemically synthesized
tgaatctaagagaagactggtg

SEQ ID NO: 140327 - DNA, 22 bp, Artificial Sequence
  chemically synthesized
aatctaagagaagactggtgtc

SEQ ID NO: 140328 - DNA, 22 bp, Artificial Sequence
  chemically synthesized
agagaagactggtgtccatact

SEQ ID NO: 140329 - DNA, 22 bp, Artificial Sequence
  chemically synthesized
gtgtccatactctgaatgggaa

SEQ ID NO: 140330 - DNA, 22 bp, Artificial Sequence
  chemically synthesized
tgaatgggaagaatgatgggat

SEQ ID NO: 140331 - DNA, 22 bp, Artificial Sequence
  chemically synthesized
aatgggaagaatgatgggatta

SEQ ID NO: 140332 - DNA, 22 bp, Artificial Sequence
  chemically synthesized
cccatagggcttgttttaggga

SEQ ID NO: 140333 - DNA, 22 bp, Artificial Sequence
  chemically synthesized
gttttagggagaaacctgttct

SEQ ID NO: 140334 - DNA, 22 bp, Artificial Sequence
  chemically synthesized
ttttagggagaaacctgttctc

SEQ ID NO: 140335 - DNA, 22 bp, Artificial Sequence
  chemically synthesized
tagggagaaacctgttctccaa

SEQ ID NO: 140336 - DNA, 22 bp, Artificial Sequence
  chemically synthesized
agggagaaacctgttctccaaa

SEQ ID NO: 140337 - DNA, 22 bp, Artificial Sequence
  chemically synthesized
gggagaaacctgttctccaaac

SEQ ID NO: 140338 - DNA, 22 bp, Artificial Sequence
  chemically synthesized
ttctccaaactcttggccttga

SEQ ID NO: 140339 - DNA, 22 bp, Artificial Sequence
  chemically synthesized
tccaaactcttggccttgagat

SEQ ID NO: 140340 - DNA, 22 bp, Artificial Sequence
  chemically synthesized
caaactcttggccttgagatac

SEQ ID NO: 140341 - DNA, 22 bp, Artificial Sequence
  chemically synthesized
ttggccttgagatacctggtcc

SEQ ID NO: 140342 - DNA, 22 bp, Artificial Sequence
  chemically synthesized
ggccttgagatacctggtcctt

SEQ ID NO: 140343 - DNA, 22 bp, Artificial Sequence
  chemically synthesized
gccttgagatacctggtcctta

SEQ ID NO: 140344 - DNA, 22 bp, Artificial Sequence
  chemically synthesized
gagatacctggtccttattcct

SEQ ID NO: 140345 - DNA, 22 bp, Artificial Sequence
  chemically synthesized
agatacctggtccttattcctt

SEQ ID NO: 140346 - DNA, 22 bp, Artificial Sequence
  chemically synthesized
gtccttattccttggactttgg

SEQ ID NO: 140347 - DNA, 22 bp, Artificial Sequence
  chemically synthesized
attccttggactttggcaatgt

SEQ ID NO: 140348 - DNA, 22 bp, Artificial Sequence
  chemically synthesized
ttccttggactttggcaatgtc

SEQ ID NO: 140349 - DNA, 22 bp, Artificial Sequence
  chemically synthesized
cttggactttggcaatgtctga

SEQ ID NO: 140350 - DNA, 22 bp, Artificial Sequence
  chemically synthesized
ggactttggcaatgtctgaccc

SEQ ID NO: 140351 - DNA, 22 bp, Artificial Sequence
  chemically synthesized
gactttggcaatgtctgaccct

SEQ ID NO: 140352 - DNA, 22 bp, Artificial Sequence
  chemically synthesized
tggcaatgtctgaccctcacat

SEQ ID NO: 140353 - DNA, 22 bp, Artificial Sequence
  chemically synthesized
ggcaatgtctgaccctcacatt

SEQ ID NO: 140354 - DNA, 22 bp, Artificial Sequence
  chemically synthesized
gcaatgtctgaccctcacattc

SEQ ID NO: 140355 - DNA, 22 bp, Artificial Sequence
  chemically synthesized
accctcacattcaagttctgag

SEQ ID NO: 140356 - DNA, 22 bp, Artificial Sequence
  chemically synthesized
acattcaagttctgaggaaggg

SEQ ID NO: 140357 - DNA, 22 bp, Artificial Sequence
  chemically synthesized
aagttctgaggaagggccactg

SEQ ID NO: 140358 - DNA, 22 bp, Artificial Sequence
  chemically synthesized
tgaggaagggccactgccttca

SEQ ID NO: 140359 - DNA, 22 bp, Artificial Sequence
  chemically synthesized
aggaagggccactgccttcata

SEQ ID NO: 140360 - DNA, 22 bp, Artificial Sequence
  chemically synthesized
ccttcatactgtggatctgtag

SEQ ID NO: 140361 - DNA, 22 bp, Artificial Sequence
  chemically synthesized
catactgtggatctgtagcaaa

SEQ ID NO: 140362 - DNA, 22 bp, Artificial Sequence
  chemically synthesized
atactgtggatctgtagcaaat

SEQ ID NO: 140363 - DNA, 22 bp, Artificial Sequence
  chemically synthesized
tggatctgtagcaaattccccc

SEQ ID NO: 140364 - DNA, 22 bp, Artificial Sequence
  chemically synthesized
tagcaaattccccctgaaaacc

SEQ ID NO: 140365 - DNA, 22 bp, Artificial Sequence
  chemically synthesized
cccctgaaaacccagagctgta

SEQ ID NO: 140366 - DNA, 22 bp, Artificial Sequence
  chemically synthesized
aaaacccagagctgtatcttaa

SEQ ID NO: 140367 - DNA, 22 bp, Artificial Sequence
  chemically synthesized
tatcttaattggttaaaaaaaa

SEQ ID NO: 140368 - DNA, 22 bp, Artificial Sequence
  chemically synthesized
aattggttaaaaaaaattatat

SEQ ID NO: 140369 - DNA, 22 bp, Artificial Sequence
  chemically synthesized
attggttaaaaaaaattatatt

SEQ ID NO: 140370 - DNA, 22 bp, Artificial Sequence
  chemically synthesized
gttaaaaaaaattatattatct

SEQ ID NO: 140371 - DNA, 22 bp, Artificial Sequence
  chemically synthesized
aaaaaaattatattatctcaac

SEQ ID NO: 140372 - DNA, 22 bp, Artificial Sequence
  chemically synthesized
tattatctcaacgactgttctt

SEQ ID NO: 140373 - DNA, 22 bp, Artificial Sequence
  chemically synthesized
tctcaacgactgttcttctctg

SEQ ID NO: 140374 - DNA, 22 bp, Artificial Sequence
  chemically synthesized
aacgactgttcttctctgagta

SEQ ID NO: 140375 - DNA, 22 bp, Artificial Sequence
  chemically synthesized
ttcttctctgagtagccaagct

SEQ ID NO: 140376 - DNA, 22 bp, Artificial Sequence
  chemically synthesized
ttctctgagtagccaagctcag

SEQ ID NO: 140377 - DNA, 22 bp, Artificial Sequence
  chemically synthesized
ctctgagtagccaagctcagct

SEQ ID NO: 140378 - DNA, 22 bp, Artificial Sequence
  chemically synthesized
tctgagtagccaagctcagctt

SEQ ID NO: 140379 - DNA, 22 bp, Artificial Sequence
  chemically synthesized
tgagtagccaagctcagcttgg

SEQ ID NO: 140380 - DNA, 22 bp, Artificial Sequence
  chemically synthesized
agtagccaagctcagcttggtt

SEQ ID NO: 140381 - DNA, 22 bp, Artificial Sequence
  chemically synthesized
agcttggttcaagctacaagca

SEQ ID NO: 140382 - DNA, 22 bp, Artificial Sequence
  chemically synthesized
ggttcaagctacaagcagctga

SEQ ID NO: 140383 - DNA, 22 bp, Artificial Sequence
  chemically synthesized
gttcaagctacaagcagctgag

SEQ ID NO: 140384 - DNA, 22 bp, Artificial Sequence
  chemically synthesized
aagctacaagcagctgagctgc

SEQ ID NO: 140385 - DNA, 22 bp, Artificial Sequence
  chemically synthesized
caagcagctgagctgctttttg

SEQ ID NO: 140386 - DNA, 22 bp, Artificial Sequence
  chemically synthesized
agctgctttttgtctagtcatt

SEQ ID NO: 140387 - DNA, 22 bp, Artificial Sequence
  chemically synthesized
ctttttgtctagtcattgttct

SEQ ID NO: 140388 - DNA, 22 bp, Artificial Sequence
  chemically synthesized
tttgtctagtcattgttctttt

SEQ ID NO: 140389 - DNA, 22 bp, Artificial Sequence
  chemically synthesized
ttgtctagtcattgttctttta

SEQ ID NO: 140390 - DNA, 22 bp, Artificial Sequence
  chemically synthesized
tgtctagtcattgttcttttat

SEQ ID NO: 140391 - DNA, 22 bp, Artificial Sequence
  chemically synthesized
gtctagtcattgttcttttatt

SEQ ID NO: 140392 - DNA, 22 bp, Artificial Sequence
  chemically synthesized
tctagtcattgttcttttattt

SEQ ID NO: 140393 - DNA, 22 bp, Artificial Sequence
  chemically synthesized
gtcattgttcttttatttcagt

SEQ ID NO: 140394 - DNA, 22 bp, Artificial Sequence
  chemically synthesized
ttcttttatttcagtggatcaa

SEQ ID NO: 140395 - DNA, 22 bp, Artificial Sequence
  chemically synthesized
ttttatttcagtggatcaaata

SEQ ID NO: 140396 - DNA, 22 bp, Artificial Sequence
  chemically synthesized
ttatttcagtggatcaaatacg

SEQ ID NO: 140397 - DNA, 22 bp, Artificial Sequence
  chemically synthesized
tatttcagtggatcaaatacgt

SEQ ID NO: 140398 - DNA, 22 bp, Artificial Sequence
  chemically synthesized
atttcagtggatcaaatacgtt

SEQ ID NO: 140399 - DNA, 22 bp, Artificial Sequence
  chemically synthesized
tttcagtggatcaaatacgttc

SEQ ID NO: 140400 - DNA, 22 bp, Artificial Sequence
  chemically synthesized
cagtggatcaaatacgttcttt

SEQ ID NO: 140401 - DNA, 22 bp, Artificial Sequence
  chemically synthesized
agtggatcaaatacgttctttc

SEQ ID NO: 140402 - DNA, 22 bp, Artificial Sequence
  chemically synthesized
tttccaaacctaggatcttgtc

SEQ ID NO: 140403 - DNA, 22 bp, Artificial Sequence
  chemically synthesized
tccaaacctaggatcttgtctt

SEQ ID NO: 140404 - DNA, 22 bp, Artificial Sequence
  chemically synthesized
ccaaacctaggatcttgtcttc

SEQ ID NO: 140405 - DNA, 22 bp, Artificial Sequence
  chemically synthesized
caaacctaggatcttgtcttcc

SEQ ID NO: 140406 - DNA, 22 bp, Artificial Sequence
  chemically synthesized
ggatcttgtcttcctaggctat

SEQ ID NO: 140407 - DNA, 22 bp, Artificial Sequence
  chemically synthesized
gtcttcctaggctatatatttt

SEQ ID NO: 140408 - DNA, 22 bp, Artificial Sequence
  chemically synthesized
tcttcctaggctatatattttg

SEQ ID NO: 140409 - DNA, 22 bp, Artificial Sequence
  chemically synthesized
cctaggctatatattttgtccc

SEQ ID NO: 140410 - DNA, 22 bp, Artificial Sequence
  chemically synthesized
ctaggctatatattttgtccca

SEQ ID NO: 140411 - DNA, 22 bp, Artificial Sequence
  chemically synthesized
ggctatatattttgtcccagga

SEQ ID NO: 140412 - DNA, 22 bp, Artificial Sequence
  chemically synthesized
tatattttgtcccaggaagtct

SEQ ID NO: 140413 - DNA, 22 bp, Artificial Sequence
  chemically synthesized
tgtcccaggaagtcttaatctg

SEQ ID NO: 140414 - DNA, 22 bp, Artificial Sequence
  chemically synthesized
gtcccaggaagtcttaatctgg

SEQ ID NO: 140415 - DNA, 22 bp, Artificial Sequence
  chemically synthesized
tcccaggaagtcttaatctggg

SEQ ID NO: 140416 - DNA, 22 bp, Artificial Sequence
  chemically synthesized
aatctggggtccacagaacact

SEQ ID NO: 140417 - DNA, 22 bp, Artificial Sequence
  chemically synthesized
atctggggtccacagaacacta

SEQ ID NO: 140418 - DNA, 22 bp, Artificial Sequence
  chemically synthesized
gggtccacagaacactaggggg

SEQ ID NO: 140419 - DNA, 22 bp, Artificial Sequence
  chemically synthesized
gggggctggtgaagtttataga

SEQ ID NO: 140420 - DNA, 22 bp, Artificial Sequence
  chemically synthesized
gtgaagtttatagaaaaaaaat

SEQ ID NO: 140421 - DNA, 22 bp, Artificial Sequence
  chemically synthesized
atagaaaaaaaatctgtatttt

SEQ ID NO: 140422 - DNA, 22 bp, Artificial Sequence
  chemically synthesized
tagaaaaaaaatctgtattttt

SEQ ID NO: 140423 - DNA, 22 bp, Artificial Sequence
  chemically synthesized
tatttttacttacatgtaactg

SEQ ID NO: 140424 - DNA, 22 bp, Artificial Sequence
  chemically synthesized
ttacttacatgtaactgaaatt

SEQ ID NO: 140425 - DNA, 22 bp, Artificial Sequence
  chemically synthesized
tacttacatgtaactgaaattt

SEQ ID NO: 140426 - DNA, 22 bp, Artificial Sequence
  chemically synthesized
acttacatgtaactgaaattta

SEQ ID NO: 140427 - DNA, 22 bp, Artificial Sequence
  chemically synthesized
cttacatgtaactgaaatttag

SEQ ID NO: 140428 - DNA, 22 bp, Artificial Sequence
  chemically synthesized
acatgtaactgaaatttagcat

SEQ ID NO: 140429 - DNA, 22 bp, Artificial Sequence
  chemically synthesized
catgtaactgaaatttagcatt

SEQ ID NO: 140430 - DNA, 22 bp, Artificial Sequence
  chemically synthesized
aaatttagcattttcttctact

SEQ ID NO: 140431 - DNA, 22 bp, Artificial Sequence
  chemically synthesized
agcattttcttctactttgaat

SEQ ID NO: 140432 - DNA, 22 bp, Artificial Sequence
  chemically synthesized
gcattttcttctactttgaatg

SEQ ID NO: 140433 - DNA, 22 bp, Artificial Sequence
  chemically synthesized
tcttctactttgaatgcaaagg

SEQ ID NO: 140434 - DNA, 22 bp, Artificial Sequence
  chemically synthesized
cttctactttgaatgcaaagga

SEQ ID NO: 140435 - DNA, 22 bp, Artificial Sequence
  chemically synthesized
ttctactttgaatgcaaaggac

SEQ ID NO: 140436 - DNA, 22 bp, Artificial Sequence
  chemically synthesized
ctactttgaatgcaaaggacaa

SEQ ID NO: 140437 - DNA, 22 bp, Artificial Sequence
  chemically synthesized
tactttgaatgcaaaggacaaa

SEQ ID NO: 140438 - DNA, 22 bp, Artificial Sequence
  chemically synthesized
ctttgaatgcaaaggacaaact

SEQ ID NO: 140439 - DNA, 22 bp, Artificial Sequence
  chemically synthesized
tgaatgcaaaggacaaactaga

SEQ ID NO: 140440 - DNA, 22 bp, Artificial Sequence
  chemically synthesized
gaatgcaaaggacaaactagaa

SEQ ID NO: 140441 - DNA, 22 bp, Artificial Sequence
  chemically synthesized
aatgcaaaggacaaactagaat

SEQ ID NO: 140442 - DNA, 22 bp, Artificial Sequence
  chemically synthesized
gaatgacatcatcagtacctat

SEQ ID NO: 140443 - DNA, 22 bp, Artificial Sequence
  chemically synthesized
ttgcatagttataaagagaaac

SEQ ID NO: 140444 - DNA, 22 bp, Artificial Sequence
  chemically synthesized
catagttataaagagaaaccac

SEQ ID NO: 140445 - DNA, 22 bp, Artificial Sequence
  chemically synthesized
taaagagaaaccacagatattt

SEQ ID NO: 140446 - DNA, 22 bp, Artificial Sequence
  chemically synthesized
tcatactacaccataggtattg

SEQ ID NO: 140447 - DNA, 22 bp, Artificial Sequence
  chemically synthesized
catactacaccataggtattgc

SEQ ID NO: 140448 - DNA, 22 bp, Artificial Sequence
  chemically synthesized
atactacaccataggtattgca

SEQ ID NO: 140449 - DNA, 22 bp, Artificial Sequence
  chemically synthesized
caccataggtattgcagatctt

SEQ ID NO: 140450 - DNA, 22 bp, Artificial Sequence
  chemically synthesized
cagatctttttgtttttgtttt

SEQ ID NO: 140451 - DNA, 22 bp, Artificial Sequence
  chemically synthesized
tttgtttttgtttttgtttgag

SEQ ID NO: 140452 - DNA, 22 bp, Artificial Sequence
  chemically synthesized
ttgtttttgtttttgtttgaga

SEQ ID NO: 140453 - DNA, 22 bp, Artificial Sequence
  chemically synthesized
tgtttttgtttttgtttgagat

SEQ ID NO: 140454 - DNA, 22 bp, Artificial Sequence
  chemically synthesized
gtttttgtttttgtttgagatg

SEQ ID NO: 140455 - DNA, 22 bp, Artificial Sequence
  chemically synthesized
tttttgtttttgtttgagatgg

SEQ ID NO: 140456 - DNA, 22 bp, Artificial Sequence
  chemically synthesized
ttgtttttgtttgagatggagt

SEQ ID NO: 140457 - DNA, 22 bp, Artificial Sequence
  chemically synthesized
tgtttttgtttgagatggagtt

SEQ ID NO: 140458 - DNA, 22 bp, Artificial Sequence
  chemically synthesized
gtttttgtttgagatggagttt

SEQ ID NO: 140459 - DNA, 22 bp, Artificial Sequence
  chemically synthesized
tttttgtttgagatggagtttc

SEQ ID NO: 140460 - DNA, 22 bp, Artificial Sequence
  chemically synthesized
ttgtttgagatggagtttcgct

SEQ ID NO: 140461 - DNA, 22 bp, Artificial Sequence
  chemically synthesized
tgtttgagatggagtttcgctc

SEQ ID NO: 140462 - DNA, 22 bp, Artificial Sequence
  chemically synthesized
gtttgagatggagtttcgctct

SEQ ID NO: 140463 - DNA, 22 bp, Artificial Sequence
  chemically synthesized
tttgagatggagtttcgctctt

SEQ ID NO: 140464 - DNA, 22 bp, Artificial Sequence
  chemically synthesized
gagatggagtttcgctcttatt

SEQ ID NO: 140465 - DNA, 22 bp, Artificial Sequence
  chemically synthesized
agatggagtttcgctcttattg

SEQ ID NO: 140466 - DNA, 22 bp, Artificial Sequence
  chemically synthesized
cgctcttattgcccaggctgga

SEQ ID NO: 140467 - DNA, 22 bp, Artificial Sequence
  chemically synthesized
gctcttattgcccaggctggag

SEQ ID NO: 140468 - DNA, 22 bp, Artificial Sequence
  chemically synthesized
ttattgcccaggctggagtgca

SEQ ID NO: 140469 - DNA, 22 bp, Artificial Sequence
  chemically synthesized
attgcccaggctggagtgcagt

SEQ ID NO: 140470 - DNA, 22 bp, Artificial Sequence
  chemically synthesized
ttgcccaggctggagtgcagtg

SEQ ID NO: 140471 - DNA, 22 bp, Artificial Sequence
  chemically synthesized
cccaggctggagtgcagtggca

SEQ ID NO: 140472 - DNA, 22 bp, Artificial Sequence
  chemically synthesized
gagtgcagtggcatgatttcgg

SEQ ID NO: 140473 - DNA, 22 bp, Artificial Sequence
  chemically synthesized
cggctcactgcaacctcccctt

SEQ ID NO: 140474 - DNA, 22 bp, Artificial Sequence
  chemically synthesized
ggctcactgcaacctccccttc

SEQ ID NO: 140475 - DNA, 22 bp, Artificial Sequence
  chemically synthesized
actgcaacctccccttcctgca

SEQ ID NO: 140476 - DNA, 22 bp, Artificial Sequence
  chemically synthesized
caacctccccttcctgcattca

SEQ ID NO: 140477 - DNA, 22 bp, Artificial Sequence
  chemically synthesized
cccttcctgcattcaagcaatt

SEQ ID NO: 140478 - DNA, 22 bp, Artificial Sequence
  chemically synthesized
cctgcattcaagcaattctcct

SEQ ID NO: 140479 - DNA, 22 bp, Artificial Sequence
  chemically synthesized
ctgcattcaagcaattctcctg

SEQ ID NO: 140480 - DNA, 22 bp, Artificial Sequence
  chemically synthesized
cattcaagcaattctcctgcct

SEQ ID NO: 140481 - DNA, 22 bp, Artificial Sequence
  chemically synthesized
aagcaattctcctgccttggcc

SEQ ID NO: 140482 - DNA, 22 bp, Artificial Sequence
  chemically synthesized
tcctgccttggcctcctgagta

SEQ ID NO: 140483 - DNA, 22 bp, Artificial Sequence
  chemically synthesized
ctgccttggcctcctgagtagc

SEQ ID NO: 140484 - DNA, 22 bp, Artificial Sequence
  chemically synthesized
ccttggcctcctgagtagctgg

SEQ ID NO: 140485 - DNA, 22 bp, Artificial Sequence
  chemically synthesized
ggcctcctgagtagctggggat

SEQ ID NO: 140486 - DNA, 22 bp, Artificial Sequence
  chemically synthesized
gcctcctgagtagctggggatt

SEQ ID NO: 140487 - DNA, 22 bp, Artificial Sequence
  chemically synthesized
ctgagtagctggggattacagg

SEQ ID NO: 140488 - DNA, 22 bp, Artificial Sequence
  chemically synthesized
agtagctggggattacaggcac

SEQ ID NO: 140489 - DNA, 22 bp, Artificial Sequence
  chemically synthesized
gggattacaggcacctgccacc

SEQ ID NO: 140490 - DNA, 22 bp, Artificial Sequence
  chemically synthesized
caggcacctgccaccatgccag

SEQ ID NO: 140491 - DNA, 22 bp, Artificial Sequence
  chemically synthesized
ccaccatgccagtctaattttt

SEQ ID NO: 140492 - DNA, 22 bp, Artificial Sequence
  chemically synthesized
atttttgtatttttagtagaga

SEQ ID NO: 140493 - DNA, 22 bp, Artificial Sequence
  chemically synthesized
ttgtatttttagtagagatggg

SEQ ID NO: 140494 - DNA, 22 bp, Artificial Sequence
  chemically synthesized
tgtatttttagtagagatgggg

SEQ ID NO: 140495 - DNA, 22 bp, Artificial Sequence
  chemically synthesized
gtatttttagtagagatggggt

SEQ ID NO: 140496 - DNA, 22 bp, Artificial Sequence
  chemically synthesized
tatttttagtagagatggggtt

SEQ ID NO: 140497 - DNA, 22 bp, Artificial Sequence
  chemically synthesized
ttagtagagatggggtttcgcc

SEQ ID NO: 140498 - DNA, 22 bp, Artificial Sequence
  chemically synthesized
tagtagagatggggtttcgcca

SEQ ID NO: 140499 - DNA, 22 bp, Artificial Sequence
  chemically synthesized
agtagagatggggtttcgccat

SEQ ID NO: 140500 - DNA, 22 bp, Artificial Sequence
  chemically synthesized
gtagagatggggtttcgccatg

SEQ ID NO: 140501 - DNA, 22 bp, Artificial Sequence
  chemically synthesized
cgccatgttggccaggctggtc

SEQ ID NO: 140502 - DNA, 22 bp, Artificial Sequence
  chemically synthesized
gccatgttggccaggctggtct

SEQ ID NO: 140503 - DNA, 22 bp, Artificial Sequence
  chemically synthesized
gccaggctggtcttgaactcct

SEQ ID NO: 140504 - DNA, 22 bp, Artificial Sequence
  chemically synthesized
gtcttgaactcctgacctcaga

SEQ ID NO: 140505 - DNA, 22 bp, Artificial Sequence
  chemically synthesized
gaactcctgacctcagatgatc

SEQ ID NO: 140506 - DNA, 22 bp, Artificial Sequence
  chemically synthesized
aactcctgacctcagatgatct

SEQ ID NO: 140507 - DNA, 22 bp, Artificial Sequence
  chemically synthesized
ctgacctcagatgatctgcccg

SEQ ID NO: 140508 - DNA, 22 bp, Artificial Sequence
  chemically synthesized
acctcagatgatctgcccgcct

SEQ ID NO: 140509 - DNA, 22 bp, Artificial Sequence
  chemically synthesized
agatgatctgcccgccttggcc

SEQ ID NO: 140510 - DNA, 22 bp, Artificial Sequence
  chemically synthesized
cccgccttggcctcctgaagtg

SEQ ID NO: 140511 - DNA, 22 bp, Artificial Sequence
  chemically synthesized
ggcctcctgaagtgctgggatt

SEQ ID NO: 140512 - DNA, 22 bp, Artificial Sequence
  chemically synthesized
gcctcctgaagtgctgggatta

SEQ ID NO: 140513 - DNA, 22 bp, Artificial Sequence
  chemically synthesized
ctgaagtgctgggattataggt

SEQ ID NO: 140514 - DNA, 22 bp, Artificial Sequence
  chemically synthesized
aagtgctgggattataggtgtg

SEQ ID NO: 140515 - DNA, 22 bp, Artificial Sequence
  chemically synthesized
ggattataggtgtgagccacca

SEQ ID NO: 140516 - DNA, 22 bp, Artificial Sequence
  chemically synthesized
taggtgtgagccaccacgcctg

SEQ ID NO: 140517 - DNA, 22 bp, Artificial Sequence
  chemically synthesized
gcccattgcagatatttttaat

SEQ ID NO: 140518 - DNA, 22 bp, Artificial Sequence
  chemically synthesized
cagatatttttaattcacattt

SEQ ID NO: 140519 - DNA, 22 bp, Artificial Sequence
  chemically synthesized
ttaattcacatttatctgcatc

SEQ ID NO: 140520 - DNA, 22 bp, Artificial Sequence
  chemically synthesized
taattcacatttatctgcatca

SEQ ID NO: 140521 - DNA, 22 bp, Artificial Sequence
  chemically synthesized
aattcacatttatctgcatcac

SEQ ID NO: 140522 - DNA, 22 bp, Artificial Sequence
  chemically synthesized
attcacatttatctgcatcact

SEQ ID NO: 140523 - DNA, 22 bp, Artificial Sequence
  chemically synthesized
acatttatctgcatcactactt

SEQ ID NO: 140524 - DNA, 22 bp, Artificial Sequence
  chemically synthesized
atctgcatcactacttggatct

SEQ ID NO: 140525 - DNA, 22 bp, Artificial Sequence
  chemically synthesized
tctgcatcactacttggatctt

SEQ ID NO: 140526 - DNA, 22 bp, Artificial Sequence
  chemically synthesized
catcactacttggatcttaagg

SEQ ID NO: 140527 - DNA, 22 bp, Artificial Sequence
  chemically synthesized
cttggatcttaaggtagctgta

SEQ ID NO: 140528 - DNA, 22 bp, Artificial Sequence
  chemically synthesized
ggatcttaaggtagctgtagac

SEQ ID NO: 140529 - DNA, 22 bp, Artificial Sequence
  chemically synthesized
gatcttaaggtagctgtagacc

SEQ ID NO: 140530 - DNA, 22 bp, Artificial Sequence
  chemically synthesized
aaggtagctgtagacccaatcc

SEQ ID NO: 140531 - DNA, 22 bp, Artificial Sequence
  chemically synthesized
aggtagctgtagacccaatcct

SEQ ID NO: 140532 - DNA, 22 bp, Artificial Sequence
  chemically synthesized
tagacccaatcctagatctaat

SEQ ID NO: 140533 - DNA, 22 bp, Artificial Sequence
  chemically synthesized
gatctaatgctttcataaagaa

SEQ ID NO: 140534 - DNA, 22 bp, Artificial Sequence
  chemically synthesized
atgctttcataaagaagcaaat

SEQ ID NO: 140535 - DNA, 22 bp, Artificial Sequence
  chemically synthesized
tcataaagaagcaaatataata

SEQ ID NO: 140536 - DNA, 22 bp, Artificial Sequence
  chemically synthesized
cataaagaagcaaatataataa

SEQ ID NO: 140537 - DNA, 22 bp, Artificial Sequence
  chemically synthesized
ataaagaagcaaatataataaa

SEQ ID NO: 140538 - DNA, 22 bp, Artificial Sequence
  chemically synthesized
taccacaaatgtaatgtttgat

SEQ ID NO: 140539 - DNA, 22 bp, Artificial Sequence
  chemically synthesized
gatgtctgataatgatatttca

SEQ ID NO: 140540 - DNA, 22 bp, Artificial Sequence
  chemically synthesized
atgtctgataatgatatttcag

SEQ ID NO: 140541 - DNA, 22 bp, Artificial Sequence
  chemically synthesized
ataatgatatttcagtgtaatt

SEQ ID NO: 140542 - DNA, 22 bp, Artificial Sequence
  chemically synthesized
cagtgtaattaaacttagcact

SEQ ID NO: 140543 - DNA, 22 bp, Artificial Sequence
  chemically synthesized
agtgtaattaaacttagcactc

SEQ ID NO: 140544 - DNA, 22 bp, Artificial Sequence
  chemically synthesized
aacttagcactcctatgtatat

SEQ ID NO: 140545 - DNA, 22 bp, Artificial Sequence
  chemically synthesized
agcactcctatgtatattattt

SEQ ID NO: 140546 - DNA, 22 bp, Artificial Sequence
  chemically synthesized
gcactcctatgtatattatttg

SEQ ID NO: 140547 - DNA, 22 bp, Artificial Sequence
  chemically synthesized
ctatgtatattatttgatgcaa

SEQ ID NO: 140548 - DNA, 22 bp, Artificial Sequence
  chemically synthesized
tgtatattatttgatgcaataa

SEQ ID NO: 140549 - DNA, 22 bp, Artificial Sequence
  chemically synthesized
tttgatgcaataaaaacatatt

SEQ ID NO: 140550 - DNA, 22 bp, Artificial Sequence
  chemically synthesized
gatgcaataaaaacatattttt

SEQ ID NO: 140551 - DNA, 22 bp, Artificial Sequence
  chemically synthesized
atgcaataaaaacatatttttt

SEQ ID NO: 140552 - DNA, 22 bp, Artificial Sequence
  chemically synthesized
ttttagcacttacagtctgcca

SEQ ID NO: 140553 - DNA, 22 bp, Artificial Sequence
  chemically synthesized
tttagcacttacagtctgccaa

SEQ ID NO: 140554 - DNA, 22 bp, Artificial Sequence
  chemically synthesized
ttagcacttacagtctgccaaa

SEQ ID NO: 140555 - DNA, 22 bp, Artificial Sequence
  chemically synthesized
tagcacttacagtctgccaaac

SEQ ID NO: 140556 - DNA, 22 bp, Artificial Sequence
  chemically synthesized
agcacttacagtctgccaaact

SEQ ID NO: 140557 - DNA, 22 bp, Artificial Sequence
  chemically synthesized
gcacttacagtctgccaaactg

SEQ ID NO: 140558 - DNA, 22 bp, Artificial Sequence
  chemically synthesized
acagtctgccaaactggcctgt

SEQ ID NO: 140559 - DNA, 22 bp, Artificial Sequence
  chemically synthesized
cagtctgccaaactggcctgtg

SEQ ID NO: 140560 - DNA, 22 bp, Artificial Sequence
  chemically synthesized
ccaaactggcctgtgacacaaa

SEQ ID NO: 140561 - DNA, 22 bp, Artificial Sequence
  chemically synthesized
gcctgtgacacaaaaaaagttt

SEQ ID NO: 140562 - DNA, 22 bp, Artificial Sequence
  chemically synthesized
tgacacaaaaaaagtttaggaa

SEQ ID NO: 140563 - DNA, 22 bp, Artificial Sequence
  chemically synthesized
aggaattcctggttttgtctgt

SEQ ID NO: 140564 - DNA, 22 bp, Artificial Sequence
  chemically synthesized
ggaattcctggttttgtctgtg

SEQ ID NO: 140565 - DNA, 22 bp, Artificial Sequence
  chemically synthesized
ctggttttgtctgtgttagcca

SEQ ID NO: 140566 - DNA, 22 bp, Artificial Sequence
  chemically synthesized
gttttgtctgtgttagccaatg

SEQ ID NO: 140567 - DNA, 22 bp, Artificial Sequence
  chemically synthesized
tgtctgtgttagccaatggtta

SEQ ID NO: 140568 - DNA, 22 bp, Artificial Sequence
  chemically synthesized
gtctgtgttagccaatggttag

SEQ ID NO: 140569 - DNA, 22 bp, Artificial Sequence
  chemically synthesized
tctgtgttagccaatggttaga

SEQ ID NO: 140570 - DNA, 22 bp, Artificial Sequence
  chemically synthesized
tgttagccaatggttagaatat

SEQ ID NO: 140571 - DNA, 22 bp, Artificial Sequence
  chemically synthesized
gccaatggttagaatatatgct

SEQ ID NO: 140572 - DNA, 22 bp, Artificial Sequence
  chemically synthesized
gaatatatgctcagaaagatac

SEQ ID NO: 140573 - DNA, 22 bp, Artificial Sequence
  chemically synthesized
agaaagataccattggttaata

SEQ ID NO: 140574 - DNA, 22 bp, Artificial Sequence
  chemically synthesized
gttaatagctaaaagaaaatgg

SEQ ID NO: 140575 - DNA, 22 bp, Artificial Sequence
  chemically synthesized
atagctaaaagaaaatggagta

SEQ ID NO: 140576 - DNA, 22 bp, Artificial Sequence
  chemically synthesized
aaagaaaatggagtagaaattc

SEQ ID NO: 140577 - DNA, 22 bp, Artificial Sequence
  chemically synthesized
agtggcctggaataataacaat

SEQ ID NO: 140578 - DNA, 22 bp, Artificial Sequence
  chemically synthesized
gaataataacaatttgggcagt

SEQ ID NO: 140579 - DNA, 22 bp, Artificial Sequence
  chemically synthesized
gggcagtcattaagtcaggtga

SEQ ID NO: 140580 - DNA, 22 bp, Artificial Sequence
  chemically synthesized
ggcagtcattaagtcaggtgaa

SEQ ID NO: 140581 - DNA, 22 bp, Artificial Sequence
  chemically synthesized
agtcaggtgaagacttctggaa

SEQ ID NO: 140582 - DNA, 22 bp, Artificial Sequence
  chemically synthesized
ctggaatcatgggagaaaagca

SEQ ID NO: 140583 - DNA, 22 bp, Artificial Sequence
  chemically synthesized
tggaatcatgggagaaaagcaa

SEQ ID NO: 140584 - DNA, 22 bp, Artificial Sequence
  chemically synthesized
gaatcatgggagaaaagcaagg

SEQ ID NO: 140585 - DNA, 22 bp, Artificial Sequence
  chemically synthesized
ttacttgccacaagtgtttttt

SEQ ID NO: 140586 - DNA, 22 bp, Artificial Sequence
  chemically synthesized
acttgccacaagtgtttttttt

SEQ ID NO: 140587 - DNA, 22 bp, Artificial Sequence
  chemically synthesized
cttgccacaagtgttttttttt

SEQ ID NO: 140588 - DNA, 22 bp, Artificial Sequence
  chemically synthesized
gccacaagtgtttttttttttt

SEQ ID NO: 140589 - DNA, 22 bp, Artificial Sequence
  chemically synthesized
ccacaagtgttttttttttttt

SEQ ID NO: 140590 - DNA, 22 bp, Artificial Sequence
  chemically synthesized
ttttttttttttttttttatca

SEQ ID NO: 140591 - DNA, 22 bp, Artificial Sequence
  chemically synthesized
tttttttttttttttttatcac

SEQ ID NO: 140592 - DNA, 22 bp, Artificial Sequence
  chemically synthesized
ttttttttttttttttatcaca

SEQ ID NO: 140593 - DNA, 22 bp, Artificial Sequence
  chemically synthesized
tttttttttttttttatcacaa

SEQ ID NO: 140594 - DNA, 22 bp, Artificial Sequence
  chemically synthesized
ttttttttttttttatcacaaa

SEQ ID NO: 140595 - DNA, 22 bp, Artificial Sequence
  chemically synthesized
tttttttttttttatcacaaac

SEQ ID NO: 140596 - DNA, 22 bp, Artificial Sequence
  chemically synthesized
ttttttttttttatcacaaaca

SEQ ID NO: 140597 - DNA, 22 bp, Artificial Sequence
  chemically synthesized
tttttttttttatcacaaacat

SEQ ID NO: 140598 - DNA, 22 bp, Artificial Sequence
  chemically synthesized
ttttttttttatcacaaacata

SEQ ID NO: 140599 - DNA, 22 bp, Artificial Sequence
  chemically synthesized
tttttttttatcacaaacataa

SEQ ID NO: 140600 - DNA, 22 bp, Artificial Sequence
  chemically synthesized
ttttttttatcacaaacataag

SEQ ID NO: 140601 - DNA, 22 bp, Artificial Sequence
  chemically synthesized
tttttttatcacaaacataaga

SEQ ID NO: 140602 - DNA, 22 bp, Artificial Sequence
  chemically synthesized
ttttttatcacaaacataagaa

SEQ ID NO: 140603 - DNA, 22 bp, Artificial Sequence
  chemically synthesized
tttttatcacaaacataagaaa

SEQ ID NO: 140604 - DNA, 22 bp, Artificial Sequence
  chemically synthesized
ttttatcacaaacataagaaaa

SEQ ID NO: 140605 - DNA, 22 bp, Artificial Sequence
  chemically synthesized
tttatcacaaacataagaaaat

SEQ ID NO: 140606 - DNA, 22 bp, Artificial Sequence
  chemically synthesized
ttatcacaaacataagaaaata

SEQ ID NO: 140607 - DNA, 22 bp, Artificial Sequence
  chemically synthesized
tatcacaaacataagaaaatat

SEQ ID NO: 140608 - DNA, 22 bp, Artificial Sequence
  chemically synthesized
atcacaaacataagaaaatata

SEQ ID NO: 140609 - DNA, 22 bp, Artificial Sequence
  chemically synthesized
tcacaaacataagaaaatataa

SEQ ID NO: 140610 - DNA, 22 bp, Artificial Sequence
  chemically synthesized
tagaagagagaaacgctcttag

SEQ ID NO: 140611 - DNA, 22 bp, Artificial Sequence
  chemically synthesized
ttagtaaacttggaatatggaa

SEQ ID NO: 140612 - DNA, 22 bp, Artificial Sequence
  chemically synthesized
agtaaacttggaatatggaatc

SEQ ID NO: 140613 - DNA, 22 bp, Artificial Sequence
  chemically synthesized
gtaaacttggaatatggaatcc

SEQ ID NO: 140614 - DNA, 22 bp, Artificial Sequence
  chemically synthesized
ggaatatggaatccccaaaggc

SEQ ID NO: 140615 - DNA, 22 bp, Artificial Sequence
  chemically synthesized
gaatatggaatccccaaaggca

SEQ ID NO: 140616 - DNA, 22 bp, Artificial Sequence
  chemically synthesized
gacttgggagacaggagccata

SEQ ID NO: 140617 - DNA, 22 bp, Artificial Sequence
  chemically synthesized
acttgggagacaggagccatac

SEQ ID NO: 140618 - DNA, 22 bp, Artificial Sequence
  chemically synthesized
gggagacaggagccatactgct

SEQ ID NO: 140619 - DNA, 22 bp, Artificial Sequence
  chemically synthesized
ggagacaggagccatactgcta

SEQ ID NO: 140620 - DNA, 22 bp, Artificial Sequence
  chemically synthesized
ctaagtgaaaaagacgaagaac

SEQ ID NO: 140621 - DNA, 22 bp, Artificial Sequence
  chemically synthesized
agtgaaaaagacgaagaacctc

SEQ ID NO: 140622 - DNA, 22 bp, Artificial Sequence
  chemically synthesized
tagggcctgaacatacaggaaa

SEQ ID NO: 140623 - DNA, 22 bp, Artificial Sequence
  chemically synthesized
gggcctgaacatacaggaaatt

SEQ ID NO: 140624 - DNA, 22 bp, Artificial Sequence
  chemically synthesized
aacatacaggaaattgtaggaa

SEQ ID NO: 140625 - DNA, 22 bp, Artificial Sequence
  chemically synthesized
taggaacagaaattcctagatc

SEQ ID NO: 140626 - DNA, 22 bp, Artificial Sequence
  chemically synthesized
ctagatctggtggggcaagggg

SEQ ID NO: 140627 - DNA, 22 bp, Artificial Sequence
  chemically synthesized
gatctggtggggcaaggggagc

SEQ ID NO: 140628 - DNA, 22 bp, Artificial Sequence
  chemically synthesized
gtggggcaaggggagccatagg

SEQ ID NO: 140629 - DNA, 22 bp, Artificial Sequence
  chemically synthesized
gcaaacatggtgaaatcccgtc

SEQ ID NO: 140630 - DNA, 22 bp, Artificial Sequence
  chemically synthesized
tactaaaaataaaaaaattagc

SEQ ID NO: 140631 - DNA, 22 bp, Artificial Sequence
  chemically synthesized
ctaaaaataaaaaaattagctg

SEQ ID NO: 140632 - DNA, 22 bp, Artificial Sequence
  chemically synthesized
aaaataaaaaaattagctgggc

SEQ ID NO: 140633 - DNA, 22 bp, Artificial Sequence
  chemically synthesized
gctgggcatggtggcatgcgcc

SEQ ID NO: 140634 - DNA, 22 bp, Artificial Sequence
  chemically synthesized
ggcatggtggcatgcgcctgta

SEQ ID NO: 140635 - DNA, 22 bp, Artificial Sequence
  chemically synthesized
tagtcccagctgctcgggaggc

SEQ ID NO: 140636 - DNA, 22 bp, Artificial Sequence
  chemically synthesized
ctcgggaggctgaggcaggaga

SEQ ID NO: 140637 - DNA, 22 bp, Artificial Sequence
  chemically synthesized
gggaggctgaggcaggagaatc

SEQ ID NO: 140638 - DNA, 22 bp, Artificial Sequence
  chemically synthesized
aggcaggagaatcgtttgaacc

SEQ ID NO: 140639 - DNA, 22 bp, Artificial Sequence
  chemically synthesized
gaacccaggaggcgaaggttgc

SEQ ID NO: 140640 - DNA, 22 bp, Artificial Sequence
  chemically synthesized
aacccaggaggcgaaggttgca

SEQ ID NO: 140641 - DNA, 22 bp, Artificial Sequence
  chemically synthesized
cagtgagctgagatagtgccat

SEQ ID NO: 140642 - DNA, 22 bp, Artificial Sequence
  chemically synthesized
agatagtgccattgcactccag

SEQ ID NO: 140643 - DNA, 22 bp, Artificial Sequence
  chemically synthesized
cactccagtctggcaacagagt

SEQ ID NO: 140644 - DNA, 22 bp, Artificial Sequence
  chemically synthesized
cagtctggcaacagagtgagac

SEQ ID NO: 140645 - DNA, 22 bp, Artificial Sequence
  chemically synthesized
gcaacagagtgagactccgtct

SEQ ID NO: 140646 - DNA, 22 bp, Artificial Sequence
  chemically synthesized
cgtctcaaaaaaaaaaaaaaaa

SEQ ID NO: 140647 - DNA, 22 bp, Artificial Sequence
  chemically synthesized
aaaaaaaaaaaaaaaagaaaga

SEQ ID NO: 140648 - DNA, 22 bp, Artificial Sequence
  chemically synthesized
ggctggggcaatgagattatgg

SEQ ID NO: 140649 - DNA, 22 bp, Artificial Sequence
  chemically synthesized
gggcaatgagattatggtgatg

SEQ ID NO: 140650 - DNA, 22 bp, Artificial Sequence
  chemically synthesized
tggtgatgtaagggacttttat

SEQ ID NO: 140651 - DNA, 22 bp, Artificial Sequence
  chemically synthesized
ttatagaattaacaatgctgga

SEQ ID NO: 140652 - DNA, 22 bp, Artificial Sequence
  chemically synthesized
tatagaattaacaatgctggaa

SEQ ID NO: 140653 - DNA, 22 bp, Artificial Sequence
  chemically synthesized
atagaattaacaatgctggaat

SEQ ID NO: 140654 - DNA, 22 bp, Artificial Sequence
  chemically synthesized
tagaattaacaatgctggaatt

SEQ ID NO: 140655 - DNA, 22 bp, Artificial Sequence
  chemically synthesized
acaatgctggaatttgtggaac

SEQ ID NO: 140656 - DNA, 22 bp, Artificial Sequence
  chemically synthesized
gaatttgtggaactctgcttct

SEQ ID NO: 140657 - DNA, 22 bp, Artificial Sequence
  chemically synthesized
gtggaactctgcttctattatt

SEQ ID NO: 140658 - DNA, 22 bp, Artificial Sequence
  chemically synthesized
tggaactctgcttctattattc

SEQ ID NO: 140659 - DNA, 22 bp, Artificial Sequence
  chemically synthesized
tgcttctattattcccccaatc

SEQ ID NO: 140660 - DNA, 22 bp, Artificial Sequence
  chemically synthesized
cttctattattcccccaatcat

SEQ ID NO: 140661 - DNA, 22 bp, Artificial Sequence
  chemically synthesized
ctattattcccccaatcattac

SEQ ID NO: 140662 - DNA, 22 bp, Artificial Sequence
  chemically synthesized
tattattcccccaatcattact

SEQ ID NO: 140663 - DNA, 22 bp, Artificial Sequence
  chemically synthesized
ttattcccccaatcattacttc

SEQ ID NO: 140664 - DNA, 22 bp, Artificial Sequence
  chemically synthesized
ttcccccaatcattacttctgt

SEQ ID NO: 140665 - DNA, 22 bp, Artificial Sequence
  chemically synthesized
ccccaatcattacttctgtcac

SEQ ID NO: 140666 - DNA, 22 bp, Artificial Sequence
  chemically synthesized
cttctgtcacattgatagttaa

SEQ ID NO: 140667 - DNA, 22 bp, Artificial Sequence
  chemically synthesized
ctgtcacattgatagttaaata

SEQ ID NO: 140668 - DNA, 22 bp, Artificial Sequence
  chemically synthesized
tgtcacattgatagttaaataa

SEQ ID NO: 140669 - DNA, 22 bp, Artificial Sequence
  chemically synthesized
tcacattgatagttaaataatt

SEQ ID NO: 140670 - DNA, 22 bp, Artificial Sequence
  chemically synthesized
atagttaaataatttctgtgaa

SEQ ID NO: 140671 - DNA, 22 bp, Artificial Sequence
  chemically synthesized
aataatttctgtgaatttattc

SEQ ID NO: 140672 - DNA, 22 bp, Artificial Sequence
  chemically synthesized
ctgtgaatttattccttgattc

SEQ ID NO: 140673 - DNA, 22 bp, Artificial Sequence
  chemically synthesized
tgtgaatttattccttgattct

SEQ ID NO: 140674 - DNA, 22 bp, Artificial Sequence
  chemically synthesized
tgaatttattccttgattctaa

SEQ ID NO: 140675 - DNA, 22 bp, Artificial Sequence
  chemically synthesized
attccttgattctaaaatatga

SEQ ID NO: 140676 - DNA, 22 bp, Artificial Sequence
  chemically synthesized
ttccttgattctaaaatatgag

SEQ ID NO: 140677 - DNA, 22 bp, Artificial Sequence
  chemically synthesized
cttgattctaaaatatgaggat

SEQ ID NO: 140678 - DNA, 22 bp, Artificial Sequence
  chemically synthesized
gattctaaaatatgaggataat

SEQ ID NO: 140679 - DNA, 22 bp, Artificial Sequence
  chemically synthesized
attctaaaatatgaggataatg

SEQ ID NO: 140680 - DNA, 22 bp, Artificial Sequence
  chemically synthesized
taaaatatgaggataatgacaa

SEQ ID NO: 140681 - DNA, 22 bp, Artificial Sequence
  chemically synthesized
aaatatgaggataatgacaatg

SEQ ID NO: 140682 - DNA, 22 bp, Artificial Sequence
  chemically synthesized
taagggcagattaagtgatata

SEQ ID NO: 140683 - DNA, 22 bp, Artificial Sequence
  chemically synthesized
agtgatatagcatgagcaatat

SEQ ID NO: 140684 - DNA, 22 bp, Artificial Sequence
  chemically synthesized
ttcaggcacatggatcgaattg

SEQ ID NO: 140685 - DNA, 22 bp, Artificial Sequence
  chemically synthesized
caggcacatggatcgaattgaa

SEQ ID NO: 140686 - DNA, 22 bp, Artificial Sequence
  chemically synthesized
aggcacatggatcgaattgaat

SEQ ID NO: 140687 - DNA, 22 bp, Artificial Sequence
  chemically synthesized
aatacactgtaaatcccaactt

SEQ ID NO: 140688 - DNA, 22 bp, Artificial Sequence
  chemically synthesized
taaatcccaacttccagtttca

SEQ ID NO: 140689 - DNA, 22 bp, Artificial Sequence
  chemically synthesized
ccagtttcagctctaccaagta

SEQ ID NO: 140690 - DNA, 22 bp, Artificial Sequence
  chemically synthesized
cagtttcagctctaccaagtaa

SEQ ID NO: 140691 - DNA, 22 bp, Artificial Sequence
  chemically synthesized
cagctctaccaagtaaagagct

SEQ ID NO: 140692 - DNA, 22 bp, Artificial Sequence
  chemically synthesized
agctctaccaagtaaagagcta

SEQ ID NO: 140693 - DNA, 22 bp, Artificial Sequence
  chemically synthesized
taccaagtaaagagctagcaag

SEQ ID NO: 140694 - DNA, 22 bp, Artificial Sequence
  chemically synthesized
ccaagtaaagagctagcaagtc

SEQ ID NO: 140695 - DNA, 22 bp, Artificial Sequence
  chemically synthesized
gcaagtcatcaaaatggggaca

SEQ ID NO: 140696 - DNA, 22 bp, Artificial Sequence
  chemically synthesized
gaggaataatataccctgactc

SEQ ID NO: 140697 - DNA, 22 bp, Artificial Sequence
  chemically synthesized
actcctagcctgattaatatat

SEQ ID NO: 140698 - DNA, 22 bp, Artificial Sequence
  chemically synthesized
ctagcctgattaatatatcgat

SEQ ID NO: 140699 - DNA, 22 bp, Artificial Sequence
  chemically synthesized
gcctgattaatatatcgattca

SEQ ID NO: 140700 - DNA, 22 bp, Artificial Sequence
  chemically synthesized
attaatatatcgattcactttt

SEQ ID NO: 140701 - DNA, 22 bp, Artificial Sequence
  chemically synthesized
atatatcgattcacttttttct

SEQ ID NO: 140702 - DNA, 22 bp, Artificial Sequence
  chemically synthesized
acttttttctctgtttgatgac

SEQ ID NO: 140703 - DNA, 22 bp, Artificial Sequence
  chemically synthesized
ttttctctgtttgatgacaaat

SEQ ID NO: 140704 - DNA, 22 bp, Artificial Sequence
  chemically synthesized
tttctctgtttgatgacaaatt

SEQ ID NO: 140705 - DNA, 22 bp, Artificial Sequence
  chemically synthesized
ttctctgtttgatgacaaattc

SEQ ID NO: 140706 - DNA, 22 bp, Artificial Sequence
  chemically synthesized
tctctgtttgatgacaaattct

SEQ ID NO: 140707 - DNA, 22 bp, Artificial Sequence
  chemically synthesized
ctctgtttgatgacaaattctg

SEQ ID NO: 140708 - DNA, 22 bp, Artificial Sequence
  chemically synthesized
tctgtttgatgacaaattctgg

SEQ ID NO: 140709 - DNA, 22 bp, Artificial Sequence
  chemically synthesized
tgtttgatgacaaattctggct

SEQ ID NO: 140710 - DNA, 22 bp, Artificial Sequence
  chemically synthesized
tttgatgacaaattctggcttt

SEQ ID NO: 140711 - DNA, 22 bp, Artificial Sequence
  chemically synthesized
gatgacaaattctggctttaaa

SEQ ID NO: 140712 - DNA, 22 bp, Artificial Sequence
  chemically synthesized
atgacaaattctggctttaaat

SEQ ID NO: 140713 - DNA, 22 bp, Artificial Sequence
  chemically synthesized
tggctttaaataattttaggat

SEQ ID NO: 140714 - DNA, 22 bp, Artificial Sequence
  chemically synthesized
gctttaaataattttaggattt

SEQ ID NO: 140715 - DNA, 22 bp, Artificial Sequence
  chemically synthesized
taaataattttaggattttagg

SEQ ID NO: 140716 - DNA, 22 bp, Artificial Sequence
  chemically synthesized
aaataattttaggattttaggc

SEQ ID NO: 140717 - DNA, 22 bp, Artificial Sequence
  chemically synthesized
aataattttaggattttaggct

SEQ ID NO: 140718 - DNA, 22 bp, Artificial Sequence
  chemically synthesized
taggattttaggcttctcagct

SEQ ID NO: 140719 - DNA, 22 bp, Artificial Sequence
  chemically synthesized
aggattttaggcttctcagctc

SEQ ID NO: 140720 - DNA, 22 bp, Artificial Sequence
  chemically synthesized
ggattttaggcttctcagctcc

SEQ ID NO: 140721 - DNA, 22 bp, Artificial Sequence
  chemically synthesized
taggcttctcagctcccttccc

SEQ ID NO: 140722 - DNA, 22 bp, Artificial Sequence
  chemically synthesized
aggcttctcagctcccttccca

SEQ ID NO: 140723 - DNA, 22 bp, Artificial Sequence
  chemically synthesized
ggcttctcagctcccttcccag

SEQ ID NO: 140724 - DNA, 22 bp, Artificial Sequence
  chemically synthesized
ctcagctcccttcccagtgaga

SEQ ID NO: 140725 - DNA, 22 bp, Artificial Sequence
  chemically synthesized
tcagctcccttcccagtgagaa

SEQ ID NO: 140726 - DNA, 22 bp, Artificial Sequence
  chemically synthesized
agctcccttcccagtgagaagt

SEQ ID NO: 140727 - DNA, 22 bp, Artificial Sequence
  chemically synthesized
ccttcccagtgagaagtataag

SEQ ID NO: 140728 - DNA, 22 bp, Artificial Sequence
  chemically synthesized
cccagtgagaagtataagcagg

SEQ ID NO: 140729 - DNA, 22 bp, Artificial Sequence
  chemically synthesized
ccagtgagaagtataagcagga

SEQ ID NO: 140730 - DNA, 22 bp, Artificial Sequence
  chemically synthesized
acaaagtagccaatgtcccctg

SEQ ID NO: 140731 - DNA, 22 bp, Artificial Sequence
  chemically synthesized
tggtcatagagaaatgaaaaga

SEQ ID NO: 140732 - DNA, 22 bp, Artificial Sequence
  chemically synthesized
tctggaagcactggatgtaatc

SEQ ID NO: 140733 - DNA, 22 bp, Artificial Sequence
  chemically synthesized
tggaagcactggatgtaatctt

SEQ ID NO: 140734 - DNA, 22 bp, Artificial Sequence
  chemically synthesized
gaagcactggatgtaatctttt

SEQ ID NO: 140735 - DNA, 22 bp, Artificial Sequence
  chemically synthesized
gatgtaatcttttctgtctgtc

SEQ ID NO: 140736 - DNA, 22 bp, Artificial Sequence
  chemically synthesized
ttctgtctgtcctctctaggga

SEQ ID NO: 140737 - DNA, 22 bp, Artificial Sequence
  chemically synthesized
tctgtctgtcctctctagggaa

SEQ ID NO: 140738 - DNA, 22 bp, Artificial Sequence
  chemically synthesized
ctgtctgtcctctctagggaat

SEQ ID NO: 140739 - DNA, 22 bp, Artificial Sequence
  chemically synthesized
tgtctgtcctctctagggaatc

SEQ ID NO: 140740 - DNA, 22 bp, Artificial Sequence
  chemically synthesized
tctgtcctctctagggaatcac

SEQ ID NO: 140741 - DNA, 22 bp, Artificial Sequence
  chemically synthesized
tcctctctagggaatcacccca

SEQ ID NO: 140742 - DNA, 22 bp, Artificial Sequence
  chemically synthesized
tctagggaatcaccccaaggta

SEQ ID NO: 140743 - DNA, 22 bp, Artificial Sequence
  chemically synthesized
tagggaatcaccccaaggtact

SEQ ID NO: 140744 - DNA, 22 bp, Artificial Sequence
  chemically synthesized
gggaatcaccccaaggtactgt

SEQ ID NO: 140745 - DNA, 22 bp, Artificial Sequence
  chemically synthesized
tactttgggattaaggctttag

SEQ ID NO: 140746 - DNA, 22 bp, Artificial Sequence
  chemically synthesized
tgggattaaggctttagtccca

SEQ ID NO: 140747 - DNA, 22 bp, Artificial Sequence
  chemically synthesized
gggattaaggctttagtcccac

SEQ ID NO: 140748 - DNA, 22 bp, Artificial Sequence
  chemically synthesized
ggattaaggctttagtcccact

SEQ ID NO: 140749 - DNA, 22 bp, Artificial Sequence
  chemically synthesized
aggctttagtcccactgtggac

SEQ ID NO: 140750 - DNA, 22 bp, Artificial Sequence
  chemically synthesized
tagtcccactgtggactacttg

SEQ ID NO: 140751 - DNA, 22 bp, Artificial Sequence
  chemically synthesized
agtcccactgtggactacttgc

SEQ ID NO: 140752 - DNA, 22 bp, Artificial Sequence
  chemically synthesized
gtcccactgtggactacttgct

SEQ ID NO: 140753 - DNA, 22 bp, Artificial Sequence
  chemically synthesized
tggactacttgctattctgttc

SEQ ID NO: 140754 - DNA, 22 bp, Artificial Sequence
  chemically synthesized
cttgctattctgttcagtttct

SEQ ID NO: 140755 - DNA, 22 bp, Artificial Sequence
  chemically synthesized
gctattctgttcagtttctaga

SEQ ID NO: 140756 - DNA, 22 bp, Artificial Sequence
  chemically synthesized
ctattctgttcagtttctagaa

SEQ ID NO: 140757 - DNA, 22 bp, Artificial Sequence
  chemically synthesized
ttctgttcagtttctagaagga

SEQ ID NO: 140758 - DNA, 22 bp, Artificial Sequence
  chemically synthesized
tgttcagtttctagaaggaact

SEQ ID NO: 140759 - DNA, 22 bp, Artificial Sequence
  chemically synthesized
ttcagtttctagaaggaactat

SEQ ID NO: 140760 - DNA, 22 bp, Artificial Sequence
  chemically synthesized
agtttctagaaggaactatgta

SEQ ID NO: 140761 - DNA, 22 bp, Artificial Sequence
  chemically synthesized
ctagaaggaactatgtacggtt

SEQ ID NO: 140762 - DNA, 22 bp, Artificial Sequence
  chemically synthesized
tagaaggaactatgtacggttt

SEQ ID NO: 140763 - DNA, 22 bp, Artificial Sequence
  chemically synthesized
gaaggaactatgtacggttttt

SEQ ID NO: 140764 - DNA, 22 bp, Artificial Sequence
  chemically synthesized
tgtacggtttttgtctccctag

SEQ ID NO: 140765 - DNA, 22 bp, Artificial Sequence
  chemically synthesized
ttgtctccctagagaaactaag

SEQ ID NO: 140766 - DNA, 22 bp, Artificial Sequence
  chemically synthesized
tgtctccctagagaaactaagg

SEQ ID NO: 140767 - DNA, 22 bp, Artificial Sequence
  chemically synthesized
gtctccctagagaaactaaggt

SEQ ID NO: 140768 - DNA, 22 bp, Artificial Sequence
  chemically synthesized
tctccctagagaaactaaggta

SEQ ID NO: 140769 - DNA, 22 bp, Artificial Sequence
  chemically synthesized
cctagagaaactaaggtacaga

SEQ ID NO: 140770 - DNA, 22 bp, Artificial Sequence
  chemically synthesized
gagaaactaaggtacagaagtt

SEQ ID NO: 140771 - DNA, 22 bp, Artificial Sequence
  chemically synthesized
aggtacagaagttttgtttaca

SEQ ID NO: 140772 - DNA, 22 bp, Artificial Sequence
  chemically synthesized
tgtttacaatgcactccttaag

SEQ ID NO: 140773 - DNA, 22 bp, Artificial Sequence
  chemically synthesized
gtttacaatgcactccttaaga

SEQ ID NO: 140774 - DNA, 22 bp, Artificial Sequence
  chemically synthesized
tttacaatgcactccttaagag

SEQ ID NO: 140775 - DNA, 22 bp, Artificial Sequence
  chemically synthesized
acaatgcactccttaagagagc

SEQ ID NO: 140776 - DNA, 22 bp, Artificial Sequence
  chemically synthesized
caatgcactccttaagagagct

SEQ ID NO: 140777 - DNA, 22 bp, Artificial Sequence
  chemically synthesized
cttaagagagctagaactgggt

SEQ ID NO: 140778 - DNA, 22 bp, Artificial Sequence
  chemically synthesized
aagagagctagaactgggtgag

SEQ ID NO: 140779 - DNA, 22 bp, Artificial Sequence
  chemically synthesized
agagagctagaactgggtgaga

SEQ ID NO: 140780 - DNA, 22 bp, Artificial Sequence
  chemically synthesized
gaactgggtgagattctgtttt

SEQ ID NO: 140781 - DNA, 22 bp, Artificial Sequence
  chemically synthesized
ggtgagattctgttttaacagc

SEQ ID NO: 140782 - DNA, 22 bp, Artificial Sequence
  chemically synthesized
tgttttaacagctttattttct

SEQ ID NO: 140783 - DNA, 22 bp, Artificial Sequence
  chemically synthesized
ttttaacagctttattttcttt

SEQ ID NO: 140784 - DNA, 22 bp, Artificial Sequence
  chemically synthesized
taacagctttattttcttttcc

SEQ ID NO: 140785 - DNA, 22 bp, Artificial Sequence
  chemically synthesized
aacagctttattttcttttcct

SEQ ID NO: 140786 - DNA, 22 bp, Artificial Sequence
  chemically synthesized
acagctttattttcttttcctt

SEQ ID NO: 140787 - DNA, 22 bp, Artificial Sequence
  chemically synthesized
tattttcttttccttggccctg

SEQ ID NO: 140788 - DNA, 22 bp, Artificial Sequence
  chemically synthesized
attttcttttccttggccctgt

SEQ ID NO: 140789 - DNA, 22 bp, Artificial Sequence
  chemically synthesized
ttttcttttccttggccctgtt

SEQ ID NO: 140790 - DNA, 22 bp, Artificial Sequence
  chemically synthesized
tcttttccttggccctgttttt

SEQ ID NO: 140791 - DNA, 22 bp, Artificial Sequence
  chemically synthesized
cttttccttggccctgtttttg

SEQ ID NO: 140792 - DNA, 22 bp, Artificial Sequence
  chemically synthesized
ttttccttggccctgtttttgt

SEQ ID NO: 140793 - DNA, 22 bp, Artificial Sequence
  chemically synthesized
ttccttggccctgtttttgtca

SEQ ID NO: 140794 - DNA, 22 bp, Artificial Sequence
  chemically synthesized
tccttggccctgtttttgtcac

SEQ ID NO: 140795 - DNA, 22 bp, Artificial Sequence
  chemically synthesized
ccttggccctgtttttgtcact

SEQ ID NO: 140796 - DNA, 22 bp, Artificial Sequence
  chemically synthesized
cttggccctgtttttgtcactg

SEQ ID NO: 140797 - DNA, 22 bp, Artificial Sequence
  chemically synthesized
ggccctgtttttgtcactgtca

SEQ ID NO: 140798 - DNA, 22 bp, Artificial Sequence
  chemically synthesized
gccctgtttttgtcactgtcac

SEQ ID NO: 140799 - DNA, 22 bp, Artificial Sequence
  chemically synthesized
tttttgtcactgtcaccacctt

SEQ ID NO: 140800 - DNA, 22 bp, Artificial Sequence
  chemically synthesized
ttgtcactgtcaccacctttaa

SEQ ID NO: 140801 - DNA, 22 bp, Artificial Sequence
  chemically synthesized
tgtcactgtcaccacctttaag

SEQ ID NO: 140802 - DNA, 22 bp, Artificial Sequence
  chemically synthesized
gtcactgtcaccacctttaagg

SEQ ID NO: 140803 - DNA, 22 bp, Artificial Sequence
  chemically synthesized
tcactgtcaccacctttaaggc

SEQ ID NO: 140804 - DNA, 22 bp, Artificial Sequence
  chemically synthesized
tcaccacctttaaggcaaatgt

SEQ ID NO: 140805 - DNA, 22 bp, Artificial Sequence
  chemically synthesized
taaggcaaatgttaaatgcgct

SEQ ID NO: 140806 - DNA, 22 bp, Artificial Sequence
  chemically synthesized
aaggcaaatgttaaatgcgctt

SEQ ID NO: 140807 - DNA, 22 bp, Artificial Sequence
  chemically synthesized
aggcaaatgttaaatgcgcttt

SEQ ID NO: 140808 - DNA, 22 bp, Artificial Sequence
  chemically synthesized
aatgcgctttggctgaaacttt

SEQ ID NO: 140809 - DNA, 22 bp, Artificial Sequence
  chemically synthesized
tggctgaaactttttttcctat

SEQ ID NO: 140810 - DNA, 22 bp, Artificial Sequence
  chemically synthesized
ggctgaaactttttttcctatt

SEQ ID NO: 140811 - DNA, 22 bp, Artificial Sequence
  chemically synthesized
gctgaaactttttttcctattt

SEQ ID NO: 140812 - DNA, 22 bp, Artificial Sequence
  chemically synthesized
aaactttttttcctattttgag

SEQ ID NO: 140813 - DNA, 22 bp, Artificial Sequence
  chemically synthesized
tttttcctattttgagatttgc

SEQ ID NO: 140814 - DNA, 22 bp, Artificial Sequence
  chemically synthesized
ttttcctattttgagatttgct

SEQ ID NO: 140815 - DNA, 22 bp, Artificial Sequence
  chemically synthesized
tttcctattttgagatttgctc

SEQ ID NO: 140816 - DNA, 22 bp, Artificial Sequence
  chemically synthesized
ttcctattttgagatttgctcc

SEQ ID NO: 140817 - DNA, 22 bp, Artificial Sequence
  chemically synthesized
tcctattttgagatttgctcct

SEQ ID NO: 140818 - DNA, 22 bp, Artificial Sequence
  chemically synthesized
cctattttgagatttgctcctt

SEQ ID NO: 140819 - DNA, 22 bp, Artificial Sequence
  chemically synthesized
ctattttgagatttgctccttt

SEQ ID NO: 140820 - DNA, 22 bp, Artificial Sequence
  chemically synthesized
ttttgagatttgctcctttata

SEQ ID NO: 140821 - DNA, 22 bp, Artificial Sequence
  chemically synthesized
tgagatttgctcctttatatga

SEQ ID NO: 140822 - DNA, 22 bp, Artificial Sequence
  chemically synthesized
gagatttgctcctttatatgag

SEQ ID NO: 140823 - DNA, 22 bp, Artificial Sequence
  chemically synthesized
agatttgctcctttatatgagg

SEQ ID NO: 140824 - DNA, 22 bp, Artificial Sequence
  chemically synthesized
gctcctttatatgaggctttct

SEQ ID NO: 140825 - DNA, 22 bp, Artificial Sequence
  chemically synthesized
ctcctttatatgaggctttctt

SEQ ID NO: 140826 - DNA, 22 bp, Artificial Sequence
  chemically synthesized
ctttatatgaggctttcttgga

SEQ ID NO: 140827 - DNA, 22 bp, Artificial Sequence
  chemically synthesized
tatatgaggctttcttggaaaa

SEQ ID NO: 140828 - DNA, 22 bp, Artificial Sequence
  chemically synthesized
atatgaggctttcttggaaaag

SEQ ID NO: 140829 - DNA, 22 bp, Artificial Sequence
  chemically synthesized
tatgaggctttcttggaaaagg

SEQ ID NO: 140830 - DNA, 22 bp, Artificial Sequence
  chemically synthesized
tcttggaaaaggagaatgggag

SEQ ID NO: 140831 - DNA, 22 bp, Artificial Sequence
  chemically synthesized
cttggaaaaggagaatgggaga

SEQ ID NO: 140832 - DNA, 22 bp, Artificial Sequence
  chemically synthesized
ttggaaaaggagaatgggagag

SEQ ID NO: 140833 - DNA, 22 bp, Artificial Sequence
  chemically synthesized
ggaaaaggagaatgggagagat

SEQ ID NO: 140834 - DNA, 22 bp, Artificial Sequence
  chemically synthesized
gaaaaggagaatgggagagatg

SEQ ID NO: 140835 - DNA, 22 bp, Artificial Sequence
  chemically synthesized
tggaagatgatgaagagggtaa

SEQ ID NO: 140836 - DNA, 22 bp, Artificial Sequence
  chemically synthesized
ggaagatgatgaagagggtaaa

SEQ ID NO: 140837 - DNA, 22 bp, Artificial Sequence
  chemically synthesized
gaagatgatgaagagggtaaaa

SEQ ID NO: 140838 - DNA, 22 bp, Artificial Sequence
  chemically synthesized
gtgttgcagatagatgaggagc

SEQ ID NO: 140839 - DNA, 22 bp, Artificial Sequence
  chemically synthesized
tgttgcagatagatgaggagcc

SEQ ID NO: 140840 - DNA, 22 bp, Artificial Sequence
  chemically synthesized
cagatagatgaggagccaacaa

SEQ ID NO: 140841 - DNA, 22 bp, Artificial Sequence
  chemically synthesized
aggatccagcacacattatcac

SEQ ID NO: 140842 - DNA, 22 bp, Artificial Sequence
  chemically synthesized
tcacaaacttagtgtccatcca

SEQ ID NO: 140843 - DNA, 22 bp, Artificial Sequence
  chemically synthesized
agtgtccatccatcactgctga

SEQ ID NO: 140844 - DNA, 22 bp, Artificial Sequence
  chemically synthesized
gtgtccatccatcactgctgac

SEQ ID NO: 140845 - DNA, 22 bp, Artificial Sequence
  chemically synthesized
ctgaccctctccggacctgact

SEQ ID NO: 140846 - DNA, 22 bp, Artificial Sequence
  chemically synthesized
accctctccggacctgactcca

SEQ ID NO: 140847 - DNA, 22 bp, Artificial Sequence
  chemically synthesized
tccggacctgactccacccctg

SEQ ID NO: 140848 - DNA, 22 bp, Artificial Sequence
  chemically synthesized
cggacctgactccacccctgag

SEQ ID NO: 140849 - DNA, 22 bp, Artificial Sequence
  chemically synthesized
actccacccctgagggacacag

SEQ ID NO: 140850 - DNA, 22 bp, Artificial Sequence
  chemically synthesized
cacccctgagggacacaggtca

SEQ ID NO: 140851 - DNA, 22 bp, Artificial Sequence
  chemically synthesized
agggacacaggtcagccttgac

SEQ ID NO: 140852 - DNA, 22 bp, Artificial Sequence
  chemically synthesized
gaccaatgacttttaagtacca

SEQ ID NO: 140853 - DNA, 22 bp, Artificial Sequence
  chemically synthesized
accaatgacttttaagtaccat

SEQ ID NO: 140854 - DNA, 22 bp, Artificial Sequence
  chemically synthesized
ttaagtaccatggagaacaggg

SEQ ID NO: 140855 - DNA, 22 bp, Artificial Sequence
  chemically synthesized
taagtaccatggagaacagggg

SEQ ID NO: 140856 - DNA, 22 bp, Artificial Sequence
  chemically synthesized
aagtaccatggagaacaggggg

SEQ ID NO: 140857 - DNA, 22 bp, Artificial Sequence
  chemically synthesized
agtaccatggagaacagggggc

SEQ ID NO: 140858 - DNA, 22 bp, Artificial Sequence
  chemically synthesized
cggcagtaaagaataaaaggcc

SEQ ID NO: 140859 - DNA, 22 bp, Artificial Sequence
  chemically synthesized
ggcagtaaagaataaaaggcca

SEQ ID NO: 140860 - DNA, 22 bp, Artificial Sequence
  chemically synthesized
cttccgacacagctgcaatcac

SEQ ID NO: 140861 - DNA, 22 bp, Artificial Sequence
  chemically synthesized
ccgacacagctgcaatcactag

SEQ ID NO: 140862 - DNA, 22 bp, Artificial Sequence
  chemically synthesized
cgacacagctgcaatcactagc

SEQ ID NO: 140863 - DNA, 22 bp, Artificial Sequence
  chemically synthesized
caatcactagcaagctctcagg

SEQ ID NO: 140864 - DNA, 22 bp, Artificial Sequence
  chemically synthesized
gcaagctctcaggcctggcatc

SEQ ID NO: 140865 - DNA, 22 bp, Artificial Sequence
  chemically synthesized
tcaggcctggcatcatggtgca

SEQ ID NO: 140866 - DNA, 22 bp, Artificial Sequence
  chemically synthesized
aggcctggcatcatggtgcatt

SEQ ID NO: 140867 - DNA, 22 bp, Artificial Sequence
  chemically synthesized
gcatcatggtgcattttactgc

SEQ ID NO: 140868 - DNA, 22 bp, Artificial Sequence
  chemically synthesized
tactgctgaggagaaggctgcc

SEQ ID NO: 140869 - DNA, 22 bp, Artificial Sequence
  chemically synthesized
actgctgaggagaaggctgccg

SEQ ID NO: 140870 - DNA, 22 bp, Artificial Sequence
  chemically synthesized
ctgctgaggagaaggctgccgt

SEQ ID NO: 140871 - DNA, 22 bp, Artificial Sequence
  chemically synthesized
ctgaggagaaggctgccgtcac

SEQ ID NO: 140872 - DNA, 22 bp, Artificial Sequence
  chemically synthesized
aggagaaggctgccgtcactag

SEQ ID NO: 140873 - DNA, 22 bp, Artificial Sequence
  chemically synthesized
ccgtcactagcctgtggagcaa

SEQ ID NO: 140874 - DNA, 22 bp, Artificial Sequence
  chemically synthesized
gcctgtggagcaagatgaatgt

SEQ ID NO: 140875 - DNA, 22 bp, Artificial Sequence
  chemically synthesized
tggagcaagatgaatgtggaag

SEQ ID NO: 140876 - DNA, 22 bp, Artificial Sequence
  chemically synthesized
gaggtgaagccttgggcaggta

SEQ ID NO: 140877 - DNA, 22 bp, Artificial Sequence
  chemically synthesized
gggcaggtaagcattggttctc

SEQ ID NO: 140878 - DNA, 22 bp, Artificial Sequence
  chemically synthesized
ggcaggtaagcattggttctca

SEQ ID NO: 140879 - DNA, 22 bp, Artificial Sequence
  chemically synthesized
gttctcaatgcatgggaatgaa

SEQ ID NO: 140880 - DNA, 22 bp, Artificial Sequence
  chemically synthesized
tcaatgcatgggaatgaagggt

SEQ ID NO: 140881 - DNA, 22 bp, Artificial Sequence
  chemically synthesized
aatgcatgggaatgaagggtga

SEQ ID NO: 140882 - DNA, 22 bp, Artificial Sequence
  chemically synthesized
ccctagcaagttgattgggaaa

SEQ ID NO: 140883 - DNA, 22 bp, Artificial Sequence
  chemically synthesized
gcaagttgattgggaaagtcct

SEQ ID NO: 140884 - DNA, 22 bp, Artificial Sequence
  chemically synthesized
attgggaaagtcctcaagattt

SEQ ID NO: 140885 - DNA, 22 bp, Artificial Sequence
  chemically synthesized
ggaaagtcctcaagattttttg

SEQ ID NO: 140886 - DNA, 22 bp, Artificial Sequence
  chemically synthesized
aagattttttgcatctctaatt

SEQ ID NO: 140887 - DNA, 22 bp, Artificial Sequence
  chemically synthesized
tttgcatctctaattttgtatc

SEQ ID NO: 140888 - DNA, 22 bp, Artificial Sequence
  chemically synthesized
ttgcatctctaattttgtatct

SEQ ID NO: 140889 - DNA, 22 bp, Artificial Sequence
  chemically synthesized
tgcatctctaattttgtatctg

SEQ ID NO: 140890 - DNA, 22 bp, Artificial Sequence
  chemically synthesized
gcatctctaattttgtatctga

SEQ ID NO: 140891 - DNA, 22 bp, Artificial Sequence
  chemically synthesized
catctctaattttgtatctgat

SEQ ID NO: 140892 - DNA, 22 bp, Artificial Sequence
  chemically synthesized
taattttgtatctgatatggtg

SEQ ID NO: 140893 - DNA, 22 bp, Artificial Sequence
  chemically synthesized
attttgtatctgatatggtgtc

SEQ ID NO: 140894 - DNA, 22 bp, Artificial Sequence
  chemically synthesized
tgtatctgatatggtgtcattt

SEQ ID NO: 140895 - DNA, 22 bp, Artificial Sequence
  chemically synthesized
gtatctgatatggtgtcatttc

SEQ ID NO: 140896 - DNA, 22 bp, Artificial Sequence
  chemically synthesized
tatctgatatggtgtcatttca

SEQ ID NO: 140897 - DNA, 22 bp, Artificial Sequence
  chemically synthesized
atatggtgtcatttcatagact

SEQ ID NO: 140898 - DNA, 22 bp, Artificial Sequence
  chemically synthesized
catagactcctcgttgtttacc

SEQ ID NO: 140899 - DNA, 22 bp, Artificial Sequence
  chemically synthesized
atagactcctcgttgtttaccc

SEQ ID NO: 140900 - DNA, 22 bp, Artificial Sequence
  chemically synthesized
ctcgttgtttacccctggaccc

SEQ ID NO: 140901 - DNA, 22 bp, Artificial Sequence
  chemically synthesized
gttgtttacccctggacccaga

SEQ ID NO: 140902 - DNA, 22 bp, Artificial Sequence
  chemically synthesized
tttacccctggacccagagatt

SEQ ID NO: 140903 - DNA, 22 bp, Artificial Sequence
  chemically synthesized
acccctggacccagagattttt

SEQ ID NO: 140904 - DNA, 22 bp, Artificial Sequence
  chemically synthesized
cccctggacccagagatttttt

SEQ ID NO: 140905 - DNA, 22 bp, Artificial Sequence
  chemically synthesized
gacccagagattttttgacagc

SEQ ID NO: 140906 - DNA, 22 bp, Artificial Sequence
  chemically synthesized
tttgacagctttggaaacctgt

SEQ ID NO: 140907 - DNA, 22 bp, Artificial Sequence
  chemically synthesized
ttgacagctttggaaacctgtc

SEQ ID NO: 140908 - DNA, 22 bp, Artificial Sequence
  chemically synthesized
tgacagctttggaaacctgtcg

SEQ ID NO: 140909 - DNA, 22 bp, Artificial Sequence
  chemically synthesized
gacagctttggaaacctgtcgt

SEQ ID NO: 140910 - DNA, 22 bp, Artificial Sequence
  chemically synthesized
acagctttggaaacctgtcgtc

SEQ ID NO: 140911 - DNA, 22 bp, Artificial Sequence
  chemically synthesized
tggaaacctgtcgtctccctct

SEQ ID NO: 140912 - DNA, 22 bp, Artificial Sequence
  chemically synthesized
ggaaacctgtcgtctccctctg

SEQ ID NO: 140913 - DNA, 22 bp, Artificial Sequence
  chemically synthesized
gaaacctgtcgtctccctctgc

SEQ ID NO: 140914 - DNA, 22 bp, Artificial Sequence
  chemically synthesized
tcgtctccctctgccatcctgg

SEQ ID NO: 140915 - DNA, 22 bp, Artificial Sequence
  chemically synthesized
cctctgccatcctgggcaaccc

SEQ ID NO: 140916 - DNA, 22 bp, Artificial Sequence
  chemically synthesized
tgccatcctgggcaaccccaag

SEQ ID NO: 140917 - DNA, 22 bp, Artificial Sequence
  chemically synthesized
ccatcctgggcaaccccaaggt

SEQ ID NO: 140918 - DNA, 22 bp, Artificial Sequence
  chemically synthesized
ggcaaccccaaggtcaaggccc

SEQ ID NO: 140919 - DNA, 22 bp, Artificial Sequence
  chemically synthesized
acttcctttggagatgctatta

SEQ ID NO: 140920 - DNA, 22 bp, Artificial Sequence
  chemically synthesized
cctttggagatgctattaaaaa

SEQ ID NO: 140921 - DNA, 22 bp, Artificial Sequence
  chemically synthesized
ctttggagatgctattaaaaac

SEQ ID NO: 140922 - DNA, 22 bp, Artificial Sequence
  chemically synthesized
tggagatgctattaaaaacatg

SEQ ID NO: 140923 - DNA, 22 bp, Artificial Sequence
  chemically synthesized
ggagatgctattaaaaacatgg

SEQ ID NO: 140924 - DNA, 22 bp, Artificial Sequence
  chemically synthesized
gagatgctattaaaaacatgga

SEQ ID NO: 140925 - DNA, 22 bp, Artificial Sequence
  chemically synthesized
ttaaaaacatggacaacctcaa

SEQ ID NO: 140926 - DNA, 22 bp, Artificial Sequence
  chemically synthesized
aaaacatggacaacctcaagcc

SEQ ID NO: 140927 - DNA, 22 bp, Artificial Sequence
  chemically synthesized
aagcccgcctttgctaagctga

SEQ ID NO: 140928 - DNA, 22 bp, Artificial Sequence
  chemically synthesized
tgctaagctgagtgagctgcac

SEQ ID NO: 140929 - DNA, 22 bp, Artificial Sequence
  chemically synthesized
gctaagctgagtgagctgcact

SEQ ID NO: 140930 - DNA, 22 bp, Artificial Sequence
  chemically synthesized
ctaagctgagtgagctgcactg

SEQ ID NO: 140931 - DNA, 22 bp, Artificial Sequence
  chemically synthesized
agctgagtgagctgcactgtga

SEQ ID NO: 140932 - DNA, 22 bp, Artificial Sequence
  chemically synthesized
agtgagctgcactgtgacaagc

SEQ ID NO: 140933 - DNA, 22 bp, Artificial Sequence
  chemically synthesized
cactgtgacaagctgcatgtgg

SEQ ID NO: 140934 - DNA, 22 bp, Artificial Sequence
  chemically synthesized
tgacaagctgcatgtggatcct

SEQ ID NO: 140935 - DNA, 22 bp, Artificial Sequence
  chemically synthesized
catgtggatcctgagaacttca

SEQ ID NO: 140936 - DNA, 22 bp, Artificial Sequence
  chemically synthesized
agaacttcaaggtgagttcagg

SEQ ID NO: 140937 - DNA, 22 bp, Artificial Sequence
  chemically synthesized
caaggtgagttcaggtgctggt

SEQ ID NO: 140938 - DNA, 22 bp, Artificial Sequence
  chemically synthesized
aaggtgagttcaggtgctggtg

SEQ ID NO: 140939 - DNA, 22 bp, Artificial Sequence
  chemically synthesized
aggtgctggtgatgtgattttt

SEQ ID NO: 140940 - DNA, 22 bp, Artificial Sequence
  chemically synthesized
gtgatgtgattttttggcttta

SEQ ID NO: 140941 - DNA, 22 bp, Artificial Sequence
  chemically synthesized
tttggctttatattttgacatt

SEQ ID NO: 140942 - DNA, 22 bp, Artificial Sequence
  chemically synthesized
ttggctttatattttgacatta

SEQ ID NO: 140943 - DNA, 22 bp, Artificial Sequence
  chemically synthesized
tggctttatattttgacattaa

SEQ ID NO: 140944 - DNA, 22 bp, Artificial Sequence
  chemically synthesized
ggctttatattttgacattaat

SEQ ID NO: 140945 - DNA, 22 bp, Artificial Sequence
  chemically synthesized
gctttatattttgacattaatt

SEQ ID NO: 140946 - DNA, 22 bp, Artificial Sequence
  chemically synthesized
tatattttgacattaattgaag

SEQ ID NO: 140947 - DNA, 22 bp, Artificial Sequence
  chemically synthesized
atattttgacattaattgaagc

SEQ ID NO: 140948 - DNA, 22 bp, Artificial Sequence
  chemically synthesized
tattttgacattaattgaagct

SEQ ID NO: 140949 - DNA, 22 bp, Artificial Sequence
  chemically synthesized
tgacattaattgaagctcataa

SEQ ID NO: 140950 - DNA, 22 bp, Artificial Sequence
  chemically synthesized
gacattaattgaagctcataat

SEQ ID NO: 140951 - DNA, 22 bp, Artificial Sequence
  chemically synthesized
acattaattgaagctcataatc

SEQ ID NO: 140952 - DNA, 22 bp, Artificial Sequence
  chemically synthesized
attgaagctcataatcttattg

SEQ ID NO: 140953 - DNA, 22 bp, Artificial Sequence
  chemically synthesized
aagctcataatcttattggaaa

SEQ ID NO: 140954 - DNA, 22 bp, Artificial Sequence
  chemically synthesized
ataatcttattggaaagaccaa

SEQ ID NO: 140955 - DNA, 22 bp, Artificial Sequence
  chemically synthesized
attggaaagaccaacaaagatc

SEQ ID NO: 140956 - DNA, 22 bp, Artificial Sequence
  chemically synthesized
ttggaaagaccaacaaagatct

SEQ ID NO: 140957 - DNA, 22 bp, Artificial Sequence
  chemically synthesized
gaaagaccaacaaagatctcag

SEQ ID NO: 140958 - DNA, 22 bp, Artificial Sequence
  chemically synthesized
agaaatcatgggtcgagcttga

SEQ ID NO: 140959 - DNA, 22 bp, Artificial Sequence
  chemically synthesized
gatgttagaacagcagacttct

SEQ ID NO: 140960 - DNA, 22 bp, Artificial Sequence
  chemically synthesized
atgttagaacagcagacttcta

SEQ ID NO: 140961 - DNA, 22 bp, Artificial Sequence
  chemically synthesized
gaacagcagacttctagtgagc

SEQ ID NO: 140962 - DNA, 22 bp, Artificial Sequence
  chemically synthesized
ctagtgagcataaccaaaactt

SEQ ID NO: 140963 - DNA, 22 bp, Artificial Sequence
  chemically synthesized
tagtgagcataaccaaaactta

SEQ ID NO: 140964 - DNA, 22 bp, Artificial Sequence
  chemically synthesized
gtgagcataaccaaaacttaca

SEQ ID NO: 140965 - DNA, 22 bp, Artificial Sequence
  chemically synthesized
acatgattcagaactagtgaca

SEQ ID NO: 140966 - DNA, 22 bp, Artificial Sequence
  chemically synthesized
catgattcagaactagtgacag

SEQ ID NO: 140967 - DNA, 22 bp, Artificial Sequence
  chemically synthesized
agaactagtgacagtaaaggac

SEQ ID NO: 140968 - DNA, 22 bp, Artificial Sequence
  chemically synthesized
gtgacagtaaaggactactaac

SEQ ID NO: 140969 - DNA, 22 bp, Artificial Sequence
  chemically synthesized
ctaacagcctgaattggcttaa

SEQ ID NO: 140970 - DNA, 22 bp, Artificial Sequence
  chemically synthesized
acagcctgaattggcttaactt

SEQ ID NO: 140971 - DNA, 22 bp, Artificial Sequence
  chemically synthesized
aattggcttaacttttcaggaa

SEQ ID NO: 140972 - DNA, 22 bp, Artificial Sequence
  chemically synthesized
gcttaacttttcaggaaatctt

SEQ ID NO: 140973 - DNA, 22 bp, Artificial Sequence
  chemically synthesized
aacttttcaggaaatcttgcca

SEQ ID NO: 140974 - DNA, 22 bp, Artificial Sequence
  chemically synthesized
acttttcaggaaatcttgccag

SEQ ID NO: 140975 - DNA, 22 bp, Artificial Sequence
  chemically synthesized
ttcaggaaatcttgccagaact

SEQ ID NO: 140976 - DNA, 22 bp, Artificial Sequence
  chemically synthesized
tcaggaaatcttgccagaactt

SEQ ID NO: 140977 - DNA, 22 bp, Artificial Sequence
  chemically synthesized
caggaaatcttgccagaacttg

SEQ ID NO: 140978 - DNA, 22 bp, Artificial Sequence
  chemically synthesized
aggaaatcttgccagaacttga

SEQ ID NO: 140979 - DNA, 22 bp, Artificial Sequence
  chemically synthesized
gccagaacttgatgtgtttatc

SEQ ID NO: 140980 - DNA, 22 bp, Artificial Sequence
  chemically synthesized
ccagaacttgatgtgtttatcc

SEQ ID NO: 140981 - DNA, 22 bp, Artificial Sequence
  chemically synthesized
gatgtgtttatcccagagaatt

SEQ ID NO: 140982 - DNA, 22 bp, Artificial Sequence
  chemically synthesized
atgtgtttatcccagagaattg

SEQ ID NO: 140983 - DNA, 22 bp, Artificial Sequence
  chemically synthesized
atcccagagaattgtattatag

SEQ ID NO: 140984 - DNA, 22 bp, Artificial Sequence
  chemically synthesized
tcccagagaattgtattataga

SEQ ID NO: 140985 - DNA, 22 bp, Artificial Sequence
  chemically synthesized
tattatagaattgtagacttgt

SEQ ID NO: 140986 - DNA, 22 bp, Artificial Sequence
  chemically synthesized
tagaattgtagacttgtgaaag

SEQ ID NO: 140987 - DNA, 22 bp, Artificial Sequence
  chemically synthesized
tagacttgtgaaagaagaatga

SEQ ID NO: 140988 - DNA, 22 bp, Artificial Sequence
  chemically synthesized
gtgaaagaagaatgaaatttgg

SEQ ID NO: 140989 - DNA, 22 bp, Artificial Sequence
  chemically synthesized
tgaaagaagaatgaaatttggc

SEQ ID NO: 140990 - DNA, 22 bp, Artificial Sequence
  chemically synthesized
ggcttttggtagatgaaagtcc

SEQ ID NO: 140991 - DNA, 22 bp, Artificial Sequence
  chemically synthesized
gcttttggtagatgaaagtcca

SEQ ID NO: 140992 - DNA, 22 bp, Artificial Sequence
  chemically synthesized
ttggtagatgaaagtccatttc

SEQ ID NO: 140993 - DNA, 22 bp, Artificial Sequence
  chemically synthesized
tggtagatgaaagtccatttca

SEQ ID NO: 140994 - DNA, 22 bp, Artificial Sequence
  chemically synthesized
ggtagatgaaagtccatttcaa

SEQ ID NO: 140995 - DNA, 22 bp, Artificial Sequence
  chemically synthesized
gtagatgaaagtccatttcaag

SEQ ID NO: 140996 - DNA, 22 bp, Artificial Sequence
  chemically synthesized
caaggaaatagaaatgccttat

SEQ ID NO: 140997 - DNA, 22 bp, Artificial Sequence
  chemically synthesized
aaggaaatagaaatgccttatt

SEQ ID NO: 140998 - DNA, 22 bp, Artificial Sequence
  chemically synthesized
attttatgtgggtcatgataat

SEQ ID NO: 140999 - DNA, 22 bp, Artificial Sequence
  chemically synthesized
ttttatgtgggtcatgataatt

SEQ ID NO: 141000 - DNA, 22 bp, Artificial Sequence
  chemically synthesized
tatgtgggtcatgataattgag

SEQ ID NO: 141001 - DNA, 22 bp, Artificial Sequence
  chemically synthesized
atgtgggtcatgataattgagg

SEQ ID NO: 141002 - DNA, 22 bp, Artificial Sequence
  chemically synthesized
tgtgggtcatgataattgaggt

SEQ ID NO: 141003 - DNA, 22 bp, Artificial Sequence
  chemically synthesized
aggtttagaaagagatttttgc

SEQ ID NO: 141004 - DNA, 22 bp, Artificial Sequence
  chemically synthesized
agaaagagatttttgcaaaaaa

SEQ ID NO: 141005 - DNA, 22 bp, Artificial Sequence
  chemically synthesized
gaaagagatttttgcaaaaaaa

SEQ ID NO: 141006 - DNA, 22 bp, Artificial Sequence
  chemically synthesized
ttgcaaaaaaaataaaagattt

SEQ ID NO: 141007 - DNA, 22 bp, Artificial Sequence
  chemically synthesized
tgcaaaaaaaataaaagatttg

SEQ ID NO: 141008 - DNA, 22 bp, Artificial Sequence
  chemically synthesized
gcaaaaaaaataaaagatttgc

SEQ ID NO: 141009 - DNA, 22 bp, Artificial Sequence
  chemically synthesized
caaaaaaaataaaagatttgct

SEQ ID NO: 141010 - DNA, 22 bp, Artificial Sequence
  chemically synthesized
gctcaaagaaaaataagacaca

SEQ ID NO: 141011 - DNA, 22 bp, Artificial Sequence
  chemically synthesized
ctcaaagaaaaataagacacat

SEQ ID NO: 141012 - DNA, 22 bp, Artificial Sequence
  chemically synthesized
aaagaaaaataagacacatttt

SEQ ID NO: 141013 - DNA, 22 bp, Artificial Sequence
  chemically synthesized
tctaaaatatgttaaatttccc

SEQ ID NO: 141014 - DNA, 22 bp, Artificial Sequence
  chemically synthesized
ctaaaatatgttaaatttccca

SEQ ID NO: 141015 - DNA, 22 bp, Artificial Sequence
  chemically synthesized
taaaatatgttaaatttcccat

SEQ ID NO: 141016 - DNA, 22 bp, Artificial Sequence
  chemically synthesized
aaatatgttaaatttcccatca

SEQ ID NO: 141017 - DNA, 22 bp, Artificial Sequence
  chemically synthesized
aatttcccatcagtattgtgac

SEQ ID NO: 141018 - DNA, 22 bp, Artificial Sequence
  chemically synthesized
cccatcagtattgtgaccaagt

SEQ ID NO: 141019 - DNA, 22 bp, Artificial Sequence
  chemically synthesized
ccatcagtattgtgaccaagtg

SEQ ID NO: 141020 - DNA, 22 bp, Artificial Sequence
  chemically synthesized
tgaccaagtgaaggcttgtttc

SEQ ID NO: 141021 - DNA, 22 bp, Artificial Sequence
  chemically synthesized
gtttccgaatttgttggggatt

SEQ ID NO: 141022 - DNA, 22 bp, Artificial Sequence
  chemically synthesized
tttccgaatttgttggggattt

SEQ ID NO: 141023 - DNA, 22 bp, Artificial Sequence
  chemically synthesized
ccgaatttgttggggattttaa

SEQ ID NO: 141024 - DNA, 22 bp, Artificial Sequence
  chemically synthesized
cgaatttgttggggattttaaa

SEQ ID NO: 141025 - DNA, 22 bp, Artificial Sequence
  chemically synthesized
gttggggattttaaactcccgc

SEQ ID NO: 141026 - DNA, 22 bp, Artificial Sequence
  chemically synthesized
ttggggattttaaactcccgct

SEQ ID NO: 141027 - DNA, 22 bp, Artificial Sequence
  chemically synthesized
gggattttaaactcccgctgag

SEQ ID NO: 141028 - DNA, 22 bp, Artificial Sequence
  chemically synthesized
taaactcccgctgagaactctt

SEQ ID NO: 141029 - DNA, 22 bp, Artificial Sequence
  chemically synthesized
aaactcccgctgagaactcttg

SEQ ID NO: 141030 - DNA, 22 bp, Artificial Sequence
  chemically synthesized
aactcccgctgagaactcttgc

SEQ ID NO: 141031 - DNA, 22 bp, Artificial Sequence
  chemically synthesized
ccgctgagaactcttgcagcac

SEQ ID NO: 141032 - DNA, 22 bp, Artificial Sequence
  chemically synthesized
agaactcttgcagcactcacat

SEQ ID NO: 141033 - DNA, 22 bp, Artificial Sequence
  chemically synthesized
ttgcagcactcacattctacat

SEQ ID NO: 141034 - DNA, 22 bp, Artificial Sequence
  chemically synthesized
gcagcactcacattctacattt

SEQ ID NO: 141035 - DNA, 22 bp, Artificial Sequence
  chemically synthesized
cagcactcacattctacattta

SEQ ID NO: 141036 - DNA, 22 bp, Artificial Sequence
  chemically synthesized
acattctacatttacaaaaatt

SEQ ID NO: 141037 - DNA, 22 bp, Artificial Sequence
  chemically synthesized
tacatttacaaaaattagacaa

SEQ ID NO: 141038 - DNA, 22 bp, Artificial Sequence
  chemically synthesized
catttacaaaaattagacaatt

SEQ ID NO: 141039 - DNA, 22 bp, Artificial Sequence
  chemically synthesized
acaaaaattagacaattgctta

SEQ ID NO: 141040 - DNA, 22 bp, Artificial Sequence
  chemically synthesized
caaaaattagacaattgcttaa

SEQ ID NO: 141041 - DNA, 22 bp, Artificial Sequence
  chemically synthesized
gacaattgcttaaagaaaaaca

SEQ ID NO: 141042 - DNA, 22 bp, Artificial Sequence
  chemically synthesized
cttaaagaaaaacagggagaga

SEQ ID NO: 141043 - DNA, 22 bp, Artificial Sequence
  chemically synthesized
aaagaaaaacagggagagaggg

SEQ ID NO: 141044 - DNA, 22 bp, Artificial Sequence
  chemically synthesized
aagaaaaacagggagagaggga

SEQ ID NO: 141045 - DNA, 22 bp, Artificial Sequence
  chemically synthesized
gtaaaatggggaagggggtgag

SEQ ID NO: 141046 - DNA, 22 bp, Artificial Sequence
  chemically synthesized
aatgtagggctcatagaataaa

SEQ ID NO: 141047 - DNA, 22 bp, Artificial Sequence
  chemically synthesized
atagaataaaattgaacctaag

SEQ ID NO: 141048 - DNA, 22 bp, Artificial Sequence
  chemically synthesized
aacctaagctcatctgaatttt

SEQ ID NO: 141049 - DNA, 22 bp, Artificial Sequence
  chemically synthesized
agctcatctgaattttttgggt

SEQ ID NO: 141050 - DNA, 22 bp, Artificial Sequence
  chemically synthesized
atctgaattttttgggtgggca

SEQ ID NO: 141051 - DNA, 22 bp, Artificial Sequence
  chemically synthesized
aattttttgggtgggcacaaac

SEQ ID NO: 141052 - DNA, 22 bp, Artificial Sequence
  chemically synthesized
tttgggtgggcacaaaccttgg

SEQ ID NO: 141053 - DNA, 22 bp, Artificial Sequence
  chemically synthesized
ttgggtgggcacaaaccttgga

SEQ ID NO: 141054 - DNA, 22 bp, Artificial Sequence
  chemically synthesized
tgggtgggcacaaaccttggaa

SEQ ID NO: 141055 - DNA, 22 bp, Artificial Sequence
  chemically synthesized
gggtgggcacaaaccttggaac

SEQ ID NO: 141056 - DNA, 22 bp, Artificial Sequence
  chemically synthesized
ggtgggcacaaaccttggaaca

SEQ ID NO: 141057 - DNA, 22 bp, Artificial Sequence
  chemically synthesized
ggaacagtttgaggtcagggtt

SEQ ID NO: 141058 - DNA, 22 bp, Artificial Sequence
  chemically synthesized
gaacagtttgaggtcagggttg

SEQ ID NO: 141059 - DNA, 22 bp, Artificial Sequence
  chemically synthesized
gaggtcagggttgtctaggaat

SEQ ID NO: 141060 - DNA, 22 bp, Artificial Sequence
  chemically synthesized
aggtcagggttgtctaggaatg

SEQ ID NO: 141061 - DNA, 22 bp, Artificial Sequence
  chemically synthesized
tctaggaatgtaggtataaagc

SEQ ID NO: 141062 - DNA, 22 bp, Artificial Sequence
  chemically synthesized
ggaatgtaggtataaagccgtt

SEQ ID NO: 141063 - DNA, 22 bp, Artificial Sequence
  chemically synthesized
ttgtttgtttgtttgttttttc

SEQ ID NO: 141064 - DNA, 22 bp, Artificial Sequence
  chemically synthesized
tgtttgtttgtttgttttttca

SEQ ID NO: 141065 - DNA, 22 bp, Artificial Sequence
  chemically synthesized
gtttgtttgtttgttttttcat

SEQ ID NO: 141066 - DNA, 22 bp, Artificial Sequence
  chemically synthesized
tttgtttgtttgttttttcatc

SEQ ID NO: 141067 - DNA, 22 bp, Artificial Sequence
  chemically synthesized
gtttgtttgttttttcatcaag

SEQ ID NO: 141068 - DNA, 22 bp, Artificial Sequence
  chemically synthesized
tttgtttgttttttcatcaagt

SEQ ID NO: 141069 - DNA, 22 bp, Artificial Sequence
  chemically synthesized
gtttgttttttcatcaagttgt

SEQ ID NO: 141070 - DNA, 22 bp, Artificial Sequence
  chemically synthesized
tttgttttttcatcaagttgtt

SEQ ID NO: 141071 - DNA, 22 bp, Artificial Sequence
  chemically synthesized
gttttttcatcaagttgttttc

SEQ ID NO: 141072 - DNA, 22 bp, Artificial Sequence
  chemically synthesized
ttttttcatcaagttgttttcg

SEQ ID NO: 141073 - DNA, 22 bp, Artificial Sequence
  chemically synthesized
tttcatcaagttgttttcggaa

SEQ ID NO: 141074 - DNA, 22 bp, Artificial Sequence
  chemically synthesized
ttcatcaagttgttttcggaaa

SEQ ID NO: 141075 - DNA, 22 bp, Artificial Sequence
  chemically synthesized
tcatcaagttgttttcggaaac

SEQ ID NO: 141076 - DNA, 22 bp, Artificial Sequence
  chemically synthesized
catcaagttgttttcggaaact

SEQ ID NO: 141077 - DNA, 22 bp, Artificial Sequence
  chemically synthesized
atcaagttgttttcggaaactt

SEQ ID NO: 141078 - DNA, 22 bp, Artificial Sequence
  chemically synthesized
ttttcggaaacttctactcaac

SEQ ID NO: 141079 - DNA, 22 bp, Artificial Sequence
  chemically synthesized
tcggaaacttctactcaacatg

SEQ ID NO: 141080 - DNA, 22 bp, Artificial Sequence
  chemically synthesized
cggaaacttctactcaacatgc

SEQ ID NO: 141081 - DNA, 22 bp, Artificial Sequence
  chemically synthesized
ggaaacttctactcaacatgcc

SEQ ID NO: 141082 - DNA, 22 bp, Artificial Sequence
  chemically synthesized
ctactcaacatgcctgtgtgtt

SEQ ID NO: 141083 - DNA, 22 bp, Artificial Sequence
  chemically synthesized
tactcaacatgcctgtgtgtta

SEQ ID NO: 141084 - DNA, 22 bp, Artificial Sequence
  chemically synthesized
ctcaacatgcctgtgtgttatt

SEQ ID NO: 141085 - DNA, 22 bp, Artificial Sequence
  chemically synthesized
aacatgcctgtgtgttattttg

SEQ ID NO: 141086 - DNA, 22 bp, Artificial Sequence
  chemically synthesized
tgtgttattttgtcttttgcct

SEQ ID NO: 141087 - DNA, 22 bp, Artificial Sequence
  chemically synthesized
ttttgtcttttgcctaacagct

SEQ ID NO: 141088 - DNA, 22 bp, Artificial Sequence
  chemically synthesized
tgtcttttgcctaacagctcct

SEQ ID NO: 141089 - DNA, 22 bp, Artificial Sequence
  chemically synthesized
gtcttttgcctaacagctcctg

SEQ ID NO: 141090 - DNA, 22 bp, Artificial Sequence
  chemically synthesized
tcttttgcctaacagctcctgg

SEQ ID NO: 141091 - DNA, 22 bp, Artificial Sequence
  chemically synthesized
ttgcctaacagctcctgggtaa

SEQ ID NO: 141092 - DNA, 22 bp, Artificial Sequence
  chemically synthesized
tgcctaacagctcctgggtaac

SEQ ID NO: 141093 - DNA, 22 bp, Artificial Sequence
  chemically synthesized
gcctaacagctcctgggtaacg

SEQ ID NO: 141094 - DNA, 22 bp, Artificial Sequence
  chemically synthesized
cctaacagctcctgggtaacgt

SEQ ID NO: 141095 - DNA, 22 bp, Artificial Sequence
  chemically synthesized
acagctcctgggtaacgtgatg

SEQ ID NO: 141096 - DNA, 22 bp, Artificial Sequence
  chemically synthesized
ctgggtaacgtgatggtgatta

SEQ ID NO: 141097 - DNA, 22 bp, Artificial Sequence
  chemically synthesized
ggtaacgtgatggtgattattc

SEQ ID NO: 141098 - DNA, 22 bp, Artificial Sequence
  chemically synthesized
ttctggctactcactttggcaa

SEQ ID NO: 141099 - DNA, 22 bp, Artificial Sequence
  chemically synthesized
tggctactcactttggcaagga

SEQ ID NO: 141100 - DNA, 22 bp, Artificial Sequence
  chemically synthesized
gctactcactttggcaaggagt

SEQ ID NO: 141101 - DNA, 22 bp, Artificial Sequence
  chemically synthesized
ctcactttggcaaggagttcac

SEQ ID NO: 141102 - DNA, 22 bp, Artificial Sequence
  chemically synthesized
actttggcaaggagttcacccc

SEQ ID NO: 141103 - DNA, 22 bp, Artificial Sequence
  chemically synthesized
tggcaaggagttcacccctgaa

SEQ ID NO: 141104 - DNA, 22 bp, Artificial Sequence
  chemically synthesized
ggcaaggagttcacccctgaag

SEQ ID NO: 141105 - DNA, 22 bp, Artificial Sequence
  chemically synthesized
gcaaggagttcacccctgaagt

SEQ ID NO: 141106 - DNA, 22 bp, Artificial Sequence
  chemically synthesized
acccctgaagtgcaggctgcct

SEQ ID NO: 141107 - DNA, 22 bp, Artificial Sequence
  chemically synthesized
aagtgcaggctgcctggcagaa

SEQ ID NO: 141108 - DNA, 22 bp, Artificial Sequence
  chemically synthesized
cctggcagaagctggtgtctgc

SEQ ID NO: 141109 - DNA, 22 bp, Artificial Sequence
  chemically synthesized
gcagaagctggtgtctgctgtc

SEQ ID NO: 141110 - DNA, 22 bp, Artificial Sequence
  chemically synthesized
gtgtctgctgtcgccattgccc

SEQ ID NO: 141111 - DNA, 22 bp, Artificial Sequence
  chemically synthesized
ctgtcgccattgccctggccca

SEQ ID NO: 141112 - DNA, 22 bp, Artificial Sequence
  chemically synthesized
tcgccattgccctggcccataa

SEQ ID NO: 141113 - DNA, 22 bp, Artificial Sequence
  chemically synthesized
ccctggcccataagtaccactg

SEQ ID NO: 141114 - DNA, 22 bp, Artificial Sequence
  chemically synthesized
gcccataagtaccactgagttc

SEQ ID NO: 141115 - DNA, 22 bp, Artificial Sequence
  chemically synthesized
agttctcttccagtttgcaggt

SEQ ID NO: 141116 - DNA, 22 bp, Artificial Sequence
  chemically synthesized
tcttccagtttgcaggtgttcc

SEQ ID NO: 141117 - DNA, 22 bp, Artificial Sequence
  chemically synthesized
ttccagtttgcaggtgttcctg

SEQ ID NO: 141118 - DNA, 22 bp, Artificial Sequence
  chemically synthesized
ccagtttgcaggtgttcctgtg

SEQ ID NO: 141119 - DNA, 22 bp, Artificial Sequence
  chemically synthesized
cagtttgcaggtgttcctgtga

SEQ ID NO: 141120 - DNA, 22 bp, Artificial Sequence
  chemically synthesized
gcaggtgttcctgtgaccctga

SEQ ID NO: 141121 - DNA, 22 bp, Artificial Sequence
  chemically synthesized
caggtgttcctgtgaccctgac

SEQ ID NO: 141122 - DNA, 22 bp, Artificial Sequence
  chemically synthesized
ctgtgaccctgacaccctcctt

SEQ ID NO: 141123 - DNA, 22 bp, Artificial Sequence
  chemically synthesized
tgaccctgacaccctccttctg

SEQ ID NO: 141124 - DNA, 22 bp, Artificial Sequence
  chemically synthesized
acaccctccttctgcacatggg

SEQ ID NO: 141125 - DNA, 22 bp, Artificial Sequence
  chemically synthesized
cttctgcacatggggactgggc

SEQ ID NO: 141126 - DNA, 22 bp, Artificial Sequence
  chemically synthesized
ctgcacatggggactgggcttg

SEQ ID NO: 141127 - DNA, 22 bp, Artificial Sequence
  chemically synthesized
tgcacatggggactgggcttgg

SEQ ID NO: 141128 - DNA, 22 bp, Artificial Sequence
  chemically synthesized
cacatggggactgggcttggcc

SEQ ID NO: 141129 - DNA, 22 bp, Artificial Sequence
  chemically synthesized
ggcttggccttgagagaaagcc

SEQ ID NO: 141130 - DNA, 22 bp, Artificial Sequence
  chemically synthesized
ggccttgagagaaagccttctg

SEQ ID NO: 141131 - DNA, 22 bp, Artificial Sequence
  chemically synthesized
gccttgagagaaagccttctgt

SEQ ID NO: 141132 - DNA, 22 bp, Artificial Sequence
  chemically synthesized
gagagaaagccttctgtttaat

SEQ ID NO: 141133 - DNA, 22 bp, Artificial Sequence
  chemically synthesized
agagaaagccttctgtttaata

SEQ ID NO: 141134 - DNA, 22 bp, Artificial Sequence
  chemically synthesized
ctgtttaataaagtacattttc

SEQ ID NO: 141135 - DNA, 22 bp, Artificial Sequence
  chemically synthesized
tgtttaataaagtacattttct

SEQ ID NO: 141136 - DNA, 22 bp, Artificial Sequence
  chemically synthesized
tttaataaagtacattttcttc

SEQ ID NO: 141137 - DNA, 22 bp, Artificial Sequence
  chemically synthesized
aataaagtacattttcttcagt

SEQ ID NO: 141138 - DNA, 22 bp, Artificial Sequence
  chemically synthesized
ataaagtacattttcttcagta

SEQ ID NO: 141139 - DNA, 22 bp, Artificial Sequence
  chemically synthesized
tcttcagtaatcaaaaattgca

SEQ ID NO: 141140 - DNA, 22 bp, Artificial Sequence
  chemically synthesized
cttcagtaatcaaaaattgcaa

SEQ ID NO: 141141 - DNA, 22 bp, Artificial Sequence
  chemically synthesized
ttcagtaatcaaaaattgcaat

SEQ ID NO: 141142 - DNA, 22 bp, Artificial Sequence
  chemically synthesized
cagtaatcaaaaattgcaattt

SEQ ID NO: 141143 - DNA, 22 bp, Artificial Sequence
  chemically synthesized
agtaatcaaaaattgcaatttt

SEQ ID NO: 141144 - DNA, 22 bp, Artificial Sequence
  chemically synthesized
caattttatcttctccatcttt

SEQ ID NO: 141145 - DNA, 22 bp, Artificial Sequence
  chemically synthesized
tatcttctccatcttttactct

SEQ ID NO: 141146 - DNA, 22 bp, Artificial Sequence
  chemically synthesized
atcttctccatcttttactctt

SEQ ID NO: 141147 - DNA, 22 bp, Artificial Sequence
  chemically synthesized
tcttctccatcttttactcttg

SEQ ID NO: 141148 - DNA, 22 bp, Artificial Sequence
  chemically synthesized
ctccatcttttactcttgtgtt

SEQ ID NO: 141149 - DNA, 22 bp, Artificial Sequence
  chemically synthesized
tccatcttttactcttgtgtta

SEQ ID NO: 141150 - DNA, 22 bp, Artificial Sequence
  chemically synthesized
catcttttactcttgtgttaaa

SEQ ID NO: 141151 - DNA, 22 bp, Artificial Sequence
  chemically synthesized
ttactcttgtgttaaaaggaaa

SEQ ID NO: 141152 - DNA, 22 bp, Artificial Sequence
  chemically synthesized
tactcttgtgttaaaaggaaaa

SEQ ID NO: 141153 - DNA, 22 bp, Artificial Sequence
  chemically synthesized
actcttgtgttaaaaggaaaaa

SEQ ID NO: 141154 - DNA, 22 bp, Artificial Sequence
  chemically synthesized
ctcttgtgttaaaaggaaaaag

SEQ ID NO: 141155 - DNA, 22 bp, Artificial Sequence
  chemically synthesized
ttgtgttaaaaggaaaaagtgt

SEQ ID NO: 141156 - DNA, 22 bp, Artificial Sequence
  chemically synthesized
gtgttaaaaggaaaaagtgttc

SEQ ID NO: 141157 - DNA, 22 bp, Artificial Sequence
  chemically synthesized
tgttaaaaggaaaaagtgttca

SEQ ID NO: 141158 - DNA, 22 bp, Artificial Sequence
  chemically synthesized
aaaggaaaaagtgttcatgggc

SEQ ID NO: 141159 - DNA, 22 bp, Artificial Sequence
  chemically synthesized
atgggctgagggatggagagaa

SEQ ID NO: 141160 - DNA, 22 bp, Artificial Sequence
  chemically synthesized
agggatggagagaaacatagga

SEQ ID NO: 141161 - DNA, 22 bp, Artificial Sequence
  chemically synthesized
ccttaagaaatgtatgggggct

SEQ ID NO: 141162 - DNA, 22 bp, Artificial Sequence
  chemically synthesized
cttaagaaatgtatgggggctt

SEQ ID NO: 141163 - DNA, 22 bp, Artificial Sequence
  chemically synthesized
aagaaatgtatgggggcttgta

SEQ ID NO: 141164 - DNA, 22 bp, Artificial Sequence
  chemically synthesized
agaaatgtatgggggcttgtaa

SEQ ID NO: 141165 - DNA, 22 bp, Artificial Sequence
  chemically synthesized
gtaaaattaatgtggatgttat

SEQ ID NO: 141166 - DNA, 22 bp, Artificial Sequence
  chemically synthesized
taaaattaatgtggatgttatg

SEQ ID NO: 141167 - DNA, 22 bp, Artificial Sequence
  chemically synthesized
atgtggatgttatgggagaatt

SEQ ID NO: 141168 - DNA, 22 bp, Artificial Sequence
  chemically synthesized
tgggagaattccaggattccaa

SEQ ID NO: 141169 - DNA, 22 bp, Artificial Sequence
  chemically synthesized
caggattccaaggaggatgata

SEQ ID NO: 141170 - DNA, 22 bp, Artificial Sequence
  chemically synthesized
caaggaggatgatatgatggag

SEQ ID NO: 141171 - DNA, 22 bp, Artificial Sequence
  chemically synthesized
tatcggggtgggaaaatggtta

SEQ ID NO: 141172 - DNA, 22 bp, Artificial Sequence
  chemically synthesized
atcggggtgggaaaatggttaa

SEQ ID NO: 141173 - DNA, 22 bp, Artificial Sequence
  chemically synthesized
tcggggtgggaaaatggttaat

SEQ ID NO: 141174 - DNA, 22 bp, Artificial Sequence
  chemically synthesized
attaagtggacagagactccta

SEQ ID NO: 141175 - DNA, 22 bp, Artificial Sequence
  chemically synthesized
agtggacagagactcctaggca

SEQ ID NO: 141176 - DNA, 22 bp, Artificial Sequence
  chemically synthesized
ctaggcagtttttactgcaccg

SEQ ID NO: 141177 - DNA, 22 bp, Artificial Sequence
  chemically synthesized
ggcagtttttactgcaccgggg

SEQ ID NO: 141178 - DNA, 22 bp, Artificial Sequence
  chemically synthesized
ttactgcaccggggaaagaagg

SEQ ID NO: 141179 - DNA, 22 bp, Artificial Sequence
  chemically synthesized
tactgcaccggggaaagaagga

SEQ ID NO: 141180 - DNA, 22 bp, Artificial Sequence
  chemically synthesized
actgcaccggggaaagaaggag

SEQ ID NO: 141181 - DNA, 22 bp, Artificial Sequence
  chemically synthesized
ctgcaccggggaaagaaggagc

SEQ ID NO: 141182 - DNA, 22 bp, Artificial Sequence
  chemically synthesized
caccggggaaagaaggagctgt

SEQ ID NO: 141183 - DNA, 22 bp, Artificial Sequence
  chemically synthesized
ttagtggtacctgagaaagcag

SEQ ID NO: 141184 - DNA, 22 bp, Artificial Sequence
  chemically synthesized
gtggtacctgagaaagcagatt

SEQ ID NO: 141185 - DNA, 22 bp, Artificial Sequence
  chemically synthesized
agaaagcagatttgtggtacat

SEQ ID NO: 141186 - DNA, 22 bp, Artificial Sequence
  chemically synthesized
gtggtacatgtcacttttcatt

SEQ ID NO: 141187 - DNA, 22 bp, Artificial Sequence
  chemically synthesized
tggtacatgtcacttttcatta

SEQ ID NO: 141188 - DNA, 22 bp, Artificial Sequence
  chemically synthesized
ttcattaaaaacaaaaacaaaa

SEQ ID NO: 141189 - DNA, 22 bp, Artificial Sequence
  chemically synthesized
tcattaaaaacaaaaacaaaac

SEQ ID NO: 141190 - DNA, 22 bp, Artificial Sequence
  chemically synthesized
cattaaaaacaaaaacaaaaca

SEQ ID NO: 141191 - DNA, 22 bp, Artificial Sequence
  chemically synthesized
attaaaaacaaaaacaaaacaa

SEQ ID NO: 141192 - DNA, 22 bp, Artificial Sequence
  chemically synthesized
aaaacaaaaacaaaacaaaaca

SEQ ID NO: 141193 - DNA, 22 bp, Artificial Sequence
  chemically synthesized
catagatatccaagatataggc

SEQ ID NO: 141194 - DNA, 22 bp, Artificial Sequence
  chemically synthesized
atagatatccaagatataggct

SEQ ID NO: 141195 - DNA, 22 bp, Artificial Sequence
  chemically synthesized
gaattactattttaatttactc

SEQ ID NO: 141196 - DNA, 22 bp, Artificial Sequence
  chemically synthesized
ctattttaatttactcttattt

SEQ ID NO: 141197 - DNA, 22 bp, Artificial Sequence
  chemically synthesized
ttttaatttactcttatttaca

SEQ ID NO: 141198 - DNA, 22 bp, Artificial Sequence
  chemically synthesized
taatttactcttatttacattt

SEQ ID NO: 141199 - DNA, 22 bp, Artificial Sequence
  chemically synthesized
aatttactcttatttacatttt

SEQ ID NO: 141200 - DNA, 22 bp, Artificial Sequence
  chemically synthesized
atttactcttatttacattttg

SEQ ID NO: 141201 - DNA, 22 bp, Artificial Sequence
  chemically synthesized
actcttatttacattttgaagt

SEQ ID NO: 141202 - DNA, 22 bp, Artificial Sequence
  chemically synthesized
ctcttatttacattttgaagta

SEQ ID NO: 141203 - DNA, 22 bp, Artificial Sequence
  chemically synthesized
ttatttacattttgaagtagct

SEQ ID NO: 141204 - DNA, 22 bp, Artificial Sequence
  chemically synthesized
atttacattttgaagtagctag

SEQ ID NO: 141205 - DNA, 22 bp, Artificial Sequence
  chemically synthesized
tttacattttgaagtagctagc

SEQ ID NO: 141206 - DNA, 22 bp, Artificial Sequence
  chemically synthesized
acattttgaagtagctagcttg

SEQ ID NO: 141207 - DNA, 22 bp, Artificial Sequence
  chemically synthesized
cattttgaagtagctagcttgt

SEQ ID NO: 141208 - DNA, 22 bp, Artificial Sequence
  chemically synthesized
tgaagtagctagcttgtcacat

SEQ ID NO: 141209 - DNA, 22 bp, Artificial Sequence
  chemically synthesized
gaagtagctagcttgtcacatg

SEQ ID NO: 141210 - DNA, 22 bp, Artificial Sequence
  chemically synthesized
aagtagctagcttgtcacatgt

SEQ ID NO: 141211 - DNA, 22 bp, Artificial Sequence
  chemically synthesized
gcttgtcacatgttttatgaaa

SEQ ID NO: 141212 - DNA, 22 bp, Artificial Sequence
  chemically synthesized
gtcacatgttttatgaaattga

SEQ ID NO: 141213 - DNA, 22 bp, Artificial Sequence
  chemically synthesized
tcacatgttttatgaaattgat

SEQ ID NO: 141214 - DNA, 22 bp, Artificial Sequence
  chemically synthesized
tatgaaattgatttggagataa

SEQ ID NO: 141215 - DNA, 22 bp, Artificial Sequence
  chemically synthesized
atgaaattgatttggagataag

SEQ ID NO: 141216 - DNA, 22 bp, Artificial Sequence
  chemically synthesized
tgaaattgatttggagataaga

SEQ ID NO: 141217 - DNA, 22 bp, Artificial Sequence
  chemically synthesized
atttggagataagatgagtgtg

SEQ ID NO: 141218 - DNA, 22 bp, Artificial Sequence
  chemically synthesized
ggagataagatgagtgtgtatc

SEQ ID NO: 141219 - DNA, 22 bp, Artificial Sequence
  chemically synthesized
gagataagatgagtgtgtatca

SEQ ID NO: 141220 - DNA, 22 bp, Artificial Sequence
  chemically synthesized
ctctttccatgaaggattccat

SEQ ID NO: 141221 - DNA, 22 bp, Artificial Sequence
  chemically synthesized
tttccatgaaggattccattat

SEQ ID NO: 141222 - DNA, 22 bp, Artificial Sequence
  chemically synthesized
tccatgaaggattccattattt

SEQ ID NO: 141223 - DNA, 22 bp, Artificial Sequence
  chemically synthesized
ccatgaaggattccattatttc

SEQ ID NO: 141224 - DNA, 22 bp, Artificial Sequence
  chemically synthesized
catgaaggattccattatttca

SEQ ID NO: 141225 - DNA, 22 bp, Artificial Sequence
  chemically synthesized
cattatttcatgggttagctga

SEQ ID NO: 141226 - DNA, 22 bp, Artificial Sequence
  chemically synthesized
tttcatgggttagctgaagcta

SEQ ID NO: 141227 - DNA, 22 bp, Artificial Sequence
  chemically synthesized
catgggttagctgaagctaaga

SEQ ID NO: 141228 - DNA, 22 bp, Artificial Sequence
  chemically synthesized
atgggttagctgaagctaagac

SEQ ID NO: 141229 - DNA, 22 bp, Artificial Sequence
  chemically synthesized
gctgaagctaagacacatgata

SEQ ID NO: 141230 - DNA, 22 bp, Artificial Sequence
  chemically synthesized
aagctaagacacatgatatcat

SEQ ID NO: 141231 - DNA, 22 bp, Artificial Sequence
  chemically synthesized
agacacatgatatcattgtgca

SEQ ID NO: 141232 - DNA, 22 bp, Artificial Sequence
  chemically synthesized
tgcattatcttctgatagaatg

SEQ ID NO: 141233 - DNA, 22 bp, Artificial Sequence
  chemically synthesized
tcttctgatagaatgtaacatg

SEQ ID NO: 141234 - DNA, 22 bp, Artificial Sequence
  chemically synthesized
ctgatagaatgtaacatgcact

SEQ ID NO: 141235 - DNA, 22 bp, Artificial Sequence
  chemically synthesized
tgatagaatgtaacatgcacta

SEQ ID NO: 141236 - DNA, 22 bp, Artificial Sequence
  chemically synthesized
atagaatgtaacatgcactaaa

SEQ ID NO: 141237 - DNA, 22 bp, Artificial Sequence
  chemically synthesized
aaataaagttagagttaggacc

SEQ ID NO: 141238 - DNA, 22 bp, Artificial Sequence
  chemically synthesized
gagttaggacctgagtgggaaa

SEQ ID NO: 141239 - DNA, 22 bp, Artificial Sequence
  chemically synthesized
ggacctgagtgggaaagttttt

SEQ ID NO: 141240 - DNA, 22 bp, Artificial Sequence
  chemically synthesized
agtgggaaagtttttggagagt

SEQ ID NO: 141241 - DNA, 22 bp, Artificial Sequence
  chemically synthesized
ttggagagtgtgatgaagactt

SEQ ID NO: 141242 - DNA, 22 bp, Artificial Sequence
  chemically synthesized
tggagagtgtgatgaagacttt

SEQ ID NO: 141243 - DNA, 22 bp, Artificial Sequence
  chemically synthesized
ggagagtgtgatgaagactttc

SEQ ID NO: 141244 - DNA, 22 bp, Artificial Sequence
  chemically synthesized
gagagtgtgatgaagactttcc

SEQ ID NO: 141245 - DNA, 22 bp, Artificial Sequence
  chemically synthesized
tccgtgggagatagaatactaa

SEQ ID NO: 141246 - DNA, 22 bp, Artificial Sequence
  chemically synthesized
ccgtgggagatagaatactaat

SEQ ID NO: 141247 - DNA, 22 bp, Artificial Sequence
  chemically synthesized
cgtgggagatagaatactaata

SEQ ID NO: 141248 - DNA, 22 bp, Artificial Sequence
  chemically synthesized
ataaaggcttaaattctaaaac

SEQ ID NO: 141249 - DNA, 22 bp, Artificial Sequence
  chemically synthesized
aaattctaaaaccagcaagcta

SEQ ID NO: 141250 - DNA, 22 bp, Artificial Sequence
  chemically synthesized
aattctaaaaccagcaagctag

SEQ ID NO: 141251 - DNA, 22 bp, Artificial Sequence
  chemically synthesized
taaaaccagcaagctagggctt

SEQ ID NO: 141252 - DNA, 22 bp, Artificial Sequence
  chemically synthesized
aaaccagcaagctagggcttcg

SEQ ID NO: 141253 - DNA, 22 bp, Artificial Sequence
  chemically synthesized
gggcttcgtgacttgcatgaaa

SEQ ID NO: 141254 - DNA, 22 bp, Artificial Sequence
  chemically synthesized
cgtgacttgcatgaaactggct

SEQ ID NO: 141255 - DNA, 22 bp, Artificial Sequence
  chemically synthesized
gtgacttgcatgaaactggctc

SEQ ID NO: 141256 - DNA, 22 bp, Artificial Sequence
  chemically synthesized
gcatgaaactggctctctggaa

SEQ ID NO: 141257 - DNA, 22 bp, Artificial Sequence
  chemically synthesized
catgaaactggctctctggaag

SEQ ID NO: 141258 - DNA, 22 bp, Artificial Sequence
  chemically synthesized
gctctctggaagtagaagggag

SEQ ID NO: 141259 - DNA, 22 bp, Artificial Sequence
  chemically synthesized
tctggaagtagaagggagagta

SEQ ID NO: 141260 - DNA, 22 bp, Artificial Sequence
  chemically synthesized
tggaagtagaagggagagtaag

SEQ ID NO: 141261 - DNA, 22 bp, Artificial Sequence
  chemically synthesized
gaagtagaagggagagtaagac

SEQ ID NO: 141262 - DNA, 22 bp, Artificial Sequence
  chemically synthesized
ggaaagaccagatagtacaggg

SEQ ID NO: 141263 - DNA, 22 bp, Artificial Sequence
  chemically synthesized
gctacaaaaatacaagctttta

SEQ ID NO: 141264 - DNA, 22 bp, Artificial Sequence
  chemically synthesized
caaaaatacaagcttttactat

SEQ ID NO: 141265 - DNA, 22 bp, Artificial Sequence
  chemically synthesized
ttactatgctattgcaatacta

SEQ ID NO: 141266 - DNA, 22 bp, Artificial Sequence
  chemically synthesized
tactatgctattgcaatactaa

SEQ ID NO: 141267 - DNA, 22 bp, Artificial Sequence
  chemically synthesized
actatgctattgcaatactaaa

SEQ ID NO: 141268 - DNA, 22 bp, Artificial Sequence
  chemically synthesized
ctatgctattgcaatactaaac

SEQ ID NO: 141269 - DNA, 22 bp, Artificial Sequence
  chemically synthesized
tgctattgcaatactaaacgat

SEQ ID NO: 141270 - DNA, 22 bp, Artificial Sequence
  chemically synthesized
ttgcaatactaaacgataagca

SEQ ID NO: 141271 - DNA, 22 bp, Artificial Sequence
  chemically synthesized
caatactaaacgataagcatta

SEQ ID NO: 141272 - DNA, 22 bp, Artificial Sequence
  chemically synthesized
aacgataagcattaggatgtta

SEQ ID NO: 141273 - DNA, 22 bp, Artificial Sequence
  chemically synthesized
ggatgttaagtgactcaggaaa

SEQ ID NO: 141274 - DNA, 22 bp, Artificial Sequence
  chemically synthesized
agtgactcaggaaataagattt

SEQ ID NO: 141275 - DNA, 22 bp, Artificial Sequence
  chemically synthesized
aggaaataagattttgggaaaa

SEQ ID NO: 141276 - DNA, 22 bp, Artificial Sequence
  chemically synthesized
tgggaaaaagtaatctgcttat

SEQ ID NO: 141277 - DNA, 22 bp, Artificial Sequence
  chemically synthesized
gggaaaaagtaatctgcttatg

SEQ ID NO: 141278 - DNA, 22 bp, Artificial Sequence
  chemically synthesized
ggaaaaagtaatctgcttatgt

SEQ ID NO: 141279 - DNA, 22 bp, Artificial Sequence
  chemically synthesized
cttatgtgcacaaaatggattc

SEQ ID NO: 141280 - DNA, 22 bp, Artificial Sequence
  chemically synthesized
atgtgcacaaaatggattcaag

SEQ ID NO: 141281 - DNA, 22 bp, Artificial Sequence
  chemically synthesized
tgtgcacaaaatggattcaagt

SEQ ID NO: 141282 - DNA, 22 bp, Artificial Sequence
  chemically synthesized
aagtttgcagataaaataaaat

SEQ ID NO: 141283 - DNA, 22 bp, Artificial Sequence
  chemically synthesized
gcagataaaataaaatatggat

SEQ ID NO: 141284 - DNA, 22 bp, Artificial Sequence
  chemically synthesized
cagataaaataaaatatggatg

SEQ ID NO: 141285 - DNA, 22 bp, Artificial Sequence
  chemically synthesized
aaggggacagatacaatggttc

SEQ ID NO: 141286 - DNA, 22 bp, Artificial Sequence
  chemically synthesized
aaacccaagaggagcagtgagt

SEQ ID NO: 141287 - DNA, 22 bp, Artificial Sequence
  chemically synthesized
tggaatttgaaggatggacaaa

SEQ ID NO: 141288 - DNA, 22 bp, Artificial Sequence
  chemically synthesized
gaaggatggacaaaggtggggt

SEQ ID NO: 141289 - DNA, 22 bp, Artificial Sequence
  chemically synthesized
aaggatggacaaaggtggggtg

SEQ ID NO: 141290 - DNA, 22 bp, Artificial Sequence
  chemically synthesized
gactgactgtgggagatgagaa

SEQ ID NO: 141291 - DNA, 22 bp, Artificial Sequence
  chemically synthesized
actgtgggagatgagaaggaag

SEQ ID NO: 141292 - DNA, 22 bp, Artificial Sequence
  chemically synthesized
tgggagatgagaaggaagaagg

SEQ ID NO: 141293 - DNA, 22 bp, Artificial Sequence
  chemically synthesized
aaagctcccagactggtgaaga

SEQ ID NO: 141294 - DNA, 22 bp, Artificial Sequence
  chemically synthesized
ccagactggtgaagataacagg

SEQ ID NO: 141295 - DNA, 22 bp, Artificial Sequence
  chemically synthesized
gtgaagataacaggaggaaacc

SEQ ID NO: 141296 - DNA, 22 bp, Artificial Sequence
  chemically synthesized
acctggtgactctcatgtgtga

SEQ ID NO: 141297 - DNA, 22 bp, Artificial Sequence
  chemically synthesized
gtgactctcatgtgtgaagggt

SEQ ID NO: 141298 - DNA, 22 bp, Artificial Sequence
  chemically synthesized
tcatgtgtgaagggtagaggga

SEQ ID NO: 141299 - DNA, 22 bp, Artificial Sequence
  chemically synthesized
atgtgtgaagggtagagggata

SEQ ID NO: 141300 - DNA, 22 bp, Artificial Sequence
  chemically synthesized
acagatttactttttaggaagt

SEQ ID NO: 141301 - DNA, 22 bp, Artificial Sequence
  chemically synthesized
actttttaggaagtgctagatt

SEQ ID NO: 141302 - DNA, 22 bp, Artificial Sequence
  chemically synthesized
ctttttaggaagtgctagattg

SEQ ID NO: 141303 - DNA, 22 bp, Artificial Sequence
  chemically synthesized
tttaggaagtgctagattggtc

SEQ ID NO: 141304 - DNA, 22 bp, Artificial Sequence
  chemically synthesized
ttaggaagtgctagattggtca

SEQ ID NO: 141305 - DNA, 22 bp, Artificial Sequence
  chemically synthesized
taggaagtgctagattggtcag

SEQ ID NO: 141306 - DNA, 22 bp, Artificial Sequence
  chemically synthesized
aggaagtgctagattggtcagg

SEQ ID NO: 141307 - DNA, 22 bp, Artificial Sequence
  chemically synthesized
ggaagtgctagattggtcaggg

SEQ ID NO: 141308 - DNA, 22 bp, Artificial Sequence
  chemically synthesized
gattggtcagggagttttgacc

SEQ ID NO: 141309 - DNA, 22 bp, Artificial Sequence
  chemically synthesized
gtcagggagttttgaccttcag

SEQ ID NO: 141310 - DNA, 22 bp, Artificial Sequence
  chemically synthesized
tgaccttcaggtcttgtgtctt

SEQ ID NO: 141311 - DNA, 22 bp, Artificial Sequence
  chemically synthesized
gaccttcaggtcttgtgtcttt

SEQ ID NO: 141312 - DNA, 22 bp, Artificial Sequence
  chemically synthesized
accttcaggtcttgtgtctttc

SEQ ID NO: 141313 - DNA, 22 bp, Artificial Sequence
  chemically synthesized
caggtcttgtgtctttcatatc

SEQ ID NO: 141314 - DNA, 22 bp, Artificial Sequence
  chemically synthesized
aggtcttgtgtctttcatatca

SEQ ID NO: 141315 - DNA, 22 bp, Artificial Sequence
  chemically synthesized
gtgtctttcatatcaaggaacc

SEQ ID NO: 141316 - DNA, 22 bp, Artificial Sequence
  chemically synthesized
tgtctttcatatcaaggaacct

SEQ ID NO: 141317 - DNA, 22 bp, Artificial Sequence
  chemically synthesized
tcatatcaaggaacctttgcat

SEQ ID NO: 141318 - DNA, 22 bp, Artificial Sequence
  chemically synthesized
catatcaaggaacctttgcatt

SEQ ID NO: 141319 - DNA, 22 bp, Artificial Sequence
  chemically synthesized
atatcaaggaacctttgcattt

SEQ ID NO: 141320 - DNA, 22 bp, Artificial Sequence
  chemically synthesized
tgcattttccaagttagagtgc

SEQ ID NO: 141321 - DNA, 22 bp, Artificial Sequence
  chemically synthesized
gcattttccaagttagagtgcc

SEQ ID NO: 141322 - DNA, 22 bp, Artificial Sequence
  chemically synthesized
cattttccaagttagagtgcca

SEQ ID NO: 141323 - DNA, 22 bp, Artificial Sequence
  chemically synthesized
tccaagttagagtgccatattt

SEQ ID NO: 141324 - DNA, 22 bp, Artificial Sequence
  chemically synthesized
ccaagttagagtgccatatttt

SEQ ID NO: 141325 - DNA, 22 bp, Artificial Sequence
  chemically synthesized
caagttagagtgccatattttg

SEQ ID NO: 141326 - DNA, 22 bp, Artificial Sequence
  chemically synthesized
gagtgccatattttggcaaata

SEQ ID NO: 141327 - DNA, 22 bp, Artificial Sequence
  chemically synthesized
tggcaaatataactttattagt

SEQ ID NO: 141328 - DNA, 22 bp, Artificial Sequence
  chemically synthesized
ggcaaatataactttattagta

SEQ ID NO: 141329 - DNA, 22 bp, Artificial Sequence
  chemically synthesized
gcaaatataactttattagtaa

SEQ ID NO: 141330 - DNA, 22 bp, Artificial Sequence
  chemically synthesized
tattagtaattttatagtgctc

SEQ ID NO: 141331 - DNA, 22 bp, Artificial Sequence
  chemically synthesized
attagtaattttatagtgctct

SEQ ID NO: 141332 - DNA, 22 bp, Artificial Sequence
  chemically synthesized
ttagtaattttatagtgctctc

SEQ ID NO: 141333 - DNA, 22 bp, Artificial Sequence
  chemically synthesized
gtaattttatagtgctctcaca

SEQ ID NO: 141334 - DNA, 22 bp, Artificial Sequence
  chemically synthesized
tatagtgctctcacattgatca

SEQ ID NO: 141335 - DNA, 22 bp, Artificial Sequence
  chemically synthesized
atagtgctctcacattgatcag

SEQ ID NO: 141336 - DNA, 22 bp, Artificial Sequence
  chemically synthesized
tagtgctctcacattgatcaga

SEQ ID NO: 141337 - DNA, 22 bp, Artificial Sequence
  chemically synthesized
tcacattgatcagactttttcc

SEQ ID NO: 141338 - DNA, 22 bp, Artificial Sequence
  chemically synthesized
acattgatcagactttttcctg

SEQ ID NO: 141339 - DNA, 22 bp, Artificial Sequence
  chemically synthesized
atcagactttttcctgtgaatt

SEQ ID NO: 141340 - DNA, 22 bp, Artificial Sequence
  chemically synthesized
tttcctgtgaattacttttgaa

SEQ ID NO: 141341 - DNA, 22 bp, Artificial Sequence
  chemically synthesized
ttcctgtgaattacttttgaat

SEQ ID NO: 141342 - DNA, 22 bp, Artificial Sequence
  chemically synthesized
tcctgtgaattacttttgaatt

SEQ ID NO: 141343 - DNA, 22 bp, Artificial Sequence
  chemically synthesized
cctgtgaattacttttgaattt

SEQ ID NO: 141344 - DNA, 22 bp, Artificial Sequence
  chemically synthesized
ctgtgaattacttttgaatttg

SEQ ID NO: 141345 - DNA, 22 bp, Artificial Sequence
  chemically synthesized
tgaattacttttgaatttggct

SEQ ID NO: 141346 - DNA, 22 bp, Artificial Sequence
  chemically synthesized
cttttgaatttggctgtatata

SEQ ID NO: 141347 - DNA, 22 bp, Artificial Sequence
  chemically synthesized
ttgaatttggctgtatatatcc

SEQ ID NO: 141348 - DNA, 22 bp, Artificial Sequence
  chemically synthesized
tgaatttggctgtatatatcca

SEQ ID NO: 141349 - DNA, 22 bp, Artificial Sequence
  chemically synthesized
gaatttggctgtatatatccag

SEQ ID NO: 141350 - DNA, 22 bp, Artificial Sequence
  chemically synthesized
aatttggctgtatatatccaga

SEQ ID NO: 141351 - DNA, 22 bp, Artificial Sequence
  chemically synthesized
ggctgtatatatccagaatatg

SEQ ID NO: 141352 - DNA, 22 bp, Artificial Sequence
  chemically synthesized
gctgtatatatccagaatatgg

SEQ ID NO: 141353 - DNA, 22 bp, Artificial Sequence
  chemically synthesized
tatatatccagaatatgggaga

SEQ ID NO: 141354 - DNA, 22 bp, Artificial Sequence
  chemically synthesized
ttgtagttgcaggctatcaaca

SEQ ID NO: 141355 - DNA, 22 bp, Artificial Sequence
  chemically synthesized
tagttgcaggctatcaacaata

SEQ ID NO: 141356 - DNA, 22 bp, Artificial Sequence
  chemically synthesized
caggctatcaacaatactggtc

SEQ ID NO: 141357 - DNA, 22 bp, Artificial Sequence
  chemically synthesized
tcaacaatactggtctctctga

SEQ ID NO: 141358 - DNA, 22 bp, Artificial Sequence
  chemically synthesized
gtctctctgagccttataacct

SEQ ID NO: 141359 - DNA, 22 bp, Artificial Sequence
  chemically synthesized
tctgagccttataacctttcaa

SEQ ID NO: 141360 - DNA, 22 bp, Artificial Sequence
  chemically synthesized
tgagccttataacctttcaata

SEQ ID NO: 141361 - DNA, 22 bp, Artificial Sequence
  chemically synthesized
agccttataacctttcaatatg

SEQ ID NO: 141362 - DNA, 22 bp, Artificial Sequence
  chemically synthesized
ataacctttcaatatgcccata

SEQ ID NO: 141363 - DNA, 22 bp, Artificial Sequence
  chemically synthesized
taacctttcaatatgcccataa

SEQ ID NO: 141364 - DNA, 22 bp, Artificial Sequence
  chemically synthesized
tcaatatgcccataaacagagt

SEQ ID NO: 141365 - DNA, 22 bp, Artificial Sequence
  chemically synthesized
caatatgcccataaacagagta

SEQ ID NO: 141366 - DNA, 22 bp, Artificial Sequence
  chemically synthesized
aatatgcccataaacagagtaa

SEQ ID NO: 141367 - DNA, 22 bp, Artificial Sequence
  chemically synthesized
ttcatggcactaaatattttca

SEQ ID NO: 141368 - DNA, 22 bp, Artificial Sequence
  chemically synthesized
atggcactaaatattttcacct

SEQ ID NO: 141369 - DNA, 22 bp, Artificial Sequence
  chemically synthesized
aatattttcacctagtcagtca

SEQ ID NO: 141370 - DNA, 22 bp, Artificial Sequence
  chemically synthesized
tcacctagtcagtcaacaaatg

SEQ ID NO: 141371 - DNA, 22 bp, Artificial Sequence
  chemically synthesized
cacctagtcagtcaacaaatgg

SEQ ID NO: 141372 - DNA, 22 bp, Artificial Sequence
  chemically synthesized
acctagtcagtcaacaaatggg

SEQ ID NO: 141373 - DNA, 22 bp, Artificial Sequence
  chemically synthesized
gtcagtcaacaaatgggagcaa

SEQ ID NO: 141374 - DNA, 22 bp, Artificial Sequence
  chemically synthesized
tttgatacatatttttatatat

SEQ ID NO: 141375 - DNA, 22 bp, Artificial Sequence
  chemically synthesized
ttgatacatatttttatatatt

SEQ ID NO: 141376 - DNA, 22 bp, Artificial Sequence
  chemically synthesized
tgatacatatttttatatattt

SEQ ID NO: 141377 - DNA, 22 bp, Artificial Sequence
  chemically synthesized
gatacatatttttatatattta

SEQ ID NO: 141378 - DNA, 22 bp, Artificial Sequence
  chemically synthesized
atacatatttttatatatttat

SEQ ID NO: 141379 - DNA, 22 bp, Artificial Sequence
  chemically synthesized
ttatatatttatggggtacatg

SEQ ID NO: 141380 - DNA, 22 bp, Artificial Sequence
  chemically synthesized
tatatatttatggggtacatgt

SEQ ID NO: 141381 - DNA, 22 bp, Artificial Sequence
  chemically synthesized
atatatttatggggtacatgtg

SEQ ID NO: 141382 - DNA, 22 bp, Artificial Sequence
  chemically synthesized
tatatttatggggtacatgtga

SEQ ID NO: 141383 - DNA, 22 bp, Artificial Sequence
  chemically synthesized
atggggtacatgtgatacttac

SEQ ID NO: 141384 - DNA, 22 bp, Artificial Sequence
  chemically synthesized
tggggtacatgtgatacttaca

SEQ ID NO: 141385 - DNA, 22 bp, Artificial Sequence
  chemically synthesized
acatgcctagaacatgtgatga

SEQ ID NO: 141386 - DNA, 22 bp, Artificial Sequence
  chemically synthesized
catgcctagaacatgtgatgat

SEQ ID NO: 141387 - DNA, 22 bp, Artificial Sequence
  chemically synthesized
gaacatgtgatgattaagtcta

SEQ ID NO: 141388 - DNA, 22 bp, Artificial Sequence
  chemically synthesized
agtctagatatttaggatatcc

SEQ ID NO: 141389 - DNA, 22 bp, Artificial Sequence
  chemically synthesized
gatatttaggatatccattgct

SEQ ID NO: 141390 - DNA, 22 bp, Artificial Sequence
  chemically synthesized
aggatatccattgctttgagca

SEQ ID NO: 141391 - DNA, 22 bp, Artificial Sequence
  chemically synthesized
ggatatccattgctttgagcat

SEQ ID NO: 141392 - DNA, 22 bp, Artificial Sequence
  chemically synthesized
ctttgagcatttatcatttcta

SEQ ID NO: 141393 - DNA, 22 bp, Artificial Sequence
  chemically synthesized
tgagcatttatcatttctatgt

SEQ ID NO: 141394 - DNA, 22 bp, Artificial Sequence
  chemically synthesized
gagcatttatcatttctatgta

SEQ ID NO: 141395 - DNA, 22 bp, Artificial Sequence
  chemically synthesized
agcatttatcatttctatgtat

SEQ ID NO: 141396 - DNA, 22 bp, Artificial Sequence
  chemically synthesized
atcatttctatgtattgagaaa

SEQ ID NO: 141397 - DNA, 22 bp, Artificial Sequence
  chemically synthesized
tcatttctatgtattgagaaaa

SEQ ID NO: 141398 - DNA, 22 bp, Artificial Sequence
  chemically synthesized
ctatgtattgagaaaatttcaa

SEQ ID NO: 141399 - DNA, 22 bp, Artificial Sequence
  chemically synthesized
tatgtattgagaaaatttcaaa

SEQ ID NO: 141400 - DNA, 22 bp, Artificial Sequence
  chemically synthesized
tgtattgagaaaatttcaaatc

SEQ ID NO: 141401 - DNA, 22 bp, Artificial Sequence
  chemically synthesized
agaaaatttcaaatcctcattt

SEQ ID NO: 141402 - DNA, 22 bp, Artificial Sequence
  chemically synthesized
caaatcctcatttctagccatt

SEQ ID NO: 141403 - DNA, 22 bp, Artificial Sequence
  chemically synthesized
aaatcctcatttctagccattt

SEQ ID NO: 141404 - DNA, 22 bp, Artificial Sequence
  chemically synthesized
atttctagccattttgaaatat

SEQ ID NO: 141405 - DNA, 22 bp, Artificial Sequence
  chemically synthesized
ctagccattttgaaatatataa

SEQ ID NO: 141406 - DNA, 22 bp, Artificial Sequence
  chemically synthesized
tagccattttgaaatatataat

SEQ ID NO: 141407 - DNA, 22 bp, Artificial Sequence
  chemically synthesized
gccattttgaaatatataataa

SEQ ID NO: 141408 - DNA, 22 bp, Artificial Sequence
  chemically synthesized
tgaaatatataataaatagtaa

SEQ ID NO: 141409 - DNA, 22 bp, Artificial Sequence
  chemically synthesized
gaaatatataataaatagtaat

SEQ ID NO: 141410 - DNA, 22 bp, Artificial Sequence
  chemically synthesized
aaatatataataaatagtaatt

SEQ ID NO: 141411 - DNA, 22 bp, Artificial Sequence
  chemically synthesized
actatagtcaccctactcaaat

SEQ ID NO: 141412 - DNA, 22 bp, Artificial Sequence
  chemically synthesized
tagtcaccctactcaaatatca

SEQ ID NO: 141413 - DNA, 22 bp, Artificial Sequence
  chemically synthesized
ctcaaatatcaaacattatggc

SEQ ID NO: 141414 - DNA, 22 bp, Artificial Sequence
  chemically synthesized
aaatatcaaacattatggctta

SEQ ID NO: 141415 - DNA, 22 bp, Artificial Sequence
  chemically synthesized
tggcttaatccttctatccaac

SEQ ID NO: 141416 - DNA, 22 bp, Artificial Sequence
  chemically synthesized
aatccttctatccaactgtgtt

SEQ ID NO: 141417 - DNA, 22 bp, Artificial Sequence
  chemically synthesized
atccttctatccaactgtgttt

SEQ ID NO: 141418 - DNA, 22 bp, Artificial Sequence
  chemically synthesized
ctatccaactgtgtttgtacct

SEQ ID NO: 141419 - DNA, 22 bp, Artificial Sequence
  chemically synthesized
tatccaactgtgtttgtaccta

SEQ ID NO: 141420 - DNA, 22 bp, Artificial Sequence
  chemically synthesized
tccaactgtgtttgtacctatt

SEQ ID NO: 141421 - DNA, 22 bp, Artificial Sequence
  chemically synthesized
tgtttgtacctattaaccaaca

SEQ ID NO: 141422 - DNA, 22 bp, Artificial Sequence
  chemically synthesized
gtacctattaaccaacatctct

SEQ ID NO: 141423 - DNA, 22 bp, Artificial Sequence
  chemically synthesized
tacctattaaccaacatctctt

SEQ ID NO: 141424 - DNA, 22 bp, Artificial Sequence
  chemically synthesized
ttaaccaacatctcttaaatcc

SEQ ID NO: 141425 - DNA, 22 bp, Artificial Sequence
  chemically synthesized
accaacatctcttaaatcccct

SEQ ID NO: 141426 - DNA, 22 bp, Artificial Sequence
  chemically synthesized
ttaaatcccctcccatacacac

SEQ ID NO: 141427 - DNA, 22 bp, Artificial Sequence
  chemically synthesized
aaatcccctcccatacacactc

SEQ ID NO: 141428 - DNA, 22 bp, Artificial Sequence
  chemically synthesized
aatcccctcccatacacactca

SEQ ID NO: 141429 - DNA, 22 bp, Artificial Sequence
  chemically synthesized
ccatacacactcacactttttc

SEQ ID NO: 141430 - DNA, 22 bp, Artificial Sequence
  chemically synthesized
acactttttccagcctctgata

SEQ ID NO: 141431 - DNA, 22 bp, Artificial Sequence
  chemically synthesized
tttccagcctctgataactatc

SEQ ID NO: 141432 - DNA, 22 bp, Artificial Sequence
  chemically synthesized
ttccagcctctgataactatca

SEQ ID NO: 141433 - DNA, 22 bp, Artificial Sequence
  chemically synthesized
tccagcctctgataactatcat

SEQ ID NO: 141434 - DNA, 22 bp, Artificial Sequence
  chemically synthesized
ccagcctctgataactatcatt

SEQ ID NO: 141435 - DNA, 22 bp, Artificial Sequence
  chemically synthesized
cagcctctgataactatcattc

SEQ ID NO: 141436 - DNA, 22 bp, Artificial Sequence
  chemically synthesized
tgataactatcattctactctc

SEQ ID NO: 141437 - DNA, 22 bp, Artificial Sequence
  chemically synthesized
ataactatcattctactctcta

SEQ ID NO: 141438 - DNA, 22 bp, Artificial Sequence
  chemically synthesized
tcattctactctctaccaccat

SEQ ID NO: 141439 - DNA, 22 bp, Artificial Sequence
  chemically synthesized
tactctctaccaccatgagacc

SEQ ID NO: 141440 - DNA, 22 bp, Artificial Sequence
  chemically synthesized
ctctctaccaccatgagaccca

SEQ ID NO: 141441 - DNA, 22 bp, Artificial Sequence
  chemically synthesized
tctaccaccatgagacccactt

SEQ ID NO: 141442 - DNA, 22 bp, Artificial Sequence
  chemically synthesized
taccaccatgagacccactttt

SEQ ID NO: 141443 - DNA, 22 bp, Artificial Sequence
  chemically synthesized
ccaccatgagacccactttttt

SEQ ID NO: 141444 - DNA, 22 bp, Artificial Sequence
  chemically synthesized
ttttagctcccacagatgaata

SEQ ID NO: 141445 - DNA, 22 bp, Artificial Sequence
  chemically synthesized
tttagctcccacagatgaataa

SEQ ID NO: 141446 - DNA, 22 bp, Artificial Sequence
  chemically synthesized
ttagctcccacagatgaataaa

SEQ ID NO: 141447 - DNA, 22 bp, Artificial Sequence
  chemically synthesized
tagctcccacagatgaataaaa

SEQ ID NO: 141448 - DNA, 22 bp, Artificial Sequence
  chemically synthesized
agctcccacagatgaataaaaa

SEQ ID NO: 141449 - DNA, 22 bp, Artificial Sequence
  chemically synthesized
gctcccacagatgaataaaaac

SEQ ID NO: 141450 - DNA, 22 bp, Artificial Sequence
  chemically synthesized
ccacagatgaataaaaacatgt

SEQ ID NO: 141451 - DNA, 22 bp, Artificial Sequence
  chemically synthesized
gactttctgtatctggcttatt

SEQ ID NO: 141452 - DNA, 22 bp, Artificial Sequence
  chemically synthesized
actttctgtatctggcttattt

SEQ ID NO: 141453 - DNA, 22 bp, Artificial Sequence
  chemically synthesized
tctgtatctggcttattttatt

SEQ ID NO: 141454 - DNA, 22 bp, Artificial Sequence
  chemically synthesized
ctgtatctggcttattttatta

SEQ ID NO: 141455 - DNA, 22 bp, Artificial Sequence
  chemically synthesized
tgtatctggcttattttattat

SEQ ID NO: 141456 - DNA, 22 bp, Artificial Sequence
  chemically synthesized
tatctggcttattttattatct

SEQ ID NO: 141457 - DNA, 22 bp, Artificial Sequence
  chemically synthesized
gcttattttattatctatctct

SEQ ID NO: 141458 - DNA, 22 bp, Artificial Sequence
  chemically synthesized
attttattatctatctctttgg

SEQ ID NO: 141459 - DNA, 22 bp, Artificial Sequence
  chemically synthesized
ttttattatctatctctttggc

SEQ ID NO: 141460 - DNA, 22 bp, Artificial Sequence
  chemically synthesized
tattatctatctctttggcata

SEQ ID NO: 141461 - DNA, 22 bp, Artificial Sequence
  chemically synthesized
attatctatctctttggcatac

SEQ ID NO: 141462 - DNA, 22 bp, Artificial Sequence
  chemically synthesized
ttatctatctctttggcatacc

SEQ ID NO: 141463 - DNA, 22 bp, Artificial Sequence
  chemically synthesized
tctatctctttggcataccaag

SEQ ID NO: 141464 - DNA, 22 bp, Artificial Sequence
  chemically synthesized
tctctttggcataccaagagtt

SEQ ID NO: 141465 - DNA, 22 bp, Artificial Sequence
  chemically synthesized
tttggcataccaagagtttgtt

SEQ ID NO: 141466 - DNA, 22 bp, Artificial Sequence
  chemically synthesized
tggcataccaagagtttgtttt

SEQ ID NO: 141467 - DNA, 22 bp, Artificial Sequence
  chemically synthesized
ggcataccaagagtttgttttt

SEQ ID NO: 141468 - DNA, 22 bp, Artificial Sequence
  chemically synthesized
gcataccaagagtttgtttttg

SEQ ID NO: 141469 - DNA, 22 bp, Artificial Sequence
  chemically synthesized
gtttttgttctgcttcagggct

SEQ ID NO: 141470 - DNA, 22 bp, Artificial Sequence
  chemically synthesized
tttttgttctgcttcagggctt

SEQ ID NO: 141471 - DNA, 22 bp, Artificial Sequence
  chemically synthesized
ttgttctgcttcagggctttca

SEQ ID NO: 141472 - DNA, 22 bp, Artificial Sequence
  chemically synthesized
tgttctgcttcagggctttcaa

SEQ ID NO: 141473 - DNA, 22 bp, Artificial Sequence
  chemically synthesized
gttctgcttcagggctttcaat

SEQ ID NO: 141474 - DNA, 22 bp, Artificial Sequence
  chemically synthesized
ttctgcttcagggctttcaatt

SEQ ID NO: 141475 - DNA, 22 bp, Artificial Sequence
  chemically synthesized
tgcttcagggctttcaattaac

SEQ ID NO: 141476 - DNA, 22 bp, Artificial Sequence
  chemically synthesized
cttcagggctttcaattaacat

SEQ ID NO: 141477 - DNA, 22 bp, Artificial Sequence
  chemically synthesized
cagggctttcaattaacataat

SEQ ID NO: 141478 - DNA, 22 bp, Artificial Sequence
  chemically synthesized
agggctttcaattaacataatg

SEQ ID NO: 141479 - DNA, 22 bp, Artificial Sequence
  chemically synthesized
tcaattaacataatgacctctg

SEQ ID NO: 141480 - DNA, 22 bp, Artificial Sequence
  chemically synthesized
caattaacataatgacctctgg

SEQ ID NO: 141481 - DNA, 22 bp, Artificial Sequence
  chemically synthesized
aattaacataatgacctctggt

SEQ ID NO: 141482 - DNA, 22 bp, Artificial Sequence
  chemically synthesized
acataatgacctctggttccat

SEQ ID NO: 141483 - DNA, 22 bp, Artificial Sequence
  chemically synthesized
tggttccatccatgttgctaca

SEQ ID NO: 141484 - DNA, 22 bp, Artificial Sequence
  chemically synthesized
gttccatccatgttgctacaaa

SEQ ID NO: 141485 - DNA, 22 bp, Artificial Sequence
  chemically synthesized
catccatgttgctacaaatgac

SEQ ID NO: 141486 - DNA, 22 bp, Artificial Sequence
  chemically synthesized
ctacaaatgacaagatttcatt

SEQ ID NO: 141487 - DNA, 22 bp, Artificial Sequence
  chemically synthesized
caaatgacaagatttcattctt

SEQ ID NO: 141488 - DNA, 22 bp, Artificial Sequence
  chemically synthesized
cattctttttcatggcaaaata

SEQ ID NO: 141489 - DNA, 22 bp, Artificial Sequence
  chemically synthesized
attctttttcatggcaaaatag

SEQ ID NO: 141490 - DNA, 22 bp, Artificial Sequence
  chemically synthesized
tttttcatggcaaaatagtact

SEQ ID NO: 141491 - DNA, 22 bp, Artificial Sequence
  chemically synthesized
tttcatggcaaaatagtactgt

SEQ ID NO: 141492 - DNA, 22 bp, Artificial Sequence
  chemically synthesized
ttcatggcaaaatagtactgtg

SEQ ID NO: 141493 - DNA, 22 bp, Artificial Sequence
  chemically synthesized
tcatggcaaaatagtactgtgc

SEQ ID NO: 141494 - DNA, 22 bp, Artificial Sequence
  chemically synthesized
catggcaaaatagtactgtgca

SEQ ID NO: 141495 - DNA, 22 bp, Artificial Sequence
  chemically synthesized
atggcaaaatagtactgtgcaa

SEQ ID NO: 141496 - DNA, 22 bp, Artificial Sequence
  chemically synthesized
tgcaaaaatacaattttttaat

SEQ ID NO: 141497 - DNA, 22 bp, Artificial Sequence
  chemically synthesized
tttaatccgttcatctgttgat

SEQ ID NO: 141498 - DNA, 22 bp, Artificial Sequence
  chemically synthesized
ttaatccgttcatctgttgata

SEQ ID NO: 141499 - DNA, 22 bp, Artificial Sequence
  chemically synthesized
taatccgttcatctgttgatag

SEQ ID NO: 141500 - DNA, 22 bp, Artificial Sequence
  chemically synthesized
aatccgttcatctgttgataga

SEQ ID NO: 141501 - DNA, 22 bp, Artificial Sequence
  chemically synthesized
atccgttcatctgttgatagac

SEQ ID NO: 141502 - DNA, 22 bp, Artificial Sequence
  chemically synthesized
atctgttgatagacacttaggt

SEQ ID NO: 141503 - DNA, 22 bp, Artificial Sequence
  chemically synthesized
ttgatagacacttaggttgatc

SEQ ID NO: 141504 - DNA, 22 bp, Artificial Sequence
  chemically synthesized
atagacacttaggttgatccca

SEQ ID NO: 141505 - DNA, 22 bp, Artificial Sequence
  chemically synthesized
aggttgatcccaaaccttaact

SEQ ID NO: 141506 - DNA, 22 bp, Artificial Sequence
  chemically synthesized
ggttgatcccaaaccttaacta

SEQ ID NO: 141507 - DNA, 22 bp, Artificial Sequence
  chemically synthesized
atcccaaaccttaactattgtg

SEQ ID NO: 141508 - DNA, 22 bp, Artificial Sequence
  chemically synthesized
aactattgtgaatagtgcttca

SEQ ID NO: 141509 - DNA, 22 bp, Artificial Sequence
  chemically synthesized
actattgtgaatagtgcttcaa

SEQ ID NO: 141510 - DNA, 22 bp, Artificial Sequence
  chemically synthesized
ttgtgaatagtgcttcaataaa

SEQ ID NO: 141511 - DNA, 22 bp, Artificial Sequence
  chemically synthesized
tgaatagtgcttcaataaacat

SEQ ID NO: 141512 - DNA, 22 bp, Artificial Sequence
  chemically synthesized
caataaacatgagtgtaatgtg

SEQ ID NO: 141513 - DNA, 22 bp, Artificial Sequence
  chemically synthesized
aataaacatgagtgtaatgtgt

SEQ ID NO: 141514 - DNA, 22 bp, Artificial Sequence
  chemically synthesized
gatatactgatttcctttcttt

SEQ ID NO: 141515 - DNA, 22 bp, Artificial Sequence
  chemically synthesized
atttcctttcttttggataaat

SEQ ID NO: 141516 - DNA, 22 bp, Artificial Sequence
  chemically synthesized
cctttcttttggataaataacc

SEQ ID NO: 141517 - DNA, 22 bp, Artificial Sequence
  chemically synthesized
ctttcttttggataaataacca

SEQ ID NO: 141518 - DNA, 22 bp, Artificial Sequence
  chemically synthesized
tcttttggataaataaccacta

SEQ ID NO: 141519 - DNA, 22 bp, Artificial Sequence
  chemically synthesized
cttttggataaataaccactag

SEQ ID NO: 141520 - DNA, 22 bp, Artificial Sequence
  chemically synthesized
ttttggataaataaccactagt

SEQ ID NO: 141521 - DNA, 22 bp, Artificial Sequence
  chemically synthesized
ttggataaataaccactagtga

SEQ ID NO: 141522 - DNA, 22 bp, Artificial Sequence
  chemically synthesized
tggataaataaccactagtgag

SEQ ID NO: 141523 - DNA, 22 bp, Artificial Sequence
  chemically synthesized
ggataaataaccactagtgaga

SEQ ID NO: 141524 - DNA, 22 bp, Artificial Sequence
  chemically synthesized
gataaataaccactagtgagat

SEQ ID NO: 141525 - DNA, 22 bp, Artificial Sequence
  chemically synthesized
gtgagattgctggattgtatga

SEQ ID NO: 141526 - DNA, 22 bp, Artificial Sequence
  chemically synthesized
ctggattgtatgatagttctgt

SEQ ID NO: 141527 - DNA, 22 bp, Artificial Sequence
  chemically synthesized
gattgtatgatagttctgtttt

SEQ ID NO: 141528 - DNA, 22 bp, Artificial Sequence
  chemically synthesized
tatgatagttctgtttttagtt

SEQ ID NO: 141529 - DNA, 22 bp, Artificial Sequence
  chemically synthesized
tgtttttagtttactgagaaat

SEQ ID NO: 141530 - DNA, 22 bp, Artificial Sequence
  chemically synthesized
tttttagtttactgagaaatct

SEQ ID NO: 141531 - DNA, 22 bp, Artificial Sequence
  chemically synthesized
ttagtttactgagaaatcttca

SEQ ID NO: 141532 - DNA, 22 bp, Artificial Sequence
  chemically synthesized
tagtttactgagaaatcttcat

SEQ ID NO: 141533 - DNA, 22 bp, Artificial Sequence
  chemically synthesized
agtttactgagaaatcttcata

SEQ ID NO: 141534 - DNA, 22 bp, Artificial Sequence
  chemically synthesized
gtttactgagaaatcttcatac

SEQ ID NO: 141535 - DNA, 22 bp, Artificial Sequence
  chemically synthesized
actgagaaatcttcatactgtt

SEQ ID NO: 141536 - DNA, 22 bp, Artificial Sequence
  chemically synthesized
ctgagaaatcttcatactgttt

SEQ ID NO: 141537 - DNA, 22 bp, Artificial Sequence
  chemically synthesized
agaaatcttcatactgttttcc

SEQ ID NO: 141538 - DNA, 22 bp, Artificial Sequence
  chemically synthesized
catactgttttccataatggtt

SEQ ID NO: 141539 - DNA, 22 bp, Artificial Sequence
  chemically synthesized
atactgttttccataatggttg

SEQ ID NO: 141540 - DNA, 22 bp, Artificial Sequence
  chemically synthesized
ttttccataatggttgtactat

SEQ ID NO: 141541 - DNA, 22 bp, Artificial Sequence
  chemically synthesized
tccataatggttgtactatttt

SEQ ID NO: 141542 - DNA, 22 bp, Artificial Sequence
  chemically synthesized
ccataatggttgtactatttta

SEQ ID NO: 141543 - DNA, 22 bp, Artificial Sequence
  chemically synthesized
cataatggttgtactattttac

SEQ ID NO: 141544 - DNA, 22 bp, Artificial Sequence
  chemically synthesized
tactattttacattcccaccaa

SEQ ID NO: 141545 - DNA, 22 bp, Artificial Sequence
  chemically synthesized
ttttacattcccaccaacagtg

SEQ ID NO: 141546 - DNA, 22 bp, Artificial Sequence
  chemically synthesized
tacattcccaccaacagtgtgt

SEQ ID NO: 141547 - DNA, 22 bp, Artificial Sequence
  chemically synthesized
acattcccaccaacagtgtgta

SEQ ID NO: 141548 - DNA, 22 bp, Artificial Sequence
  chemically synthesized
cattcccaccaacagtgtgtaa

SEQ ID NO: 141549 - DNA, 22 bp, Artificial Sequence
  chemically synthesized
ccaccaacagtgtgtaagaaag

SEQ ID NO: 141550 - DNA, 22 bp, Artificial Sequence
  chemically synthesized
ccttttctccatatcctcacaa

SEQ ID NO: 141551 - DNA, 22 bp, Artificial Sequence
  chemically synthesized
ttctccatatcctcacaaggat

SEQ ID NO: 141552 - DNA, 22 bp, Artificial Sequence
  chemically synthesized
tctccatatcctcacaaggatc

SEQ ID NO: 141553 - DNA, 22 bp, Artificial Sequence
  chemically synthesized
ctccatatcctcacaaggatct

SEQ ID NO: 141554 - DNA, 22 bp, Artificial Sequence
  chemically synthesized
tccatatcctcacaaggatctg

SEQ ID NO: 141555 - DNA, 22 bp, Artificial Sequence
  chemically synthesized
catatcctcacaaggatctgtt

SEQ ID NO: 141556 - DNA, 22 bp, Artificial Sequence
  chemically synthesized
acaaggatctgttattttttgt

SEQ ID NO: 141557 - DNA, 22 bp, Artificial Sequence
  chemically synthesized
ttattttttgtcttttttgtta

SEQ ID NO: 141558 - DNA, 22 bp, Artificial Sequence
  chemically synthesized
ttttttgtcttttttgttaata

SEQ ID NO: 141559 - DNA, 22 bp, Artificial Sequence
  chemically synthesized
tttgtcttttttgttaatagcc

SEQ ID NO: 141560 - DNA, 22 bp, Artificial Sequence
  chemically synthesized
ttgtcttttttgttaatagccg

SEQ ID NO: 141561 - DNA, 22 bp, Artificial Sequence
  chemically synthesized
tgtcttttttgttaatagccgt

SEQ ID NO: 141562 - DNA, 22 bp, Artificial Sequence
  chemically synthesized
gtcttttttgttaatagccgtt

SEQ ID NO: 141563 - DNA, 22 bp, Artificial Sequence
  chemically synthesized
tcttttttgttaatagccgttt

SEQ ID NO: 141564 - DNA, 22 bp, Artificial Sequence
  chemically synthesized
ttttgttaatagccgttttaac

SEQ ID NO: 141565 - DNA, 22 bp, Artificial Sequence
  chemically synthesized
tttgttaatagccgttttaact

SEQ ID NO: 141566 - DNA, 22 bp, Artificial Sequence
  chemically synthesized
ttgttaatagccgttttaacta

SEQ ID NO: 141567 - DNA, 22 bp, Artificial Sequence
  chemically synthesized
tgttaatagccgttttaactag

SEQ ID NO: 141568 - DNA, 22 bp, Artificial Sequence
  chemically synthesized
gttaatagccgttttaactaga

SEQ ID NO: 141569 - DNA, 22 bp, Artificial Sequence
  chemically synthesized
ttaatagccgttttaactagag

SEQ ID NO: 141570 - DNA, 22 bp, Artificial Sequence
  chemically synthesized
atagccgttttaactagagtaa

SEQ ID NO: 141571 - DNA, 22 bp, Artificial Sequence
  chemically synthesized
taactagagtaagtagatatct

SEQ ID NO: 141572 - DNA, 22 bp, Artificial Sequence
  chemically synthesized
aactagagtaagtagatatctc

SEQ ID NO: 141573 - DNA, 22 bp, Artificial Sequence
  chemically synthesized
actagagtaagtagatatctca

SEQ ID NO: 141574 - DNA, 22 bp, Artificial Sequence
  chemically synthesized
gagtaagtagatatctcattgt

SEQ ID NO: 141575 - DNA, 22 bp, Artificial Sequence
  chemically synthesized
attgtagttttgatttgcattt

SEQ ID NO: 141576 - DNA, 22 bp, Artificial Sequence
  chemically synthesized
tagttttgatttgcatttccct

SEQ ID NO: 141577 - DNA, 22 bp, Artificial Sequence
  chemically synthesized
tgatttgcatttccctgatcat

SEQ ID NO: 141578 - DNA, 22 bp, Artificial Sequence
  chemically synthesized
gatttgcatttccctgatcatt

SEQ ID NO: 141579 - DNA, 22 bp, Artificial Sequence
  chemically synthesized
atttgcatttccctgatcatta

SEQ ID NO: 141580 - DNA, 22 bp, Artificial Sequence
  chemically synthesized
gcatttccctgatcattagtga

SEQ ID NO: 141581 - DNA, 22 bp, Artificial Sequence
  chemically synthesized
catttccctgatcattagtgat

SEQ ID NO: 141582 - DNA, 22 bp, Artificial Sequence
  chemically synthesized
ccctgatcattagtgatgttga

SEQ ID NO: 141583 - DNA, 22 bp, Artificial Sequence
  chemically synthesized
cctgatcattagtgatgttgag

SEQ ID NO: 141584 - DNA, 22 bp, Artificial Sequence
  chemically synthesized
atcattagtgatgttgagaatt

SEQ ID NO: 141585 - DNA, 22 bp, Artificial Sequence
  chemically synthesized
gtgatgttgagaattttttcat

SEQ ID NO: 141586 - DNA, 22 bp, Artificial Sequence
  chemically synthesized
agaattttttcatatgtttgtt

SEQ ID NO: 141587 - DNA, 22 bp, Artificial Sequence
  chemically synthesized
tttcatatgtttgttggtcatt

SEQ ID NO: 141588 - DNA, 22 bp, Artificial Sequence
  chemically synthesized
ttcatatgtttgttggtcattt

SEQ ID NO: 141589 - DNA, 22 bp, Artificial Sequence
  chemically synthesized
tcatatgtttgttggtcatttg

SEQ ID NO: 141590 - DNA, 22 bp, Artificial Sequence
  chemically synthesized
catatgtttgttggtcatttgt

SEQ ID NO: 141591 - DNA, 22 bp, Artificial Sequence
  chemically synthesized
atatgtttgttggtcatttgta

SEQ ID NO: 141592 - DNA, 22 bp, Artificial Sequence
  chemically synthesized
gttggtcatttgtatatctttt

SEQ ID NO: 141593 - DNA, 22 bp, Artificial Sequence
  chemically synthesized
ttggtcatttgtatatcttttt

SEQ ID NO: 141594 - DNA, 22 bp, Artificial Sequence
  chemically synthesized
gtcatttgtatatctttttctg

SEQ ID NO: 141595 - DNA, 22 bp, Artificial Sequence
  chemically synthesized
gtatatctttttctgagaattg

SEQ ID NO: 141596 - DNA, 22 bp, Artificial Sequence
  chemically synthesized
tatatctttttctgagaattgt

SEQ ID NO: 141597 - DNA, 22 bp, Artificial Sequence
  chemically synthesized
tttctgagaattgtctgttcat

SEQ ID NO: 141598 - DNA, 22 bp, Artificial Sequence
  chemically synthesized
ttctgagaattgtctgttcatg

SEQ ID NO: 141599 - DNA, 22 bp, Artificial Sequence
  chemically synthesized
tctgagaattgtctgttcatgt

SEQ ID NO: 141600 - DNA, 22 bp, Artificial Sequence
  chemically synthesized
ctgagaattgtctgttcatgtc

SEQ ID NO: 141601 - DNA, 22 bp, Artificial Sequence
  chemically synthesized
tgagaattgtctgttcatgtcc

SEQ ID NO: 141602 - DNA, 22 bp, Artificial Sequence
  chemically synthesized
agaattgtctgttcatgtcctt

SEQ ID NO: 141603 - DNA, 22 bp, Artificial Sequence
  chemically synthesized
tctgttcatgtccttagcctac

SEQ ID NO: 141604 - DNA, 22 bp, Artificial Sequence
  chemically synthesized
ttcatgtccttagcctactttt

SEQ ID NO: 141605 - DNA, 22 bp, Artificial Sequence
  chemically synthesized
atgtccttagcctactttttat

SEQ ID NO: 141606 - DNA, 22 bp, Artificial Sequence
  chemically synthesized
agcctactttttattgggattg

SEQ ID NO: 141607 - DNA, 22 bp, Artificial Sequence
  chemically synthesized
gcctactttttattgggattgt

SEQ ID NO: 141608 - DNA, 22 bp, Artificial Sequence
  chemically synthesized
ctttttattgggattgtttgtt

SEQ ID NO: 141609 - DNA, 22 bp, Artificial Sequence
  chemically synthesized
tttattgggattgtttgttatt

SEQ ID NO: 141610 - DNA, 22 bp, Artificial Sequence
  chemically synthesized
ttattgggattgtttgttattt

SEQ ID NO: 141611 - DNA, 22 bp, Artificial Sequence
  chemically synthesized
tattgggattgtttgttatttt

SEQ ID NO: 141612 - DNA, 22 bp, Artificial Sequence
  chemically synthesized
attgggattgtttgttattttc

SEQ ID NO: 141613 - DNA, 22 bp, Artificial Sequence
  chemically synthesized
ttgggattgtttgttattttct

SEQ ID NO: 141614 - DNA, 22 bp, Artificial Sequence
  chemically synthesized
ggattgtttgttattttcttga

SEQ ID NO: 141615 - DNA, 22 bp, Artificial Sequence
  chemically synthesized
tttgttattttcttgataatct

SEQ ID NO: 141616 - DNA, 22 bp, Artificial Sequence
  chemically synthesized
gttattttcttgataatctatt

SEQ ID NO: 141617 - DNA, 22 bp, Artificial Sequence
  chemically synthesized
ttattttcttgataatctattt

SEQ ID NO: 141618 - DNA, 22 bp, Artificial Sequence
  chemically synthesized
ttttcttgataatctatttgtg

SEQ ID NO: 141619 - DNA, 22 bp, Artificial Sequence
  chemically synthesized
tcttgataatctatttgtgttc

SEQ ID NO: 141620 - DNA, 22 bp, Artificial Sequence
  chemically synthesized
cttgataatctatttgtgttca

SEQ ID NO: 141621 - DNA, 22 bp, Artificial Sequence
  chemically synthesized
ttgataatctatttgtgttcat

SEQ ID NO: 141622 - DNA, 22 bp, Artificial Sequence
  chemically synthesized
gataatctatttgtgttcattt

SEQ ID NO: 141623 - DNA, 22 bp, Artificial Sequence
  chemically synthesized
ataatctatttgtgttcatttt

SEQ ID NO: 141624 - DNA, 22 bp, Artificial Sequence
  chemically synthesized
tttgtgttcattttagagcctg

SEQ ID NO: 141625 - DNA, 22 bp, Artificial Sequence
  chemically synthesized
gtgttcattttagagcctggat

SEQ ID NO: 141626 - DNA, 22 bp, Artificial Sequence
  chemically synthesized
tgttcattttagagcctggata

SEQ ID NO: 141627 - DNA, 22 bp, Artificial Sequence
  chemically synthesized
attttagagcctggatattatt

SEQ ID NO: 141628 - DNA, 22 bp, Artificial Sequence
  chemically synthesized
tagagcctggatattattcttt

SEQ ID NO: 141629 - DNA, 22 bp, Artificial Sequence
  chemically synthesized
agagcctggatattattctttt

SEQ ID NO: 141630 - DNA, 22 bp, Artificial Sequence
  chemically synthesized
gagcctggatattattcttttg

SEQ ID NO: 141631 - DNA, 22 bp, Artificial Sequence
  chemically synthesized
gatattattcttttgtcagatg

SEQ ID NO: 141632 - DNA, 22 bp, Artificial Sequence
  chemically synthesized
ttcttttgtcagatgtatagat

SEQ ID NO: 141633 - DNA, 22 bp, Artificial Sequence
  chemically synthesized
ttttgtcagatgtatagattgt

SEQ ID NO: 141634 - DNA, 22 bp, Artificial Sequence
  chemically synthesized
ttgtcagatgtatagattgtga

SEQ ID NO: 141635 - DNA, 22 bp, Artificial Sequence
  chemically synthesized
tgtcagatgtatagattgtgaa

SEQ ID NO: 141636 - DNA, 22 bp, Artificial Sequence
  chemically synthesized
gtcagatgtatagattgtgaag

SEQ ID NO: 141637 - DNA, 22 bp, Artificial Sequence
  chemically synthesized
tcagatgtatagattgtgaaga

SEQ ID NO: 141638 - DNA, 22 bp, Artificial Sequence
  chemically synthesized
tgaagattttctcccactctgt

SEQ ID NO: 141639 - DNA, 22 bp, Artificial Sequence
  chemically synthesized
tctcccactctgtgggttgtct

SEQ ID NO: 141640 - DNA, 22 bp, Artificial Sequence
  chemically synthesized
ctcccactctgtgggttgtctg

SEQ ID NO: 141641 - DNA, 22 bp, Artificial Sequence
  chemically synthesized
tcccactctgtgggttgtctgt

SEQ ID NO: 141642 - DNA, 22 bp, Artificial Sequence
  chemically synthesized
ccactctgtgggttgtctgttt

SEQ ID NO: 141643 - DNA, 22 bp, Artificial Sequence
  chemically synthesized
tgtgggttgtctgtttattctg

SEQ ID NO: 141644 - DNA, 22 bp, Artificial Sequence
  chemically synthesized
tgggttgtctgtttattctgca

SEQ ID NO: 141645 - DNA, 22 bp, Artificial Sequence
  chemically synthesized
tctgtttattctgcagactctt

SEQ ID NO: 141646 - DNA, 22 bp, Artificial Sequence
  chemically synthesized
tttattctgcagactcttcctt

SEQ ID NO: 141647 - DNA, 22 bp, Artificial Sequence
  chemically synthesized
attctgcagactcttccttttg

SEQ ID NO: 141648 - DNA, 22 bp, Artificial Sequence
  chemically synthesized
ttctgcagactcttccttttgc

SEQ ID NO: 141649 - DNA, 22 bp, Artificial Sequence
  chemically synthesized
tgcagactcttccttttgccat

SEQ ID NO: 141650 - DNA, 22 bp, Artificial Sequence
  chemically synthesized
cagactcttccttttgccatgc

SEQ ID NO: 141651 - DNA, 22 bp, Artificial Sequence
  chemically synthesized
ttccttttgccatgcaaaagct

SEQ ID NO: 141652 - DNA, 22 bp, Artificial Sequence
  chemically synthesized
ccttttgccatgcaaaagctct

SEQ ID NO: 141653 - DNA, 22 bp, Artificial Sequence
  chemically synthesized
cttttgccatgcaaaagctctt

SEQ ID NO: 141654 - DNA, 22 bp, Artificial Sequence
  chemically synthesized
ttgccatgcaaaagctctttag

SEQ ID NO: 141655 - DNA, 22 bp, Artificial Sequence
  chemically synthesized
tgccatgcaaaagctctttagt

SEQ ID NO: 141656 - DNA, 22 bp, Artificial Sequence
  chemically synthesized
gccatgcaaaagctctttagtt

SEQ ID NO: 141657 - DNA, 22 bp, Artificial Sequence
  chemically synthesized
ccatgcaaaagctctttagttt

SEQ ID NO: 141658 - DNA, 22 bp, Artificial Sequence
  chemically synthesized
tttagtttaatttagtcccaga

SEQ ID NO: 141659 - DNA, 22 bp, Artificial Sequence
  chemically synthesized
tagtttaatttagtcccagata

SEQ ID NO: 141660 - DNA, 22 bp, Artificial Sequence
  chemically synthesized
agtttaatttagtcccagatat

SEQ ID NO: 141661 - DNA, 22 bp, Artificial Sequence
  chemically synthesized
gtttaatttagtcccagatatt

SEQ ID NO: 141662 - DNA, 22 bp, Artificial Sequence
  chemically synthesized
aatttagtcccagatattttct

SEQ ID NO: 141663 - DNA, 22 bp, Artificial Sequence
  chemically synthesized
atttagtcccagatattttctt

SEQ ID NO: 141664 - DNA, 22 bp, Artificial Sequence
  chemically synthesized
agtcccagatattttctttgtt

SEQ ID NO: 141665 - DNA, 22 bp, Artificial Sequence
  chemically synthesized
gtcccagatattttctttgttt

SEQ ID NO: 141666 - DNA, 22 bp, Artificial Sequence
  chemically synthesized
tctttgtttttatgtatttgca

SEQ ID NO: 141667 - DNA, 22 bp, Artificial Sequence
  chemically synthesized
ctttgtttttatgtatttgcat

SEQ ID NO: 141668 - DNA, 22 bp, Artificial Sequence
  chemically synthesized
tttgtttttatgtatttgcatt

SEQ ID NO: 141669 - DNA, 22 bp, Artificial Sequence
  chemically synthesized
tgtttttatgtatttgcatttg

SEQ ID NO: 141670 - DNA, 22 bp, Artificial Sequence
  chemically synthesized
gtttttatgtatttgcatttgt

SEQ ID NO: 141671 - DNA, 22 bp, Artificial Sequence
  chemically synthesized
tttttatgtatttgcatttgtg

SEQ ID NO: 141672 - DNA, 22 bp, Artificial Sequence
  chemically synthesized
ttatgtatttgcatttgtgttc

SEQ ID NO: 141673 - DNA, 22 bp, Artificial Sequence
  chemically synthesized
tatgtatttgcatttgtgttct

SEQ ID NO: 141674 - DNA, 22 bp, Artificial Sequence
  chemically synthesized
atgtatttgcatttgtgttctt

SEQ ID NO: 141675 - DNA, 22 bp, Artificial Sequence
  chemically synthesized
tgtatttgcatttgtgttcttg

SEQ ID NO: 141676 - DNA, 22 bp, Artificial Sequence
  chemically synthesized
gcatttgtgttcttggtcatga

SEQ ID NO: 141677 - DNA, 22 bp, Artificial Sequence
  chemically synthesized
catttgtgttcttggtcatgaa

SEQ ID NO: 141678 - DNA, 22 bp, Artificial Sequence
  chemically synthesized
gtgttcttggtcatgaaatcct

SEQ ID NO: 141679 - DNA, 22 bp, Artificial Sequence
  chemically synthesized
tgttcttggtcatgaaatcctt

SEQ ID NO: 141680 - DNA, 22 bp, Artificial Sequence
  chemically synthesized
ttggtcatgaaatcctttccta

SEQ ID NO: 141681 - DNA, 22 bp, Artificial Sequence
  chemically synthesized
ggtcatgaaatcctttcctaag

SEQ ID NO: 141682 - DNA, 22 bp, Artificial Sequence
  chemically synthesized
gtcatgaaatcctttcctaagc

SEQ ID NO: 141683 - DNA, 22 bp, Artificial Sequence
  chemically synthesized
tcctaagccaatgtgtagaagg

SEQ ID NO: 141684 - DNA, 22 bp, Artificial Sequence
  chemically synthesized
cctaagccaatgtgtagaaggg

SEQ ID NO: 141685 - DNA, 22 bp, Artificial Sequence
  chemically synthesized
ctaagccaatgtgtagaagggt

SEQ ID NO: 141686 - DNA, 22 bp, Artificial Sequence
  chemically synthesized
agccaatgtgtagaagggtttt

SEQ ID NO: 141687 - DNA, 22 bp, Artificial Sequence
  chemically synthesized
ttccgatgttattttctagaat

SEQ ID NO: 141688 - DNA, 22 bp, Artificial Sequence
  chemically synthesized
tccgatgttattttctagaatt

SEQ ID NO: 141689 - DNA, 22 bp, Artificial Sequence
  chemically synthesized
ccgatgttattttctagaattg

SEQ ID NO: 141690 - DNA, 22 bp, Artificial Sequence
  chemically synthesized
cgatgttattttctagaattgt

SEQ ID NO: 141691 - DNA, 22 bp, Artificial Sequence
  chemically synthesized
ttttctagaattgttacagttt

SEQ ID NO: 141692 - DNA, 22 bp, Artificial Sequence
  chemically synthesized
tctagaattgttacagtttcag

SEQ ID NO: 141693 - DNA, 22 bp, Artificial Sequence
  chemically synthesized
ctagaattgttacagtttcagg

SEQ ID NO: 141694 - DNA, 22 bp, Artificial Sequence
  chemically synthesized
tagaattgttacagtttcaggg

SEQ ID NO: 141695 - DNA, 22 bp, Artificial Sequence
  chemically synthesized
gaattgttacagtttcagggct

SEQ ID NO: 141696 - DNA, 22 bp, Artificial Sequence
  chemically synthesized
ttacagtttcagggcttagatt

SEQ ID NO: 141697 - DNA, 22 bp, Artificial Sequence
  chemically synthesized
cagtttcagggcttagatttaa

SEQ ID NO: 141698 - DNA, 22 bp, Artificial Sequence
  chemically synthesized
cagggcttagatttaagtcctt

SEQ ID NO: 141699 - DNA, 22 bp, Artificial Sequence
  chemically synthesized
agggcttagatttaagtccttg

SEQ ID NO: 141700 - DNA, 22 bp, Artificial Sequence
  chemically synthesized
agatttaagtccttgatccatc

SEQ ID NO: 141701 - DNA, 22 bp, Artificial Sequence
  chemically synthesized
gatttaagtccttgatccatct

SEQ ID NO: 141702 - DNA, 22 bp, Artificial Sequence
  chemically synthesized
aagtccttgatccatcttgagt

SEQ ID NO: 141703 - DNA, 22 bp, Artificial Sequence
  chemically synthesized
agtccttgatccatcttgagtt

SEQ ID NO: 141704 - DNA, 22 bp, Artificial Sequence
  chemically synthesized
gatccatcttgagttgattttt

SEQ ID NO: 141705 - DNA, 22 bp, Artificial Sequence
  chemically synthesized
atccatcttgagttgatttttg

SEQ ID NO: 141706 - DNA, 22 bp, Artificial Sequence
  chemically synthesized
gagttgatttttgtataaggtg

SEQ ID NO: 141707 - DNA, 22 bp, Artificial Sequence
  chemically synthesized
agttgatttttgtataaggtga

SEQ ID NO: 141708 - DNA, 22 bp, Artificial Sequence
  chemically synthesized
atttttgtataaggtgagagat

SEQ ID NO: 141709 - DNA, 22 bp, Artificial Sequence
  chemically synthesized
ttgtataaggtgagagatgaag

SEQ ID NO: 141710 - DNA, 22 bp, Artificial Sequence
  chemically synthesized
tgtataaggtgagagatgaaga

SEQ ID NO: 141711 - DNA, 22 bp, Artificial Sequence
  chemically synthesized
gtataaggtgagagatgaagat

SEQ ID NO: 141712 - DNA, 22 bp, Artificial Sequence
  chemically synthesized
tataaggtgagagatgaagatc

SEQ ID NO: 141713 - DNA, 22 bp, Artificial Sequence
  chemically synthesized
cattctcctacatgtagcttgc

SEQ ID NO: 141714 - DNA, 22 bp, Artificial Sequence
  chemically synthesized
attctcctacatgtagcttgcc

SEQ ID NO: 141715 - DNA, 22 bp, Artificial Sequence
  chemically synthesized
tcctacatgtagcttgccagct

SEQ ID NO: 141716 - DNA, 22 bp, Artificial Sequence
  chemically synthesized
ctacatgtagcttgccagctat

SEQ ID NO: 141717 - DNA, 22 bp, Artificial Sequence
  chemically synthesized
catgtagcttgccagctatccc

SEQ ID NO: 141718 - DNA, 22 bp, Artificial Sequence
  chemically synthesized
gccagctatccccgcaccattt

SEQ ID NO: 141719 - DNA, 22 bp, Artificial Sequence
  chemically synthesized
ccagctatccccgcaccatttg

SEQ ID NO: 141720 - DNA, 22 bp, Artificial Sequence
  chemically synthesized
tccccgcaccatttgttgaata

SEQ ID NO: 141721 - DNA, 22 bp, Artificial Sequence
  chemically synthesized
gttgaatagggtgccctttccc

SEQ ID NO: 141722 - DNA, 22 bp, Artificial Sequence
  chemically synthesized
ttgaatagggtgccctttcccc

SEQ ID NO: 141723 - DNA, 22 bp, Artificial Sequence
  chemically synthesized
aatagggtgccctttccccact

SEQ ID NO: 141724 - DNA, 22 bp, Artificial Sequence
  chemically synthesized
tccccactttatgtttttgttt

SEQ ID NO: 141725 - DNA, 22 bp, Artificial Sequence
  chemically synthesized
ccccactttatgtttttgtttg

SEQ ID NO: 141726 - DNA, 22 bp, Artificial Sequence
  chemically synthesized
cccactttatgtttttgtttgc

SEQ ID NO: 141727 - DNA, 22 bp, Artificial Sequence
  chemically synthesized
tatgtttttgtttgctttgtca

SEQ ID NO: 141728 - DNA, 22 bp, Artificial Sequence
  chemically synthesized
atgtttttgtttgctttgtcaa

SEQ ID NO: 141729 - DNA, 22 bp, Artificial Sequence
  chemically synthesized
tgtttttgtttgctttgtcaaa

SEQ ID NO: 141730 - DNA, 22 bp, Artificial Sequence
  chemically synthesized
ttgtttgctttgtcaaagatca

SEQ ID NO: 141731 - DNA, 22 bp, Artificial Sequence
  chemically synthesized
tgtttgctttgtcaaagatcag

SEQ ID NO: 141732 - DNA, 22 bp, Artificial Sequence
  chemically synthesized
gtttgctttgtcaaagatcagt

SEQ ID NO: 141733 - DNA, 22 bp, Artificial Sequence
  chemically synthesized
tttgctttgtcaaagatcagtt

SEQ ID NO: 141734 - DNA, 22 bp, Artificial Sequence
  chemically synthesized
gctttgtcaaagatcagttgga

SEQ ID NO: 141735 - DNA, 22 bp, Artificial Sequence
  chemically synthesized
ctttgtcaaagatcagttggat

SEQ ID NO: 141736 - DNA, 22 bp, Artificial Sequence
  chemically synthesized
tgtcaaagatcagttggatgta

SEQ ID NO: 141737 - DNA, 22 bp, Artificial Sequence
  chemically synthesized
gtcaaagatcagttggatgtaa

SEQ ID NO: 141738 - DNA, 22 bp, Artificial Sequence
  chemically synthesized
tcaaagatcagttggatgtaag

SEQ ID NO: 141739 - DNA, 22 bp, Artificial Sequence
  chemically synthesized
gatgtaagtatttgagtttatt

SEQ ID NO: 141740 - DNA, 22 bp, Artificial Sequence
  chemically synthesized
gagtttatttctgggttctcta

SEQ ID NO: 141741 - DNA, 22 bp, Artificial Sequence
  chemically synthesized
agtttatttctgggttctctat

SEQ ID NO: 141742 - DNA, 22 bp, Artificial Sequence
  chemically synthesized
atttctgggttctctattctgt

SEQ ID NO: 141743 - DNA, 22 bp, Artificial Sequence
  chemically synthesized
tttctgggttctctattctgtt

SEQ ID NO: 141744 - DNA, 22 bp, Artificial Sequence
  chemically synthesized
ctgggttctctattctgttcca

SEQ ID NO: 141745 - DNA, 22 bp, Artificial Sequence
  chemically synthesized
tgggttctctattctgttccat

SEQ ID NO: 141746 - DNA, 22 bp, Artificial Sequence
  chemically synthesized
ggttctctattctgttccattg

SEQ ID NO: 141747 - DNA, 22 bp, Artificial Sequence
  chemically synthesized
tctattctgttccattggtcga

SEQ ID NO: 141748 - DNA, 22 bp, Artificial Sequence
  chemically synthesized
tattctgttccattggtcgatg

SEQ ID NO: 141749 - DNA, 22 bp, Artificial Sequence
  chemically synthesized
ttctgttccattggtcgatgtg

SEQ ID NO: 141750 - DNA, 22 bp, Artificial Sequence
  chemically synthesized
tgttccattggtcgatgtgcct

SEQ ID NO: 141751 - DNA, 22 bp, Artificial Sequence
  chemically synthesized
ttccattggtcgatgtgcctat

SEQ ID NO: 141752 - DNA, 22 bp, Artificial Sequence
  chemically synthesized
cattggtcgatgtgcctatttg

SEQ ID NO: 141753 - DNA, 22 bp, Artificial Sequence
  chemically synthesized
gtcgatgtgcctatttgtacac

SEQ ID NO: 141754 - DNA, 22 bp, Artificial Sequence
  chemically synthesized
tttgtacaccagcatcatgctg

SEQ ID NO: 141755 - DNA, 22 bp, Artificial Sequence
  chemically synthesized
gtacaccagcatcatgctgttt

SEQ ID NO: 141756 - DNA, 22 bp, Artificial Sequence
  chemically synthesized
tacaccagcatcatgctgtttt

SEQ ID NO: 141757 - DNA, 22 bp, Artificial Sequence
  chemically synthesized
ttttggtgactatggccttatt

SEQ ID NO: 141758 - DNA, 22 bp, Artificial Sequence
  chemically synthesized
tggtgactatggccttattgta

SEQ ID NO: 141759 - DNA, 22 bp, Artificial Sequence
  chemically synthesized
ggtgactatggccttattgtat

SEQ ID NO: 141760 - DNA, 22 bp, Artificial Sequence
  chemically synthesized
gtgactatggccttattgtata

SEQ ID NO: 141761 - DNA, 22 bp, Artificial Sequence
  chemically synthesized
tggccttattgtatagtttgaa

SEQ ID NO: 141762 - DNA, 22 bp, Artificial Sequence
  chemically synthesized
attgtatagtttgaaatgaggt

SEQ ID NO: 141763 - DNA, 22 bp, Artificial Sequence
  chemically synthesized
ttgtatagtttgaaatgaggta

SEQ ID NO: 141764 - DNA, 22 bp, Artificial Sequence
  chemically synthesized
tatagtttgaaatgaggtaatg

SEQ ID NO: 141765 - DNA, 22 bp, Artificial Sequence
  chemically synthesized
gaaatgaggtaatgtaatgcct

SEQ ID NO: 141766 - DNA, 22 bp, Artificial Sequence
  chemically synthesized
aaatgaggtaatgtaatgcctt

SEQ ID NO: 141767 - DNA, 22 bp, Artificial Sequence
  chemically synthesized
cagatttgttcttttttttaga

SEQ ID NO: 141768 - DNA, 22 bp, Artificial Sequence
  chemically synthesized
agatttgttcttttttttagac

SEQ ID NO: 141769 - DNA, 22 bp, Artificial Sequence
  chemically synthesized
gttcttttttttagacttgctt

SEQ ID NO: 141770 - DNA, 22 bp, Artificial Sequence
  chemically synthesized
ttcttttttttagacttgcttg

SEQ ID NO: 141771 - DNA, 22 bp, Artificial Sequence
  chemically synthesized
ttttttttagacttgcttgttt

SEQ ID NO: 141772 - DNA, 22 bp, Artificial Sequence
  chemically synthesized
ttttttagacttgcttgtttat

SEQ ID NO: 141773 - DNA, 22 bp, Artificial Sequence
  chemically synthesized
tttttagacttgcttgtttatt

SEQ ID NO: 141774 - DNA, 22 bp, Artificial Sequence
  chemically synthesized
ttttagacttgcttgtttattg

SEQ ID NO: 141775 - DNA, 22 bp, Artificial Sequence
  chemically synthesized
tttagacttgcttgtttattgg

SEQ ID NO: 141776 - DNA, 22 bp, Artificial Sequence
  chemically synthesized
ttagacttgcttgtttattggg

SEQ ID NO: 141777 - DNA, 22 bp, Artificial Sequence
  chemically synthesized
tagacttgcttgtttattgggc

SEQ ID NO: 141778 - DNA, 22 bp, Artificial Sequence
  chemically synthesized
agacttgcttgtttattgggct

SEQ ID NO: 141779 - DNA, 22 bp, Artificial Sequence
  chemically synthesized
gacttgcttgtttattgggctc

SEQ ID NO: 141780 - DNA, 22 bp, Artificial Sequence
  chemically synthesized
gcttgtttattgggctcttttt

SEQ ID NO: 141781 - DNA, 22 bp, Artificial Sequence
  chemically synthesized
cttgtttattgggctctttttt

SEQ ID NO: 141782 - DNA, 22 bp, Artificial Sequence
  chemically synthesized
gtttattgggctcttttttggt

SEQ ID NO: 141783 - DNA, 22 bp, Artificial Sequence
  chemically synthesized
tttattgggctcttttttggtt

SEQ ID NO: 141784 - DNA, 22 bp, Artificial Sequence
  chemically synthesized
attgggctcttttttggttcca

SEQ ID NO: 141785 - DNA, 22 bp, Artificial Sequence
  chemically synthesized
ttgggctcttttttggttccat

SEQ ID NO: 141786 - DNA, 22 bp, Artificial Sequence
  chemically synthesized
ggctcttttttggttccataag

SEQ ID NO: 141787 - DNA, 22 bp, Artificial Sequence
  chemically synthesized
ttttttggttccataagaattt

SEQ ID NO: 141788 - DNA, 22 bp, Artificial Sequence
  chemically synthesized
ttttggttccataagaatttta

SEQ ID NO: 141789 - DNA, 22 bp, Artificial Sequence
  chemically synthesized
tttggttccataagaattttag

SEQ ID NO: 141790 - DNA, 22 bp, Artificial Sequence
  chemically synthesized
ttggttccataagaattttagg

SEQ ID NO: 141791 - DNA, 22 bp, Artificial Sequence
  chemically synthesized
tggttccataagaattttagga

SEQ ID NO: 141792 - DNA, 22 bp, Artificial Sequence
  chemically synthesized
ggttccataagaattttaggat

SEQ ID NO: 141793 - DNA, 22 bp, Artificial Sequence
  chemically synthesized
gttccataagaattttaggatt

SEQ ID NO: 141794 - DNA, 22 bp, Artificial Sequence
  chemically synthesized
cataagaattttaggattgttt

SEQ ID NO: 141795 - DNA, 22 bp, Artificial Sequence
  chemically synthesized
taggattgttttttctagttct

SEQ ID NO: 141796 - DNA, 22 bp, Artificial Sequence
  chemically synthesized
aggattgttttttctagttctg

SEQ ID NO: 141797 - DNA, 22 bp, Artificial Sequence
  chemically synthesized
ggattgttttttctagttctgt

SEQ ID NO: 141798 - DNA, 22 bp, Artificial Sequence
  chemically synthesized
ttttttctagttctgtgaagac

SEQ ID NO: 141799 - DNA, 22 bp, Artificial Sequence
  chemically synthesized
tttctagttctgtgaagactaa

SEQ ID NO: 141800 - DNA, 22 bp, Artificial Sequence
  chemically synthesized
ttctagttctgtgaagactaat

SEQ ID NO: 141801 - DNA, 22 bp, Artificial Sequence
  chemically synthesized
tctagttctgtgaagactaatg

SEQ ID NO: 141802 - DNA, 22 bp, Artificial Sequence
  chemically synthesized
ctagttctgtgaagactaatgg

SEQ ID NO: 141803 - DNA, 22 bp, Artificial Sequence
  chemically synthesized
tagttctgtgaagactaatggt

SEQ ID NO: 141804 - DNA, 22 bp, Artificial Sequence
  chemically synthesized
gttctgtgaagactaatggtgg

SEQ ID NO: 141805 - DNA, 22 bp, Artificial Sequence
  chemically synthesized
tgtgaagactaatggtggtatt

SEQ ID NO: 141806 - DNA, 22 bp, Artificial Sequence
  chemically synthesized
tgaagactaatggtggtatttt

SEQ ID NO: 141807 - DNA, 22 bp, Artificial Sequence
  chemically synthesized
atggtggtattttgatgggaat

SEQ ID NO: 141808 - DNA, 22 bp, Artificial Sequence
  chemically synthesized
tgatgggaattgcaatgaattt

SEQ ID NO: 141809 - DNA, 22 bp, Artificial Sequence
  chemically synthesized
gatgggaattgcaatgaatttg

SEQ ID NO: 141810 - DNA, 22 bp, Artificial Sequence
  chemically synthesized
atgggaattgcaatgaatttgt

SEQ ID NO: 141811 - DNA, 22 bp, Artificial Sequence
  chemically synthesized
caatgaatttgtaggttgcttc

SEQ ID NO: 141812 - DNA, 22 bp, Artificial Sequence
  chemically synthesized
gtaggttgcttctggcattatg

SEQ ID NO: 141813 - DNA, 22 bp, Artificial Sequence
  chemically synthesized
taggttgcttctggcattatgg

SEQ ID NO: 141814 - DNA, 22 bp, Artificial Sequence
  chemically synthesized
cttctggcattatggccatttt

SEQ ID NO: 141815 - DNA, 22 bp, Artificial Sequence
  chemically synthesized
ctggcattatggccattttcac

SEQ ID NO: 141816 - DNA, 22 bp, Artificial Sequence
  chemically synthesized
tggcattatggccattttcaca

SEQ ID NO: 141817 - DNA, 22 bp, Artificial Sequence
  chemically synthesized
gcattatggccattttcacaat

SEQ ID NO: 141818 - DNA, 22 bp, Artificial Sequence
  chemically synthesized
tggccattttcacaatattgat

SEQ ID NO: 141819 - DNA, 22 bp, Artificial Sequence
  chemically synthesized
tcacaatattgattctacccat

SEQ ID NO: 141820 - DNA, 22 bp, Artificial Sequence
  chemically synthesized
cacaatattgattctacccatc

SEQ ID NO: 141821 - DNA, 22 bp, Artificial Sequence
  chemically synthesized
acaatattgattctacccatct

SEQ ID NO: 141822 - DNA, 22 bp, Artificial Sequence
  chemically synthesized
attctacccatctatgagaatg

SEQ ID NO: 141823 - DNA, 22 bp, Artificial Sequence
  chemically synthesized
tacccatctatgagaatggcat

SEQ ID NO: 141824 - DNA, 22 bp, Artificial Sequence
  chemically synthesized
cccatctatgagaatggcatgt

SEQ ID NO: 141825 - DNA, 22 bp, Artificial Sequence
  chemically synthesized
tgagaatggcatgtgtttccat

SEQ ID NO: 141826 - DNA, 22 bp, Artificial Sequence
  chemically synthesized
ccatttgtttgtgtcttatatg

SEQ ID NO: 141827 - DNA, 22 bp, Artificial Sequence
  chemically synthesized
catttgtttgtgtcttatatga

SEQ ID NO: 141828 - DNA, 22 bp, Artificial Sequence
  chemically synthesized
gtttgtgtcttatatgattact

SEQ ID NO: 141829 - DNA, 22 bp, Artificial Sequence
  chemically synthesized
tttgtgtcttatatgattactt

SEQ ID NO: 141830 - DNA, 22 bp, Artificial Sequence
  chemically synthesized
gtgtcttatatgattactttca

SEQ ID NO: 141831 - DNA, 22 bp, Artificial Sequence
  chemically synthesized
tgtcttatatgattactttcag

SEQ ID NO: 141832 - DNA, 22 bp, Artificial Sequence
  chemically synthesized
atatgattactttcagccgtgt

SEQ ID NO: 141833 - DNA, 22 bp, Artificial Sequence
  chemically synthesized
tatgattactttcagccgtgtt

SEQ ID NO: 141834 - DNA, 22 bp, Artificial Sequence
  chemically synthesized
ctttcagccgtgttttgtagtt

SEQ ID NO: 141835 - DNA, 22 bp, Artificial Sequence
  chemically synthesized
tcagccgtgttttgtagttttc

SEQ ID NO: 141836 - DNA, 22 bp, Artificial Sequence
  chemically synthesized
cagccgtgttttgtagttttcc

SEQ ID NO: 141837 - DNA, 22 bp, Artificial Sequence
  chemically synthesized
agccgtgttttgtagttttcct

SEQ ID NO: 141838 - DNA, 22 bp, Artificial Sequence
  chemically synthesized
tgtagttttccttgtagatgtc

SEQ ID NO: 141839 - DNA, 22 bp, Artificial Sequence
  chemically synthesized
gtagttttccttgtagatgtct

SEQ ID NO: 141840 - DNA, 22 bp, Artificial Sequence
  chemically synthesized
tagttttccttgtagatgtctt

SEQ ID NO: 141841 - DNA, 22 bp, Artificial Sequence
  chemically synthesized
tccttgtagatgtctttcacct

SEQ ID NO: 141842 - DNA, 22 bp, Artificial Sequence
  chemically synthesized
ccttgtagatgtctttcacctc

SEQ ID NO: 141843 - DNA, 22 bp, Artificial Sequence
  chemically synthesized
cttgtagatgtctttcacctcc

SEQ ID NO: 141844 - DNA, 22 bp, Artificial Sequence
  chemically synthesized
gtagatgtctttcacctccttg

SEQ ID NO: 141845 - DNA, 22 bp, Artificial Sequence
  chemically synthesized
tagatgtctttcacctccttgg

SEQ ID NO: 141846 - DNA, 22 bp, Artificial Sequence
  chemically synthesized
tcacctccttggttaggtatat

SEQ ID NO: 141847 - DNA, 22 bp, Artificial Sequence
  chemically synthesized
cacctccttggttaggtatata

SEQ ID NO: 141848 - DNA, 22 bp, Artificial Sequence
  chemically synthesized
acctccttggttaggtatatat

SEQ ID NO: 141849 - DNA, 22 bp, Artificial Sequence
  chemically synthesized
cttggttaggtatatattccta

SEQ ID NO: 141850 - DNA, 22 bp, Artificial Sequence
  chemically synthesized
ggttaggtatatattcctaagt

SEQ ID NO: 141851 - DNA, 22 bp, Artificial Sequence
  chemically synthesized
gttaggtatatattcctaagtt

SEQ ID NO: 141852 - DNA, 22 bp, Artificial Sequence
  chemically synthesized
ggtatatattcctaagtttttg

SEQ ID NO: 141853 - DNA, 22 bp, Artificial Sequence
  chemically synthesized
ctaagtttttgttttgttttgt

SEQ ID NO: 141854 - DNA, 22 bp, Artificial Sequence
  chemically synthesized
agtttttgttttgttttgtttt

SEQ ID NO: 141855 - DNA, 22 bp, Artificial Sequence
  chemically synthesized
ttgttttgttttgttttgtttt

SEQ ID NO: 141856 - DNA, 22 bp, Artificial Sequence
  chemically synthesized
tgttttgttttgttttgttttt

SEQ ID NO: 141857 - DNA, 22 bp, Artificial Sequence
  chemically synthesized
gttttgttttgttttgtttttt

SEQ ID NO: 141858 - DNA, 22 bp, Artificial Sequence
  chemically synthesized
ttttgttttgttttgttttttg

SEQ ID NO: 141859 - DNA, 22 bp, Artificial Sequence
  chemically synthesized
tgttttgttttgttttttgcag

SEQ ID NO: 141860 - DNA, 22 bp, Artificial Sequence
  chemically synthesized
gttttgttttgttttttgcagc

SEQ ID NO: 141861 - DNA, 22 bp, Artificial Sequence
  chemically synthesized
ttttgttttgttttttgcagct

SEQ ID NO: 141862 - DNA, 22 bp, Artificial Sequence
  chemically synthesized
tgttttgttttttgcagctatt

SEQ ID NO: 141863 - DNA, 22 bp, Artificial Sequence
  chemically synthesized
gttttgttttttgcagctattg

SEQ ID NO: 141864 - DNA, 22 bp, Artificial Sequence
  chemically synthesized
ttttgttttttgcagctattgt

SEQ ID NO: 141865 - DNA, 22 bp, Artificial Sequence
  chemically synthesized
tgttttttgcagctattgtaaa

SEQ ID NO: 141866 - DNA, 22 bp, Artificial Sequence
  chemically synthesized
gttttttgcagctattgtaaaa

SEQ ID NO: 141867 - DNA, 22 bp, Artificial Sequence
  chemically synthesized
ttttttgcagctattgtaaaag

SEQ ID NO: 141868 - DNA, 22 bp, Artificial Sequence
  chemically synthesized
tttgcagctattgtaaaagggg

SEQ ID NO: 141869 - DNA, 22 bp, Artificial Sequence
  chemically synthesized
ttgcagctattgtaaaaggggt

SEQ ID NO: 141870 - DNA, 22 bp, Artificial Sequence
  chemically synthesized
tgcagctattgtaaaaggggtt

SEQ ID NO: 141871 - DNA, 22 bp, Artificial Sequence
  chemically synthesized
gcagctattgtaaaaggggttg

SEQ ID NO: 141872 - DNA, 22 bp, Artificial Sequence
  chemically synthesized
cagctattgtaaaaggggttga

SEQ ID NO: 141873 - DNA, 22 bp, Artificial Sequence
  chemically synthesized
ttgtaaaaggggttgagttctt

SEQ ID NO: 141874 - DNA, 22 bp, Artificial Sequence
  chemically synthesized
taaaaggggttgagttcttgat

SEQ ID NO: 141875 - DNA, 22 bp, Artificial Sequence
  chemically synthesized
agttcttgattttattctcagc

SEQ ID NO: 141876 - DNA, 22 bp, Artificial Sequence
  chemically synthesized
ttgattttattctcagcttggt

SEQ ID NO: 141877 - DNA, 22 bp, Artificial Sequence
  chemically synthesized
gattttattctcagcttggtca

SEQ ID NO: 141878 - DNA, 22 bp, Artificial Sequence
  chemically synthesized
attttattctcagcttggtcat

SEQ ID NO: 141879 - DNA, 22 bp, Artificial Sequence
  chemically synthesized
tattctcagcttggtcattgct

SEQ ID NO: 141880 - DNA, 22 bp, Artificial Sequence
  chemically synthesized
attctcagcttggtcattgctg

SEQ ID NO: 141881 - DNA, 22 bp, Artificial Sequence
  chemically synthesized
ttctcagcttggtcattgctgg

SEQ ID NO: 141882 - DNA, 22 bp, Artificial Sequence
  chemically synthesized
tcagcttggtcattgctggtat

SEQ ID NO: 141883 - DNA, 22 bp, Artificial Sequence
  chemically synthesized
agcttggtcattgctggtatgt

SEQ ID NO: 141884 - DNA, 22 bp, Artificial Sequence
  chemically synthesized
ggtcattgctggtatgtaagaa

SEQ ID NO: 141885 - DNA, 22 bp, Artificial Sequence
  chemically synthesized
gtcattgctggtatgtaagaaa

SEQ ID NO: 141886 - DNA, 22 bp, Artificial Sequence
  chemically synthesized
ctggtatgtaagaaagcaactc

SEQ ID NO: 141887 - DNA, 22 bp, Artificial Sequence
  chemically synthesized
gtatgtaagaaagcaactcatt

SEQ ID NO: 141888 - DNA, 22 bp, Artificial Sequence
  chemically synthesized
attggtgtacgttaattttgta

SEQ ID NO: 141889 - DNA, 22 bp, Artificial Sequence
  chemically synthesized
gtgtacgttaattttgtatcca

SEQ ID NO: 141890 - DNA, 22 bp, Artificial Sequence
  chemically synthesized
attttgtatccagaaactttgc

SEQ ID NO: 141891 - DNA, 22 bp, Artificial Sequence
  chemically synthesized
tgtatccagaaactttgctgaa

SEQ ID NO: 141892 - DNA, 22 bp, Artificial Sequence
  chemically synthesized
gtatccagaaactttgctgaat

SEQ ID NO: 141893 - DNA, 22 bp, Artificial Sequence
  chemically synthesized
tatccagaaactttgctgaatt

SEQ ID NO: 141894 - DNA, 22 bp, Artificial Sequence
  chemically synthesized
tgctgaattattttatcagttc

SEQ ID NO: 141895 - DNA, 22 bp, Artificial Sequence
  chemically synthesized
gctgaattattttatcagttct

SEQ ID NO: 141896 - DNA, 22 bp, Artificial Sequence
  chemically synthesized
ctgaattattttatcagttcta

SEQ ID NO: 141897 - DNA, 22 bp, Artificial Sequence
  chemically synthesized
aattattttatcagttctaggg

SEQ ID NO: 141898 - DNA, 22 bp, Artificial Sequence
  chemically synthesized
ttttatcagttctagggggttt

SEQ ID NO: 141899 - DNA, 22 bp, Artificial Sequence
  chemically synthesized
tatcagttctagggggttttgg

SEQ ID NO: 141900 - DNA, 22 bp, Artificial Sequence
  chemically synthesized
atcagttctagggggttttgga

SEQ ID NO: 141901 - DNA, 22 bp, Artificial Sequence
  chemically synthesized
tcagttctagggggttttggag

SEQ ID NO: 141902 - DNA, 22 bp, Artificial Sequence
  chemically synthesized
tagggggttttggaggagtctt

SEQ ID NO: 141903 - DNA, 22 bp, Artificial Sequence
  chemically synthesized
gggggttttggaggagtcttta

SEQ ID NO: 141904 - DNA, 22 bp, Artificial Sequence
  chemically synthesized
tggaggagtctttagagttttc

SEQ ID NO: 141905 - DNA, 22 bp, Artificial Sequence
  chemically synthesized
ggaggagtctttagagttttct

SEQ ID NO: 141906 - DNA, 22 bp, Artificial Sequence
  chemically synthesized
gaggagtctttagagttttcta

SEQ ID NO: 141907 - DNA, 22 bp, Artificial Sequence
  chemically synthesized
tagagttttctacatacacaat

SEQ ID NO: 141908 - DNA, 22 bp, Artificial Sequence
  chemically synthesized
agagttttctacatacacaatc

SEQ ID NO: 141909 - DNA, 22 bp, Artificial Sequence
  chemically synthesized
gagttttctacatacacaatca

SEQ ID NO: 141910 - DNA, 22 bp, Artificial Sequence
  chemically synthesized
tctacatacacaatcatatcat

SEQ ID NO: 141911 - DNA, 22 bp, Artificial Sequence
  chemically synthesized
ctacatacacaatcatatcatc

SEQ ID NO: 141912 - DNA, 22 bp, Artificial Sequence
  chemically synthesized
tacatacacaatcatatcatca

SEQ ID NO: 141913 - DNA, 22 bp, Artificial Sequence
  chemically synthesized
catacacaatcatatcatcagc

SEQ ID NO: 141914 - DNA, 22 bp, Artificial Sequence
  chemically synthesized
gactttctctttaacaatttgg

SEQ ID NO: 141915 - DNA, 22 bp, Artificial Sequence
  chemically synthesized
actttctctttaacaatttgga

SEQ ID NO: 141916 - DNA, 22 bp, Artificial Sequence
  chemically synthesized
tctctttaacaatttggatgtg

SEQ ID NO: 141917 - DNA, 22 bp, Artificial Sequence
  chemically synthesized
ctctttaacaatttggatgtgc

SEQ ID NO: 141918 - DNA, 22 bp, Artificial Sequence
  chemically synthesized
tctttaacaatttggatgtgct

SEQ ID NO: 141919 - DNA, 22 bp, Artificial Sequence
  chemically synthesized
tttaacaatttggatgtgcttt

SEQ ID NO: 141920 - DNA, 22 bp, Artificial Sequence
  chemically synthesized
taacaatttggatgtgctttac

SEQ ID NO: 141921 - DNA, 22 bp, Artificial Sequence
  chemically synthesized
aacaatttggatgtgctttact

SEQ ID NO: 141922 - DNA, 22 bp, Artificial Sequence
  chemically synthesized
acaatttggatgtgctttactt

SEQ ID NO: 141923 - DNA, 22 bp, Artificial Sequence
  chemically synthesized
ggatgtgctttacttgtttctc

SEQ ID NO: 141924 - DNA, 22 bp, Artificial Sequence
  chemically synthesized
gatgtgctttacttgtttctct

SEQ ID NO: 141925 - DNA, 22 bp, Artificial Sequence
  chemically synthesized
tacttgtttctcttgtctgatt

SEQ ID NO: 141926 - DNA, 22 bp, Artificial Sequence
  chemically synthesized
acttgtttctcttgtctgattg

SEQ ID NO: 141927 - DNA, 22 bp, Artificial Sequence
  chemically synthesized
cttgtttctcttgtctgattgc

SEQ ID NO: 141928 - DNA, 22 bp, Artificial Sequence
  chemically synthesized
gtttctcttgtctgattgctct

SEQ ID NO: 141929 - DNA, 22 bp, Artificial Sequence
  chemically synthesized
tttctcttgtctgattgctctt

SEQ ID NO: 141930 - DNA, 22 bp, Artificial Sequence
  chemically synthesized
ctcttgtctgattgctcttgct

SEQ ID NO: 141931 - DNA, 22 bp, Artificial Sequence
  chemically synthesized
tcttgtctgattgctcttgcta

SEQ ID NO: 141932 - DNA, 22 bp, Artificial Sequence
  chemically synthesized
ttgtctgattgctcttgctagg

SEQ ID NO: 141933 - DNA, 22 bp, Artificial Sequence
  chemically synthesized
gtctgattgctcttgctaggac

SEQ ID NO: 141934 - DNA, 22 bp, Artificial Sequence
  chemically synthesized
tctgattgctcttgctaggact

SEQ ID NO: 141935 - DNA, 22 bp, Artificial Sequence
  chemically synthesized
attgctcttgctaggacttcca

SEQ ID NO: 141936 - DNA, 22 bp, Artificial Sequence
  chemically synthesized
ctcttgctaggacttccagtaa

SEQ ID NO: 141937 - DNA, 22 bp, Artificial Sequence
  chemically synthesized
ttgctaggacttccagtaatat

SEQ ID NO: 141938 - DNA, 22 bp, Artificial Sequence
  chemically synthesized
gctaggacttccagtaatatgt

SEQ ID NO: 141939 - DNA, 22 bp, Artificial Sequence
  chemically synthesized
ctaggacttccagtaatatgtt

SEQ ID NO: 141940 - DNA, 22 bp, Artificial Sequence
  chemically synthesized
ggacttccagtaatatgttaaa

SEQ ID NO: 141941 - DNA, 22 bp, Artificial Sequence
  chemically synthesized
ccagtaatatgttaaagagaag

SEQ ID NO: 141942 - DNA, 22 bp, Artificial Sequence
  chemically synthesized
cagtaatatgttaaagagaagt

SEQ ID NO: 141943 - DNA, 22 bp, Artificial Sequence
  chemically synthesized
aagagaagtggtgagagtgggt

SEQ ID NO: 141944 - DNA, 22 bp, Artificial Sequence
  chemically synthesized
gtctcattccagttttcagaca

SEQ ID NO: 141945 - DNA, 22 bp, Artificial Sequence
  chemically synthesized
tctcattccagttttcagacag

SEQ ID NO: 141946 - DNA, 22 bp, Artificial Sequence
  chemically synthesized
attccagttttcagacagaatg

SEQ ID NO: 141947 - DNA, 22 bp, Artificial Sequence
  chemically synthesized
cagttttcagacagaatgcttt

SEQ ID NO: 141948 - DNA, 22 bp, Artificial Sequence
  chemically synthesized
tcagacagaatgcttttaactt

SEQ ID NO: 141949 - DNA, 22 bp, Artificial Sequence
  chemically synthesized
cagacagaatgcttttaacttt

SEQ ID NO: 141950 - DNA, 22 bp, Artificial Sequence
  chemically synthesized
agacagaatgcttttaactttt

SEQ ID NO: 141951 - DNA, 22 bp, Artificial Sequence
  chemically synthesized
ttaactttttcccattcaatat

SEQ ID NO: 141952 - DNA, 22 bp, Artificial Sequence
  chemically synthesized
taactttttcccattcaatata

SEQ ID NO: 141953 - DNA, 22 bp, Artificial Sequence
  chemically synthesized
aactttttcccattcaatataa

SEQ ID NO: 141954 - DNA, 22 bp, Artificial Sequence
  chemically synthesized
actttttcccattcaatataat

SEQ ID NO: 141955 - DNA, 22 bp, Artificial Sequence
  chemically synthesized
tttcccattcaatataatgttg

SEQ ID NO: 141956 - DNA, 22 bp, Artificial Sequence
  chemically synthesized
ttcccattcaatataatgttgg

SEQ ID NO: 141957 - DNA, 22 bp, Artificial Sequence
  chemically synthesized
tcccattcaatataatgttggc

SEQ ID NO: 141958 - DNA, 22 bp, Artificial Sequence
  chemically synthesized
cccattcaatataatgttggct

SEQ ID NO: 141959 - DNA, 22 bp, Artificial Sequence
  chemically synthesized
ccattcaatataatgttggctg

SEQ ID NO: 141960 - DNA, 22 bp, Artificial Sequence
  chemically synthesized
aatataatgttggctgtgtgtt

SEQ ID NO: 141961 - DNA, 22 bp, Artificial Sequence
  chemically synthesized
gctgtgtgtttaccatagctgg

SEQ ID NO: 141962 - DNA, 22 bp, Artificial Sequence
  chemically synthesized
tgtgtttaccatagctggcttt

SEQ ID NO: 141963 - DNA, 22 bp, Artificial Sequence
  chemically synthesized
accatagctggcttttattaca

SEQ ID NO: 141964 - DNA, 22 bp, Artificial Sequence
  chemically synthesized
ccatagctggcttttattacat

SEQ ID NO: 141965 - DNA, 22 bp, Artificial Sequence
  chemically synthesized
gcttttattacattgaggtatg

SEQ ID NO: 141966 - DNA, 22 bp, Artificial Sequence
  chemically synthesized
ttattacattgaggtatgtcct

SEQ ID NO: 141967 - DNA, 22 bp, Artificial Sequence
  chemically synthesized
tattacattgaggtatgtcctt

SEQ ID NO: 141968 - DNA, 22 bp, Artificial Sequence
  chemically synthesized
attacattgaggtatgtccttt

SEQ ID NO: 141969 - DNA, 22 bp, Artificial Sequence
  chemically synthesized
ttacattgaggtatgtcctttg

SEQ ID NO: 141970 - DNA, 22 bp, Artificial Sequence
  chemically synthesized
cattgaggtatgtcctttgtaa

SEQ ID NO: 141971 - DNA, 22 bp, Artificial Sequence
  chemically synthesized
aggtatgtcctttgtaaaccga

SEQ ID NO: 141972 - DNA, 22 bp, Artificial Sequence
  chemically synthesized
tgtaaaccgattttgctgagtt

SEQ ID NO: 141973 - DNA, 22 bp, Artificial Sequence
  chemically synthesized
gtaaaccgattttgctgagttt

SEQ ID NO: 141974 - DNA, 22 bp, Artificial Sequence
  chemically synthesized
taaaccgattttgctgagtttt

SEQ ID NO: 141975 - DNA, 22 bp, Artificial Sequence
  chemically synthesized
tgctgagttttagtcataaagt

SEQ ID NO: 141976 - DNA, 22 bp, Artificial Sequence
  chemically synthesized
gctgagttttagtcataaagtg

SEQ ID NO: 141977 - DNA, 22 bp, Artificial Sequence
  chemically synthesized
ctgagttttagtcataaagtga

SEQ ID NO: 141978 - DNA, 22 bp, Artificial Sequence
  chemically synthesized
agttttagtcataaagtgatgt

SEQ ID NO: 141979 - DNA, 22 bp, Artificial Sequence
  chemically synthesized
tagtcataaagtgatgttgaat

SEQ ID NO: 141980 - DNA, 22 bp, Artificial Sequence
  chemically synthesized
agtcataaagtgatgttgaatt

SEQ ID NO: 141981 - DNA, 22 bp, Artificial Sequence
  chemically synthesized
gtcataaagtgatgttgaattt

SEQ ID NO: 141982 - DNA, 22 bp, Artificial Sequence
  chemically synthesized
aattttgttgaatgcagtttct

SEQ ID NO: 141983 - DNA, 22 bp, Artificial Sequence
  chemically synthesized
tgttgaatgcagtttctgtggc

SEQ ID NO: 141984 - DNA, 22 bp, Artificial Sequence
  chemically synthesized
gttgaatgcagtttctgtggct

SEQ ID NO: 141985 - DNA, 22 bp, Artificial Sequence
  chemically synthesized
ttgaatgcagtttctgtggcta

SEQ ID NO: 141986 - DNA, 22 bp, Artificial Sequence
  chemically synthesized
aatgcagtttctgtggctattg

SEQ ID NO: 141987 - DNA, 22 bp, Artificial Sequence
  chemically synthesized
ctgtggctattgagataatcac

SEQ ID NO: 141988 - DNA, 22 bp, Artificial Sequence
  chemically synthesized
tgtggctattgagataatcaca

SEQ ID NO: 141989 - DNA, 22 bp, Artificial Sequence
  chemically synthesized
tggctattgagataatcacatg

SEQ ID NO: 141990 - DNA, 22 bp, Artificial Sequence
  chemically synthesized
ttgagataatcacatgattttt

SEQ ID NO: 141991 - DNA, 22 bp, Artificial Sequence
  chemically synthesized
agataatcacatgatttttgtt

SEQ ID NO: 141992 - DNA, 22 bp, Artificial Sequence
  chemically synthesized
ttgtttccaattctctttatgt

SEQ ID NO: 141993 - DNA, 22 bp, Artificial Sequence
  chemically synthesized
tgtttccaattctctttatgtt

SEQ ID NO: 141994 - DNA, 22 bp, Artificial Sequence
  chemically synthesized
gtttccaattctctttatgttg

SEQ ID NO: 141995 - DNA, 22 bp, Artificial Sequence
  chemically synthesized
tttccaattctctttatgttgt

SEQ ID NO: 141996 - DNA, 22 bp, Artificial Sequence
  chemically synthesized
ccaattctctttatgttgtgta

SEQ ID NO: 141997 - DNA, 22 bp, Artificial Sequence
  chemically synthesized
caattctctttatgttgtgtat

SEQ ID NO: 141998 - DNA, 22 bp, Artificial Sequence
  chemically synthesized
tctttatgttgtgtatcacact

SEQ ID NO: 141999 - DNA, 22 bp, Artificial Sequence
  chemically synthesized
tttatgttgtgtatcacactta

SEQ ID NO: 142000 - DNA, 22 bp, Artificial Sequence
  chemically synthesized
tatgttgtgtatcacacttatt

SEQ ID NO: 142001 - DNA, 22 bp, Artificial Sequence
  chemically synthesized
atgttgtgtatcacacttattg

SEQ ID NO: 142002 - DNA, 22 bp, Artificial Sequence
  chemically synthesized
tgttgtgtatcacacttattga

SEQ ID NO: 142003 - DNA, 22 bp, Artificial Sequence
  chemically synthesized
tgtatcacacttattgacttgc

SEQ ID NO: 142004 - DNA, 22 bp, Artificial Sequence
  chemically synthesized
attgacttgcgtatgttaaacc

SEQ ID NO: 142005 - DNA, 22 bp, Artificial Sequence
  chemically synthesized
ttgacttgcgtatgttaaacca

SEQ ID NO: 142006 - DNA, 22 bp, Artificial Sequence
  chemically synthesized
acttgcgtatgttaaaccatcc

SEQ ID NO: 142007 - DNA, 22 bp, Artificial Sequence
  chemically synthesized
gcgtatgttaaaccatccgtgc

SEQ ID NO: 142008 - DNA, 22 bp, Artificial Sequence
  chemically synthesized
cgtatgttaaaccatccgtgca

SEQ ID NO: 142009 - DNA, 22 bp, Artificial Sequence
  chemically synthesized
aaccatccgtgcatccctcgca

SEQ ID NO: 142010 - DNA, 22 bp, Artificial Sequence
  chemically synthesized
gcatgaaacccacttgatcatg

SEQ ID NO: 142011 - DNA, 22 bp, Artificial Sequence
  chemically synthesized
gatcatgggttttgatatgctg

SEQ ID NO: 142012 - DNA, 22 bp, Artificial Sequence
  chemically synthesized
atcatgggttttgatatgctgt

SEQ ID NO: 142013 - DNA, 22 bp, Artificial Sequence
  chemically synthesized
tgatatgctgtcggatgctatt

SEQ ID NO: 142014 - DNA, 22 bp, Artificial Sequence
  chemically synthesized
gatatgctgtcggatgctatta

SEQ ID NO: 142015 - DNA, 22 bp, Artificial Sequence
  chemically synthesized
atatgctgtcggatgctattag

SEQ ID NO: 142016 - DNA, 22 bp, Artificial Sequence
  chemically synthesized
tcggatgctattagctagtatt

SEQ ID NO: 142017 - DNA, 22 bp, Artificial Sequence
  chemically synthesized
ttagctagtattttgtcaagga

SEQ ID NO: 142018 - DNA, 22 bp, Artificial Sequence
  chemically synthesized
gctagtattttgtcaaggatgt

SEQ ID NO: 142019 - DNA, 22 bp, Artificial Sequence
  chemically synthesized
gtattttgtcaaggatgttggc

SEQ ID NO: 142020 - DNA, 22 bp, Artificial Sequence
  chemically synthesized
tgtcaaggatgttggcatctat

SEQ ID NO: 142021 - DNA, 22 bp, Artificial Sequence
  chemically synthesized
gtcaaggatgttggcatctatg

SEQ ID NO: 142022 - DNA, 22 bp, Artificial Sequence
  chemically synthesized
tcaaggatgttggcatctatgt

SEQ ID NO: 142023 - DNA, 22 bp, Artificial Sequence
  chemically synthesized
gcatctatgttcatcagggata

SEQ ID NO: 142024 - DNA, 22 bp, Artificial Sequence
  chemically synthesized
tgttcatcagggatattgatct

SEQ ID NO: 142025 - DNA, 22 bp, Artificial Sequence
  chemically synthesized
atcagggatattgatctgtagt

SEQ ID NO: 142026 - DNA, 22 bp, Artificial Sequence
  chemically synthesized
atctgtagtgtttttttttttt

SEQ ID NO: 142027 - DNA, 22 bp, Artificial Sequence
  chemically synthesized
tagtgttttttttttttggtta

SEQ ID NO: 142028 - DNA, 22 bp, Artificial Sequence
  chemically synthesized
tttttttttggttatgttcttt

SEQ ID NO: 142029 - DNA, 22 bp, Artificial Sequence
  chemically synthesized
ttttttttggttatgttctttc

SEQ ID NO: 142030 - DNA, 22 bp, Artificial Sequence
  chemically synthesized
tttttttggttatgttctttcc

SEQ ID NO: 142031 - DNA, 22 bp, Artificial Sequence
  chemically synthesized
ttttttggttatgttctttccc

SEQ ID NO: 142032 - DNA, 22 bp, Artificial Sequence
  chemically synthesized
tttttggttatgttctttccca

SEQ ID NO: 142033 - DNA, 22 bp, Artificial Sequence
  chemically synthesized
ttttggttatgttctttcccag

SEQ ID NO: 142034 - DNA, 22 bp, Artificial Sequence
  chemically synthesized
tttggttatgttctttcccagt

SEQ ID NO: 142035 - DNA, 22 bp, Artificial Sequence
  chemically synthesized
ttggttatgttctttcccagtt

SEQ ID NO: 142036 - DNA, 22 bp, Artificial Sequence
  chemically synthesized
tggttatgttctttcccagttt

SEQ ID NO: 142037 - DNA, 22 bp, Artificial Sequence
  chemically synthesized
ggttatgttctttcccagtttt

SEQ ID NO: 142038 - DNA, 22 bp, Artificial Sequence
  chemically synthesized
gttatgttctttcccagttttg

SEQ ID NO: 142039 - DNA, 22 bp, Artificial Sequence
  chemically synthesized
tgttctttcccagttttggtat

SEQ ID NO: 142040 - DNA, 22 bp, Artificial Sequence
  chemically synthesized
tttcccagttttggtattaagg

SEQ ID NO: 142041 - DNA, 22 bp, Artificial Sequence
  chemically synthesized
tcccagttttggtattaaggtg

SEQ ID NO: 142042 - DNA, 22 bp, Artificial Sequence
  chemically synthesized
cccagttttggtattaaggtga

SEQ ID NO: 142043 - DNA, 22 bp, Artificial Sequence
  chemically synthesized
ccagttttggtattaaggtgat

SEQ ID NO: 142044 - DNA, 22 bp, Artificial Sequence
  chemically synthesized
tggtattaaggtgatactggct

SEQ ID NO: 142045 - DNA, 22 bp, Artificial Sequence
  chemically synthesized
ggtattaaggtgatactggctt

SEQ ID NO: 142046 - DNA, 22 bp, Artificial Sequence
  chemically synthesized
gtattaaggtgatactggcttc

SEQ ID NO: 142047 - DNA, 22 bp, Artificial Sequence
  chemically synthesized
aggtgatactggcttcatagaa

SEQ ID NO: 142048 - DNA, 22 bp, Artificial Sequence
  chemically synthesized
gcttcatagaatgatttaggga

SEQ ID NO: 142049 - DNA, 22 bp, Artificial Sequence
  chemically synthesized
catagaatgatttagggaggat

SEQ ID NO: 142050 - DNA, 22 bp, Artificial Sequence
  chemically synthesized
atagaatgatttagggaggatt

SEQ ID NO: 142051 - DNA, 22 bp, Artificial Sequence
  chemically synthesized
agggaggattctctctttctct

SEQ ID NO: 142052 - DNA, 22 bp, Artificial Sequence
  chemically synthesized
gggaggattctctctttctcta

SEQ ID NO: 142053 - DNA, 22 bp, Artificial Sequence
  chemically synthesized
tctctttctctatcttgtagaa

SEQ ID NO: 142054 - DNA, 22 bp, Artificial Sequence
  chemically synthesized
tctttctctatcttgtagaata

SEQ ID NO: 142055 - DNA, 22 bp, Artificial Sequence
  chemically synthesized
tttctctatcttgtagaatact

SEQ ID NO: 142056 - DNA, 22 bp, Artificial Sequence
  chemically synthesized
tctctatcttgtagaatactgt

SEQ ID NO: 142057 - DNA, 22 bp, Artificial Sequence
  chemically synthesized
ctctatcttgtagaatactgtc

SEQ ID NO: 142058 - DNA, 22 bp, Artificial Sequence
  chemically synthesized
tctatcttgtagaatactgtca

SEQ ID NO: 142059 - DNA, 22 bp, Artificial Sequence
  chemically synthesized
tatcttgtagaatactgtcaat

SEQ ID NO: 142060 - DNA, 22 bp, Artificial Sequence
  chemically synthesized
tcttgtagaatactgtcaatag

SEQ ID NO: 142061 - DNA, 22 bp, Artificial Sequence
  chemically synthesized
gtagaatactgtcaataggatt

SEQ ID NO: 142062 - DNA, 22 bp, Artificial Sequence
  chemically synthesized
tagaatactgtcaataggattg

SEQ ID NO: 142063 - DNA, 22 bp, Artificial Sequence
  chemically synthesized
tcaataggattggtatcaattc

SEQ ID NO: 142064 - DNA, 22 bp, Artificial Sequence
  chemically synthesized
gtatcaattcttctttgaatgt

SEQ ID NO: 142065 - DNA, 22 bp, Artificial Sequence
  chemically synthesized
ttctttgaatgtctggtagaat

SEQ ID NO: 142066 - DNA, 22 bp, Artificial Sequence
  chemically synthesized
ctttgaatgtctggtagaattc

SEQ ID NO: 142067 - DNA, 22 bp, Artificial Sequence
  chemically synthesized
tttgaatgtctggtagaattca

SEQ ID NO: 142068 - DNA, 22 bp, Artificial Sequence
  chemically synthesized
tgaatgtctggtagaattcagc

SEQ ID NO: 142069 - DNA, 22 bp, Artificial Sequence
  chemically synthesized
gaatgtctggtagaattcagct

SEQ ID NO: 142070 - DNA, 22 bp, Artificial Sequence
  chemically synthesized
aatgtctggtagaattcagctg

SEQ ID NO: 142071 - DNA, 22 bp, Artificial Sequence
  chemically synthesized
gtagaattcagctgtgaatcta

SEQ ID NO: 142072 - DNA, 22 bp, Artificial Sequence
  chemically synthesized
agctgtgaatctatctggtcct

SEQ ID NO: 142073 - DNA, 22 bp, Artificial Sequence
  chemically synthesized
tgaatctatctggtcctggact

SEQ ID NO: 142074 - DNA, 22 bp, Artificial Sequence
  chemically synthesized
tctggtcctggacttttttgtt

SEQ ID NO: 142075 - DNA, 22 bp, Artificial Sequence
  chemically synthesized
gtcctggacttttttgttgttg

SEQ ID NO: 142076 - DNA, 22 bp, Artificial Sequence
  chemically synthesized
gacttttttgttgttggtaaat

SEQ ID NO: 142077 - DNA, 22 bp, Artificial Sequence
  chemically synthesized
ttttgttgttggtaaattttta

SEQ ID NO: 142078 - DNA, 22 bp, Artificial Sequence
  chemically synthesized
tttgttgttggtaaatttttat

SEQ ID NO: 142079 - DNA, 22 bp, Artificial Sequence
  chemically synthesized
ttgttgttggtaaatttttatt

SEQ ID NO: 142080 - DNA, 22 bp, Artificial Sequence
  chemically synthesized
tgttgttggtaaatttttatta

SEQ ID NO: 142081 - DNA, 22 bp, Artificial Sequence
  chemically synthesized
gttgttggtaaatttttattat

SEQ ID NO: 142082 - DNA, 22 bp, Artificial Sequence
  chemically synthesized
ttgttggtaaatttttattatc

SEQ ID NO: 142083 - DNA, 22 bp, Artificial Sequence
  chemically synthesized
ttggtaaatttttattatcatt

SEQ ID NO: 142084 - DNA, 22 bp, Artificial Sequence
  chemically synthesized
gtaaatttttattatcatttca

SEQ ID NO: 142085 - DNA, 22 bp, Artificial Sequence
  chemically synthesized
ttattatcatttcagtcttgct

SEQ ID NO: 142086 - DNA, 22 bp, Artificial Sequence
  chemically synthesized
tattatcatttcagtcttgctg

SEQ ID NO: 142087 - DNA, 22 bp, Artificial Sequence
  chemically synthesized
attatcatttcagtcttgctgc

SEQ ID NO: 142088 - DNA, 22 bp, Artificial Sequence
  chemically synthesized
ttatcatttcagtcttgctgct

SEQ ID NO: 142089 - DNA, 22 bp, Artificial Sequence
  chemically synthesized
tcatttcagtcttgctgcttat

SEQ ID NO: 142090 - DNA, 22 bp, Artificial Sequence
  chemically synthesized
cagtcttgctgcttattactgg

SEQ ID NO: 142091 - DNA, 22 bp, Artificial Sequence
  chemically synthesized
agtcttgctgcttattactggt

SEQ ID NO: 142092 - DNA, 22 bp, Artificial Sequence
  chemically synthesized
gctgcttattactggtctgttc

SEQ ID NO: 142093 - DNA, 22 bp, Artificial Sequence
  chemically synthesized
ctgcttattactggtctgttca

SEQ ID NO: 142094 - DNA, 22 bp, Artificial Sequence
  chemically synthesized
cttattactggtctgttcaggg

SEQ ID NO: 142095 - DNA, 22 bp, Artificial Sequence
  chemically synthesized
attactggtctgttcagggtat

SEQ ID NO: 142096 - DNA, 22 bp, Artificial Sequence
  chemically synthesized
ttactggtctgttcagggtatc

SEQ ID NO: 142097 - DNA, 22 bp, Artificial Sequence
  chemically synthesized
ctggtctgttcagggtatctaa

SEQ ID NO: 142098 - DNA, 22 bp, Artificial Sequence
  chemically synthesized
gtctgttcagggtatctaattc

SEQ ID NO: 142099 - DNA, 22 bp, Artificial Sequence
  chemically synthesized
ttcagggtatctaattcttcct

SEQ ID NO: 142100 - DNA, 22 bp, Artificial Sequence
  chemically synthesized
agggtatctaattcttcctgac

SEQ ID NO: 142101 - DNA, 22 bp, Artificial Sequence
  chemically synthesized
attcttcctgacttaagctaga

SEQ ID NO: 142102 - DNA, 22 bp, Artificial Sequence
  chemically synthesized
ttcctgacttaagctagagccc

SEQ ID NO: 142103 - DNA, 22 bp, Artificial Sequence
  chemically synthesized
cctgacttaagctagagccctg

SEQ ID NO: 142104 - DNA, 22 bp, Artificial Sequence
  chemically synthesized
ctgacttaagctagagccctgt

SEQ ID NO: 142105 - DNA, 22 bp, Artificial Sequence
  chemically synthesized
acttaagctagagccctgtatc

SEQ ID NO: 142106 - DNA, 22 bp, Artificial Sequence
  chemically synthesized
aagctagagccctgtatctttc

SEQ ID NO: 142107 - DNA, 22 bp, Artificial Sequence
  chemically synthesized
agctagagccctgtatctttcc

SEQ ID NO: 142108 - DNA, 22 bp, Artificial Sequence
  chemically synthesized
gagccctgtatctttccaggaa

SEQ ID NO: 142109 - DNA, 22 bp, Artificial Sequence
  chemically synthesized
tatctttccaggaattcgaacg

SEQ ID NO: 142110 - DNA, 22 bp, Artificial Sequence
  chemically synthesized
tccaggaattcgaacgtctcct

SEQ ID NO: 142111 - DNA, 22 bp, Artificial Sequence
  chemically synthesized
ccaggaattcgaacgtctcctt

SEQ ID NO: 142112 - DNA, 22 bp, Artificial Sequence
  chemically synthesized
caggaattcgaacgtctccttt

SEQ ID NO: 142113 - DNA, 22 bp, Artificial Sequence
  chemically synthesized
gaacgtctcctttaggttttct

SEQ ID NO: 142114 - DNA, 22 bp, Artificial Sequence
  chemically synthesized
ctttaggttttctagtttatgc

SEQ ID NO: 142115 - DNA, 22 bp, Artificial Sequence
  chemically synthesized
taggttttctagtttatgcatg

SEQ ID NO: 142116 - DNA, 22 bp, Artificial Sequence
  chemically synthesized
aggttttctagtttatgcatgt

SEQ ID NO: 142117 - DNA, 22 bp, Artificial Sequence
  chemically synthesized
ggttttctagtttatgcatgta

SEQ ID NO: 142118 - DNA, 22 bp, Artificial Sequence
  chemically synthesized
tctagtttatgcatgtaaaggt

SEQ ID NO: 142119 - DNA, 22 bp, Artificial Sequence
  chemically synthesized
ctagtttatgcatgtaaaggtg

SEQ ID NO: 142120 - DNA, 22 bp, Artificial Sequence
  chemically synthesized
tagtttatgcatgtaaaggtgt

SEQ ID NO: 142121 - DNA, 22 bp, Artificial Sequence
  chemically synthesized
gtttatgcatgtaaaggtgttc

SEQ ID NO: 142122 - DNA, 22 bp, Artificial Sequence
  chemically synthesized
atgcatgtaaaggtgttcatag

SEQ ID NO: 142123 - DNA, 22 bp, Artificial Sequence
  chemically synthesized
tgcatgtaaaggtgttcatagt

SEQ ID NO: 142124 - DNA, 22 bp, Artificial Sequence
  chemically synthesized
atagtagccttgaataatcttt

SEQ ID NO: 142125 - DNA, 22 bp, Artificial Sequence
  chemically synthesized
gaataatcttttgtatttctgt

SEQ ID NO: 142126 - DNA, 22 bp, Artificial Sequence
  chemically synthesized
aataatcttttgtatttctgtg

SEQ ID NO: 142127 - DNA, 22 bp, Artificial Sequence
  chemically synthesized
ttgtatttctgtggtatcagta

SEQ ID NO: 142128 - DNA, 22 bp, Artificial Sequence
  chemically synthesized
tgtatttctgtggtatcagtaa

SEQ ID NO: 142129 - DNA, 22 bp, Artificial Sequence
  chemically synthesized
gtatttctgtggtatcagtaat

SEQ ID NO: 142130 - DNA, 22 bp, Artificial Sequence
  chemically synthesized
tatttctgtggtatcagtaata

SEQ ID NO: 142131 - DNA, 22 bp, Artificial Sequence
  chemically synthesized
ctgtggtatcagtaatagtatc

SEQ ID NO: 142132 - DNA, 22 bp, Artificial Sequence
  chemically synthesized
tgtggtatcagtaatagtatct

SEQ ID NO: 142133 - DNA, 22 bp, Artificial Sequence
  chemically synthesized
tggtatcagtaatagtatctcc

SEQ ID NO: 142134 - DNA, 22 bp, Artificial Sequence
  chemically synthesized
ctgttttgtttctaattgagtt

SEQ ID NO: 142135 - DNA, 22 bp, Artificial Sequence
  chemically synthesized
ttttgtttctaattgagtttat

SEQ ID NO: 142136 - DNA, 22 bp, Artificial Sequence
  chemically synthesized
tgtttctaattgagtttatttg

SEQ ID NO: 142137 - DNA, 22 bp, Artificial Sequence
  chemically synthesized
gtttctaattgagtttatttgc

SEQ ID NO: 142138 - DNA, 22 bp, Artificial Sequence
  chemically synthesized
tttctaattgagtttatttgca

SEQ ID NO: 142139 - DNA, 22 bp, Artificial Sequence
  chemically synthesized
ctaattgagtttatttgcactt

SEQ ID NO: 142140 - DNA, 22 bp, Artificial Sequence
  chemically synthesized
taattgagtttatttgcacttc

SEQ ID NO: 142141 - DNA, 22 bp, Artificial Sequence
  chemically synthesized
attgagtttatttgcacttctc

SEQ ID NO: 142142 - DNA, 22 bp, Artificial Sequence
  chemically synthesized
agtttatttgcacttctctcct

SEQ ID NO: 142143 - DNA, 22 bp, Artificial Sequence
  chemically synthesized
atttgcacttctctcctctttt

SEQ ID NO: 142144 - DNA, 22 bp, Artificial Sequence
  chemically synthesized
tttgcacttctctcctcttttc

SEQ ID NO: 142145 - DNA, 22 bp, Artificial Sequence
  chemically synthesized
gcacttctctcctcttttcttg

SEQ ID NO: 142146 - DNA, 22 bp, Artificial Sequence
  chemically synthesized
cacttctctcctcttttcttgg

SEQ ID NO: 142147 - DNA, 22 bp, Artificial Sequence
  chemically synthesized
ctctcctcttttcttggttaat

SEQ ID NO: 142148 - DNA, 22 bp, Artificial Sequence
  chemically synthesized
tctcctcttttcttggttaatc

SEQ ID NO: 142149 - DNA, 22 bp, Artificial Sequence
  chemically synthesized
tcctcttttcttggttaatctt

SEQ ID NO: 142150 - DNA, 22 bp, Artificial Sequence
  chemically synthesized
ctcttttcttggttaatcttgc

SEQ ID NO: 142151 - DNA, 22 bp, Artificial Sequence
  chemically synthesized
ttttcttggttaatcttgctaa

SEQ ID NO: 142152 - DNA, 22 bp, Artificial Sequence
  chemically synthesized
ttcttggttaatcttgctaatg

SEQ ID NO: 142153 - DNA, 22 bp, Artificial Sequence
  chemically synthesized
tcttggttaatcttgctaatgg

SEQ ID NO: 142154 - DNA, 22 bp, Artificial Sequence
  chemically synthesized
cttggttaatcttgctaatggt

SEQ ID NO: 142155 - DNA, 22 bp, Artificial Sequence
  chemically synthesized
ttggttaatcttgctaatggtc

SEQ ID NO: 142156 - DNA, 22 bp, Artificial Sequence
  chemically synthesized
ggttaatcttgctaatggtcta

SEQ ID NO: 142157 - DNA, 22 bp, Artificial Sequence
  chemically synthesized
gttaatcttgctaatggtctat

SEQ ID NO: 142158 - DNA, 22 bp, Artificial Sequence
  chemically synthesized
atcttgctaatggtctatcagt

SEQ ID NO: 142159 - DNA, 22 bp, Artificial Sequence
  chemically synthesized
gctaatggtctatcagttttat

SEQ ID NO: 142160 - DNA, 22 bp, Artificial Sequence
  chemically synthesized
ctaatggtctatcagttttatt

SEQ ID NO: 142161 - DNA, 22 bp, Artificial Sequence
  chemically synthesized
atggtctatcagttttatttat

SEQ ID NO: 142162 - DNA, 22 bp, Artificial Sequence
  chemically synthesized
tcagttttatttatcttttcaa

SEQ ID NO: 142163 - DNA, 22 bp, Artificial Sequence
  chemically synthesized
tatttatcttttcaaagaacca

SEQ ID NO: 142164 - DNA, 22 bp, Artificial Sequence
  chemically synthesized
atttatcttttcaaagaaccag

SEQ ID NO: 142165 - DNA, 22 bp, Artificial Sequence
  chemically synthesized
tttatcttttcaaagaaccagc

SEQ ID NO: 142166 - DNA, 22 bp, Artificial Sequence
  chemically synthesized
atcttttcaaagaaccagcttt

SEQ ID NO: 142167 - DNA, 22 bp, Artificial Sequence
  chemically synthesized
tcttttcaaagaaccagctttt

SEQ ID NO: 142168 - DNA, 22 bp, Artificial Sequence
  chemically synthesized
ttcaaagaaccagctttttatt

SEQ ID NO: 142169 - DNA, 22 bp, Artificial Sequence
  chemically synthesized
tcaaagaaccagctttttattt

SEQ ID NO: 142170 - DNA, 22 bp, Artificial Sequence
  chemically synthesized
caaagaaccagctttttatttc

SEQ ID NO: 142171 - DNA, 22 bp, Artificial Sequence
  chemically synthesized
aaagaaccagctttttatttca

SEQ ID NO: 142172 - DNA, 22 bp, Artificial Sequence
  chemically synthesized
tttatttcatttagcttttgta

SEQ ID NO: 142173 - DNA, 22 bp, Artificial Sequence
  chemically synthesized
ttatttcatttagcttttgtat

SEQ ID NO: 142174 - DNA, 22 bp, Artificial Sequence
  chemically synthesized
tatttcatttagcttttgtatt

SEQ ID NO: 142175 - DNA, 22 bp, Artificial Sequence
  chemically synthesized
atttcatttagcttttgtattt

SEQ ID NO: 142176 - DNA, 22 bp, Artificial Sequence
  chemically synthesized
tttcatttagcttttgtatttt

SEQ ID NO: 142177 - DNA, 22 bp, Artificial Sequence
  chemically synthesized
catttagcttttgtattttttt

SEQ ID NO: 142178 - DNA, 22 bp, Artificial Sequence
  chemically synthesized
atttagcttttgtatttttttg

SEQ ID NO: 142179 - DNA, 22 bp, Artificial Sequence
  chemically synthesized
agcttttgtatttttttgcagt

SEQ ID NO: 142180 - DNA, 22 bp, Artificial Sequence
  chemically synthesized
gcttttgtatttttttgcagtt

SEQ ID NO: 142181 - DNA, 22 bp, Artificial Sequence
  chemically synthesized
ttgtatttttttgcagttgttt

SEQ ID NO: 142182 - DNA, 22 bp, Artificial Sequence
  chemically synthesized
tgtatttttttgcagttgtttt

SEQ ID NO: 142183 - DNA, 22 bp, Artificial Sequence
  chemically synthesized
gtatttttttgcagttgtttta

SEQ ID NO: 142184 - DNA, 22 bp, Artificial Sequence
  chemically synthesized
tatttttttgcagttgttttaa

SEQ ID NO: 142185 - DNA, 22 bp, Artificial Sequence
  chemically synthesized
ttttgcagttgttttaatttca

SEQ ID NO: 142186 - DNA, 22 bp, Artificial Sequence
  chemically synthesized
tttgcagttgttttaatttcat

SEQ ID NO: 142187 - DNA, 22 bp, Artificial Sequence
  chemically synthesized
ttgcagttgttttaatttcatt

SEQ ID NO: 142188 - DNA, 22 bp, Artificial Sequence
  chemically synthesized
tgcagttgttttaatttcattt

SEQ ID NO: 142189 - DNA, 22 bp, Artificial Sequence
  chemically synthesized
gcagttgttttaatttcattta

SEQ ID NO: 142190 - DNA, 22 bp, Artificial Sequence
  chemically synthesized
cagttgttttaatttcatttag

SEQ ID NO: 142191 - DNA, 22 bp, Artificial Sequence
  chemically synthesized
ttttaatttcatttagttctcc

SEQ ID NO: 142192 - DNA, 22 bp, Artificial Sequence
  chemically synthesized
taatttcatttagttctcctct

SEQ ID NO: 142193 - DNA, 22 bp, Artificial Sequence
  chemically synthesized
aatttcatttagttctcctctt

SEQ ID NO: 142194 - DNA, 22 bp, Artificial Sequence
  chemically synthesized
atttcatttagttctcctctta

SEQ ID NO: 142195 - DNA, 22 bp, Artificial Sequence
  chemically synthesized
catttagttctcctcttatctt

SEQ ID NO: 142196 - DNA, 22 bp, Artificial Sequence
  chemically synthesized
atttagttctcctcttatctta

SEQ ID NO: 142197 - DNA, 22 bp, Artificial Sequence
  chemically synthesized
agttctcctcttatcttagtta

SEQ ID NO: 142198 - DNA, 22 bp, Artificial Sequence
  chemically synthesized
gttctcctcttatcttagttat

SEQ ID NO: 142199 - DNA, 22 bp, Artificial Sequence
  chemically synthesized
tcctcttatcttagttattccc

SEQ ID NO: 142200 - DNA, 22 bp, Artificial Sequence
  chemically synthesized
ctcttatcttagttattccctt

SEQ ID NO: 142201 - DNA, 22 bp, Artificial Sequence
  chemically synthesized
ttatcttagttattccctttct

SEQ ID NO: 142202 - DNA, 22 bp, Artificial Sequence
  chemically synthesized
atcttagttattccctttcttt

SEQ ID NO: 142203 - DNA, 22 bp, Artificial Sequence
  chemically synthesized
tcttagttattccctttctttt

SEQ ID NO: 142204 - DNA, 22 bp, Artificial Sequence
  chemically synthesized
agttattccctttcttttgctg

SEQ ID NO: 142205 - DNA, 22 bp, Artificial Sequence
  chemically synthesized
gttattccctttcttttgctgg

SEQ ID NO: 142206 - DNA, 22 bp, Artificial Sequence
  chemically synthesized
ttccctttcttttgctgggttt

SEQ ID NO: 142207 - DNA, 22 bp, Artificial Sequence
  chemically synthesized
cctttcttttgctgggttttgg

SEQ ID NO: 142208 - DNA, 22 bp, Artificial Sequence
  chemically synthesized
tcttttgctgggttttggttct

SEQ ID NO: 142209 - DNA, 22 bp, Artificial Sequence
  chemically synthesized
cttttgctgggttttggttctg

SEQ ID NO: 142210 - DNA, 22 bp, Artificial Sequence
  chemically synthesized
ttttgctgggttttggttctgt

SEQ ID NO: 142211 - DNA, 22 bp, Artificial Sequence
  chemically synthesized
ttgctgggttttggttctgttt

SEQ ID NO: 142212 - DNA, 22 bp, Artificial Sequence
  chemically synthesized
tgctgggttttggttctgtttg

SEQ ID NO: 142213 - DNA, 22 bp, Artificial Sequence
  chemically synthesized
gctgggttttggttctgtttgt

SEQ ID NO: 142214 - DNA, 22 bp, Artificial Sequence
  chemically synthesized
ctgggttttggttctgtttgtt

SEQ ID NO: 142215 - DNA, 22 bp, Artificial Sequence
  chemically synthesized
ggttttggttctgtttgttttt

SEQ ID NO: 142216 - DNA, 22 bp, Artificial Sequence
  chemically synthesized
tggttctgtttgtttttgtttc

SEQ ID NO: 142217 - DNA, 22 bp, Artificial Sequence
  chemically synthesized
ggttctgtttgtttttgtttct

SEQ ID NO: 142218 - DNA, 22 bp, Artificial Sequence
  chemically synthesized
gttctgtttgtttttgtttctc

SEQ ID NO: 142219 - DNA, 22 bp, Artificial Sequence
  chemically synthesized
tgtttgtttttgtttctctagt

SEQ ID NO: 142220 - DNA, 22 bp, Artificial Sequence
  chemically synthesized
tttgtttttgtttctctagttt

SEQ ID NO: 142221 - DNA, 22 bp, Artificial Sequence
  chemically synthesized
gtttttgtttctctagtttctt

SEQ ID NO: 142222 - DNA, 22 bp, Artificial Sequence
  chemically synthesized
tttttgtttctctagtttcttg

SEQ ID NO: 142223 - DNA, 22 bp, Artificial Sequence
  chemically synthesized
ttgtttctctagtttcttgtgg

SEQ ID NO: 142224 - DNA, 22 bp, Artificial Sequence
  chemically synthesized
tgtttctctagtttcttgtggt

SEQ ID NO: 142225 - DNA, 22 bp, Artificial Sequence
  chemically synthesized
gtttctctagtttcttgtggtg

SEQ ID NO: 142226 - DNA, 22 bp, Artificial Sequence
  chemically synthesized
tttctctagtttcttgtggtgt

SEQ ID NO: 142227 - DNA, 22 bp, Artificial Sequence
  chemically synthesized
ctctagtttcttgtggtgtgac

SEQ ID NO: 142228 - DNA, 22 bp, Artificial Sequence
  chemically synthesized
tctagtttcttgtggtgtgacc

SEQ ID NO: 142229 - DNA, 22 bp, Artificial Sequence
  chemically synthesized
tagtttcttgtggtgtgacctt

SEQ ID NO: 142230 - DNA, 22 bp, Artificial Sequence
  chemically synthesized
gtttcttgtggtgtgaccttat

SEQ ID NO: 142231 - DNA, 22 bp, Artificial Sequence
  chemically synthesized
cttgtggtgtgaccttatattg

SEQ ID NO: 142232 - DNA, 22 bp, Artificial Sequence
  chemically synthesized
ttgtggtgtgaccttatattgt

SEQ ID NO: 142233 - DNA, 22 bp, Artificial Sequence
  chemically synthesized
gtggtgtgaccttatattgtct

SEQ ID NO: 142234 - DNA, 22 bp, Artificial Sequence
  chemically synthesized
tggtgtgaccttatattgtctg

SEQ ID NO: 142235 - DNA, 22 bp, Artificial Sequence
  chemically synthesized
atattgtctgtctgtcctcttt

SEQ ID NO: 142236 - DNA, 22 bp, Artificial Sequence
  chemically synthesized
tattgtctgtctgtcctctttc

SEQ ID NO: 142237 - DNA, 22 bp, Artificial Sequence
  chemically synthesized
tctgtctgtcctctttcagact

SEQ ID NO: 142238 - DNA, 22 bp, Artificial Sequence
  chemically synthesized
tctgtcctctttcagactcttt

SEQ ID NO: 142239 - DNA, 22 bp, Artificial Sequence
  chemically synthesized
tcctctttcagactctttgaca

SEQ ID NO: 142240 - DNA, 22 bp, Artificial Sequence
  chemically synthesized
tttcagactctttgacatcgac

SEQ ID NO: 142241 - DNA, 22 bp, Artificial Sequence
  chemically synthesized
tcagactctttgacatcgacat

SEQ ID NO: 142242 - DNA, 22 bp, Artificial Sequence
  chemically synthesized
cagactctttgacatcgacatt

SEQ ID NO: 142243 - DNA, 22 bp, Artificial Sequence
  chemically synthesized
agactctttgacatcgacattt

SEQ ID NO: 142244 - DNA, 22 bp, Artificial Sequence
  chemically synthesized
tttgacatcgacatttagggct

SEQ ID NO: 142245 - DNA, 22 bp, Artificial Sequence
  chemically synthesized
tgacatcgacatttagggctgt

SEQ ID NO: 142246 - DNA, 22 bp, Artificial Sequence
  chemically synthesized
gacatcgacatttagggctgtg

SEQ ID NO: 142247 - DNA, 22 bp, Artificial Sequence
  chemically synthesized
acatcgacatttagggctgtga

SEQ ID NO: 142248 - DNA, 22 bp, Artificial Sequence
  chemically synthesized
agggctgtgaactttcctttta

SEQ ID NO: 142249 - DNA, 22 bp, Artificial Sequence
  chemically synthesized
gggctgtgaactttccttttag

SEQ ID NO: 142250 - DNA, 22 bp, Artificial Sequence
  chemically synthesized
tgaactttccttttagcaccat

SEQ ID NO: 142251 - DNA, 22 bp, Artificial Sequence
  chemically synthesized
tccttttagcaccatctttgct

SEQ ID NO: 142252 - DNA, 22 bp, Artificial Sequence
  chemically synthesized
ccttttagcaccatctttgctg

SEQ ID NO: 142253 - DNA, 22 bp, Artificial Sequence
  chemically synthesized
cttttagcaccatctttgctgt

SEQ ID NO: 142254 - DNA, 22 bp, Artificial Sequence
  chemically synthesized
ttagcaccatctttgctgtatc

SEQ ID NO: 142255 - DNA, 22 bp, Artificial Sequence
  chemically synthesized
tagcaccatctttgctgtatcc

SEQ ID NO: 142256 - DNA, 22 bp, Artificial Sequence
  chemically synthesized
agcaccatctttgctgtatcct

SEQ ID NO: 142257 - DNA, 22 bp, Artificial Sequence
  chemically synthesized
gcaccatctttgctgtatccta

SEQ ID NO: 142258 - DNA, 22 bp, Artificial Sequence
  chemically synthesized
tgctgtatcctagaggttttga

SEQ ID NO: 142259 - DNA, 22 bp, Artificial Sequence
  chemically synthesized
gctgtatcctagaggttttgat

SEQ ID NO: 142260 - DNA, 22 bp, Artificial Sequence
  chemically synthesized
ctgtatcctagaggttttgata

SEQ ID NO: 142261 - DNA, 22 bp, Artificial Sequence
  chemically synthesized
tatcctagaggttttgataggt

SEQ ID NO: 142262 - DNA, 22 bp, Artificial Sequence
  chemically synthesized
gaggttttgataggttgtgtca

SEQ ID NO: 142263 - DNA, 22 bp, Artificial Sequence
  chemically synthesized
tgataggttgtgtcactattgt

SEQ ID NO: 142264 - DNA, 22 bp, Artificial Sequence
  chemically synthesized
gataggttgtgtcactattgtc

SEQ ID NO: 142265 - DNA, 22 bp, Artificial Sequence
  chemically synthesized
ataggttgtgtcactattgtcg

SEQ ID NO: 142266 - DNA, 22 bp, Artificial Sequence
  chemically synthesized
tgtcactattgtcggtcagttc

SEQ ID NO: 142267 - DNA, 22 bp, Artificial Sequence
  chemically synthesized
ttgtcggtcagttcaagtaatt

SEQ ID NO: 142268 - DNA, 22 bp, Artificial Sequence
  chemically synthesized
tcggtcagttcaagtaattttg

SEQ ID NO: 142269 - DNA, 22 bp, Artificial Sequence
  chemically synthesized
aagtaattttgttgttcttatt

SEQ ID NO: 142270 - DNA, 22 bp, Artificial Sequence
  chemically synthesized
tgttgttcttattatactttaa

SEQ ID NO: 142271 - DNA, 22 bp, Artificial Sequence
  chemically synthesized
gttgttcttattatactttaag

SEQ ID NO: 142272 - DNA, 22 bp, Artificial Sequence
  chemically synthesized
ttgttcttattatactttaagt

SEQ ID NO: 142273 - DNA, 22 bp, Artificial Sequence
  chemically synthesized
ttcttattatactttaagttct

SEQ ID NO: 142274 - DNA, 22 bp, Artificial Sequence
  chemically synthesized
ttattatactttaagttctggg

SEQ ID NO: 142275 - DNA, 22 bp, Artificial Sequence
  chemically synthesized
attatactttaagttctgggat

SEQ ID NO: 142276 - DNA, 22 bp, Artificial Sequence
  chemically synthesized
ttatactttaagttctgggata

SEQ ID NO: 142277 - DNA, 22 bp, Artificial Sequence
  chemically synthesized
tactttaagttctgggatacat

SEQ ID NO: 142278 - DNA, 22 bp, Artificial Sequence
  chemically synthesized
taagttctgggatacatgtgca

SEQ ID NO: 142279 - DNA, 22 bp, Artificial Sequence
  chemically synthesized
aagttctgggatacatgtgcag

SEQ ID NO: 142280 - DNA, 22 bp, Artificial Sequence
  chemically synthesized
agttctgggatacatgtgcaga

SEQ ID NO: 142281 - DNA, 22 bp, Artificial Sequence
  chemically synthesized
tgggatacatgtgcagaatgtg

SEQ ID NO: 142282 - DNA, 22 bp, Artificial Sequence
  chemically synthesized
ggatacatgtgcagaatgtgca

SEQ ID NO: 142283 - DNA, 22 bp, Artificial Sequence
  chemically synthesized
gttacataggtatagatgtgcc

SEQ ID NO: 142284 - DNA, 22 bp, Artificial Sequence
  chemically synthesized
ttacataggtatagatgtgcca

SEQ ID NO: 142285 - DNA, 22 bp, Artificial Sequence
  chemically synthesized
cataggtatagatgtgccatgg

SEQ ID NO: 142286 - DNA, 22 bp, Artificial Sequence
  chemically synthesized
gctgcacccatcaacctgtcat

SEQ ID NO: 142287 - DNA, 22 bp, Artificial Sequence
  chemically synthesized
ctgcacccatcaacctgtcatc

SEQ ID NO: 142288 - DNA, 22 bp, Artificial Sequence
  chemically synthesized
cacccatcaacctgtcatctac

SEQ ID NO: 142289 - DNA, 22 bp, Artificial Sequence
  chemically synthesized
tcatctacattaggtatttctt

SEQ ID NO: 142290 - DNA, 22 bp, Artificial Sequence
  chemically synthesized
cattaggtatttcttttaatgt

SEQ ID NO: 142291 - DNA, 22 bp, Artificial Sequence
  chemically synthesized
ggtatttcttttaatgttatcc

SEQ ID NO: 142292 - DNA, 22 bp, Artificial Sequence
  chemically synthesized
cttttaatgttatccctctcct

SEQ ID NO: 142293 - DNA, 22 bp, Artificial Sequence
  chemically synthesized
ttttaatgttatccctctccta

SEQ ID NO: 142294 - DNA, 22 bp, Artificial Sequence
  chemically synthesized
ttaatgttatccctctcctaac

SEQ ID NO: 142295 - DNA, 22 bp, Artificial Sequence
  chemically synthesized
taatgttatccctctcctaacc

SEQ ID NO: 142296 - DNA, 22 bp, Artificial Sequence
  chemically synthesized
aatgttatccctctcctaaccc

SEQ ID NO: 142297 - DNA, 22 bp, Artificial Sequence
  chemically synthesized
atgttatccctctcctaacccc

SEQ ID NO: 142298 - DNA, 22 bp, Artificial Sequence
  chemically synthesized
tccctctcctaaccccctcacc

SEQ ID NO: 142299 - DNA, 22 bp, Artificial Sequence
  chemically synthesized
tcctaaccccctcaccccccga

SEQ ID NO: 142300 - DNA, 22 bp, Artificial Sequence
  chemically synthesized
ctaaccccctcaccccccgaca

SEQ ID NO: 142301 - DNA, 22 bp, Artificial Sequence
  chemically synthesized
accccctcaccccccgacaggc

SEQ ID NO: 142302 - DNA, 22 bp, Artificial Sequence
  chemically synthesized
accccccgacaggccctggtgt

SEQ ID NO: 142303 - DNA, 22 bp, Artificial Sequence
  chemically synthesized
gtgtgtgatgttcccctccctg

SEQ ID NO: 142304 - DNA, 22 bp, Artificial Sequence
  chemically synthesized
ccctccctgtgtccatgtgttc

SEQ ID NO: 142305 - DNA, 22 bp, Artificial Sequence
  chemically synthesized
cctgtgtccatgtgttctcatt

SEQ ID NO: 142306 - DNA, 22 bp, Artificial Sequence
  chemically synthesized
tgtccatgtgttctcattgttc

SEQ ID NO: 142307 - DNA, 22 bp, Artificial Sequence
  chemically synthesized
tcattgttcaactcccacttat

SEQ ID NO: 142308 - DNA, 22 bp, Artificial Sequence
  chemically synthesized
attgttcaactcccacttatga

SEQ ID NO: 142309 - DNA, 22 bp, Artificial Sequence
  chemically synthesized
ttcaactcccacttatgagtga

SEQ ID NO: 142310 - DNA, 22 bp, Artificial Sequence
  chemically synthesized
aactcccacttatgagtgagaa

SEQ ID NO: 142311 - DNA, 22 bp, Artificial Sequence
  chemically synthesized
ccacttatgagtgagaacgtgt

SEQ ID NO: 142312 - DNA, 22 bp, Artificial Sequence
  chemically synthesized
atgagtgagaacgtgtggtgtt

SEQ ID NO: 142313 - DNA, 22 bp, Artificial Sequence
  chemically synthesized
tgagtgagaacgtgtggtgttt

SEQ ID NO: 142314 - DNA, 22 bp, Artificial Sequence
  chemically synthesized
ggtttctctgttcctgtgttag

SEQ ID NO: 142315 - DNA, 22 bp, Artificial Sequence
  chemically synthesized
gtttctctgttcctgtgttagt

SEQ ID NO: 142316 - DNA, 22 bp, Artificial Sequence
  chemically synthesized
ctctgttcctgtgttagtttgc

SEQ ID NO: 142317 - DNA, 22 bp, Artificial Sequence
  chemically synthesized
tctgttcctgtgttagtttgct

SEQ ID NO: 142318 - DNA, 22 bp, Artificial Sequence
  chemically synthesized
tgttcctgtgttagtttgctca

SEQ ID NO: 142319 - DNA, 22 bp, Artificial Sequence
  chemically synthesized
ttcctgtgttagtttgctcaga

SEQ ID NO: 142320 - DNA, 22 bp, Artificial Sequence
  chemically synthesized
ctgtgttagtttgctcagaatg

SEQ ID NO: 142321 - DNA, 22 bp, Artificial Sequence
  chemically synthesized
tgttagtttgctcagaatgatg

SEQ ID NO: 142322 - DNA, 22 bp, Artificial Sequence
  chemically synthesized
gtttgctcagaatgatggtttc

SEQ ID NO: 142323 - DNA, 22 bp, Artificial Sequence
  chemically synthesized
gctcagaatgatggtttccacc

SEQ ID NO: 142324 - DNA, 22 bp, Artificial Sequence
  chemically synthesized
ctcagaatgatggtttccacct

SEQ ID NO: 142325 - DNA, 22 bp, Artificial Sequence
  chemically synthesized
agaatgatggtttccaccttca

SEQ ID NO: 142326 - DNA, 22 bp, Artificial Sequence
  chemically synthesized
ccaccttcatccatgtccctgc

SEQ ID NO: 142327 - DNA, 22 bp, Artificial Sequence
  chemically synthesized
caccttcatccatgtccctgca

SEQ ID NO: 142328 - DNA, 22 bp, Artificial Sequence
  chemically synthesized
catccatgtccctgcaaagaca

SEQ ID NO: 142329 - DNA, 22 bp, Artificial Sequence
  chemically synthesized
atccatgtccctgcaaagacat

SEQ ID NO: 142330 - DNA, 22 bp, Artificial Sequence
  chemically synthesized
caaagacatgaactcatcattt

SEQ ID NO: 142331 - DNA, 22 bp, Artificial Sequence
  chemically synthesized
atcatttttatggctgcatagt

SEQ ID NO: 142332 - DNA, 22 bp, Artificial Sequence
  chemically synthesized
ttatggctgcatagtattccat

SEQ ID NO: 142333 - DNA, 22 bp, Artificial Sequence
  chemically synthesized
tatggctgcatagtattccatg

SEQ ID NO: 142334 - DNA, 22 bp, Artificial Sequence
  chemically synthesized
atggctgcatagtattccatgg

SEQ ID NO: 142335 - DNA, 22 bp, Artificial Sequence
  chemically synthesized
tggctgcatagtattccatggt

SEQ ID NO: 142336 - DNA, 22 bp, Artificial Sequence
  chemically synthesized
catagtattccatggtgtatat

SEQ ID NO: 142337 - DNA, 22 bp, Artificial Sequence
  chemically synthesized
catggtgtatatgtgccacatt

SEQ ID NO: 142338 - DNA, 22 bp, Artificial Sequence
  chemically synthesized
tctttatccattatatcgctga

SEQ ID NO: 142339 - DNA, 22 bp, Artificial Sequence
  chemically synthesized
ctttatccattatatcgctgat

SEQ ID NO: 142340 - DNA, 22 bp, Artificial Sequence
  chemically synthesized
tttatccattatatcgctgatg

SEQ ID NO: 142341 - DNA, 22 bp, Artificial Sequence
  chemically synthesized
tatccattatatcgctgatggc

SEQ ID NO: 142342 - DNA, 22 bp, Artificial Sequence
  chemically synthesized
atccattatatcgctgatggcc

SEQ ID NO: 142343 - DNA, 22 bp, Artificial Sequence
  chemically synthesized
tccattatatcgctgatggcca

SEQ ID NO: 142344 - DNA, 22 bp, Artificial Sequence
  chemically synthesized
tatcgctgatggccatttgggt

SEQ ID NO: 142345 - DNA, 22 bp, Artificial Sequence
  chemically synthesized
atggccatttgggttggttcca

SEQ ID NO: 142346 - DNA, 22 bp, Artificial Sequence
  chemically synthesized
gggttggttccaagtctttgct

SEQ ID NO: 142347 - DNA, 22 bp, Artificial Sequence
  chemically synthesized
ggttggttccaagtctttgcta

SEQ ID NO: 142348 - DNA, 22 bp, Artificial Sequence
  chemically synthesized
gttccaagtctttgctattgtg

SEQ ID NO: 142349 - DNA, 22 bp, Artificial Sequence
  chemically synthesized
caagtctttgctattgtgaata

SEQ ID NO: 142350 - DNA, 22 bp, Artificial Sequence
  chemically synthesized
tgctattgtgaatagtgccaca

SEQ ID NO: 142351 - DNA, 22 bp, Artificial Sequence
  chemically synthesized
gctattgtgaatagtgccacaa

SEQ ID NO: 142352 - DNA, 22 bp, Artificial Sequence
  chemically synthesized
ctattgtgaatagtgccacaat

SEQ ID NO: 142353 - DNA, 22 bp, Artificial Sequence
  chemically synthesized
ttgtgaatagtgccacaataaa

SEQ ID NO: 142354 - DNA, 22 bp, Artificial Sequence
  chemically synthesized
tgaatagtgccacaataaacat

SEQ ID NO: 142355 - DNA, 22 bp, Artificial Sequence
  chemically synthesized
tatagtagaatgatttctaatt

SEQ ID NO: 142356 - DNA, 22 bp, Artificial Sequence
  chemically synthesized
atagtagaatgatttctaattc

SEQ ID NO: 142357 - DNA, 22 bp, Artificial Sequence
  chemically synthesized
tagtagaatgatttctaattct

SEQ ID NO: 142358 - DNA, 22 bp, Artificial Sequence
  chemically synthesized
ctaattctttgggtatataccc

SEQ ID NO: 142359 - DNA, 22 bp, Artificial Sequence
  chemically synthesized
taattctttgggtatataccca

SEQ ID NO: 142360 - DNA, 22 bp, Artificial Sequence
  chemically synthesized
attctttgggtatatacccagt

SEQ ID NO: 142361 - DNA, 22 bp, Artificial Sequence
  chemically synthesized
tttgggtatatacccagtaatg

SEQ ID NO: 142362 - DNA, 22 bp, Artificial Sequence
  chemically synthesized
tgggtatatacccagtaatggg

SEQ ID NO: 142363 - DNA, 22 bp, Artificial Sequence
  chemically synthesized
gggtatatacccagtaatggga

SEQ ID NO: 142364 - DNA, 22 bp, Artificial Sequence
  chemically synthesized
ggtatatacccagtaatgggat

SEQ ID NO: 142365 - DNA, 22 bp, Artificial Sequence
  chemically synthesized
ctgggtcaaacagtatttctgg

SEQ ID NO: 142366 - DNA, 22 bp, Artificial Sequence
  chemically synthesized
ggtcaaacagtatttctggttc

SEQ ID NO: 142367 - DNA, 22 bp, Artificial Sequence
  chemically synthesized
ctggttctagatccttgaggaa

SEQ ID NO: 142368 - DNA, 22 bp, Artificial Sequence
  chemically synthesized
tggttctagatccttgaggaat

SEQ ID NO: 142369 - DNA, 22 bp, Artificial Sequence
  chemically synthesized
gttctagatccttgaggaatcg

SEQ ID NO: 142370 - DNA, 22 bp, Artificial Sequence
  chemically synthesized
tagatccttgaggaatcgccac

SEQ ID NO: 142371 - DNA, 22 bp, Artificial Sequence
  chemically synthesized
gatccttgaggaatcgccacac

SEQ ID NO: 142372 - DNA, 22 bp, Artificial Sequence
  chemically synthesized
gaggaatcgccacactgtcttc

SEQ ID NO: 142373 - DNA, 22 bp, Artificial Sequence
  chemically synthesized
aggaatcgccacactgtcttcc

SEQ ID NO: 142374 - DNA, 22 bp, Artificial Sequence
  chemically synthesized
tcttccacaatggttgaactaa

SEQ ID NO: 142375 - DNA, 22 bp, Artificial Sequence
  chemically synthesized
ccacaatggttgaactaattta

SEQ ID NO: 142376 - DNA, 22 bp, Artificial Sequence
  chemically synthesized
cacaatggttgaactaatttac

SEQ ID NO: 142377 - DNA, 22 bp, Artificial Sequence
  chemically synthesized
aactaatttacacacccatcaa

SEQ ID NO: 142378 - DNA, 22 bp, Artificial Sequence
  chemically synthesized
atttacacacccatcaacagtg

SEQ ID NO: 142379 - DNA, 22 bp, Artificial Sequence
  chemically synthesized
acacacccatcaacagtgtaaa

SEQ ID NO: 142380 - DNA, 22 bp, Artificial Sequence
  chemically synthesized
cacacccatcaacagtgtaaaa

SEQ ID NO: 142381 - DNA, 22 bp, Artificial Sequence
  chemically synthesized
ttcctattcttccacatcctct

SEQ ID NO: 142382 - DNA, 22 bp, Artificial Sequence
  chemically synthesized
tcctattcttccacatcctctc

SEQ ID NO: 142383 - DNA, 22 bp, Artificial Sequence
  chemically synthesized
cctattcttccacatcctctcc

SEQ ID NO: 142384 - DNA, 22 bp, Artificial Sequence
  chemically synthesized
ctattcttccacatcctctcca

SEQ ID NO: 142385 - DNA, 22 bp, Artificial Sequence
  chemically synthesized
ttcttccacatcctctccagca

SEQ ID NO: 142386 - DNA, 22 bp, Artificial Sequence
  chemically synthesized
ttccacatcctctccagcacct

SEQ ID NO: 142387 - DNA, 22 bp, Artificial Sequence
  chemically synthesized
ccacatcctctccagcaccttt

SEQ ID NO: 142388 - DNA, 22 bp, Artificial Sequence
  chemically synthesized
cacatcctctccagcacctttt

SEQ ID NO: 142389 - DNA, 22 bp, Artificial Sequence
  chemically synthesized
tccagcaccttttgtttcctga

SEQ ID NO: 142390 - DNA, 22 bp, Artificial Sequence
  chemically synthesized
cagcaccttttgtttcctgact

SEQ ID NO: 142391 - DNA, 22 bp, Artificial Sequence
  chemically synthesized
ttgtttcctgactttttaataa

SEQ ID NO: 142392 - DNA, 22 bp, Artificial Sequence
  chemically synthesized
tgtttcctgactttttaataat

SEQ ID NO: 142393 - DNA, 22 bp, Artificial Sequence
  chemically synthesized
gtttcctgactttttaataatt

SEQ ID NO: 142394 - DNA, 22 bp, Artificial Sequence
  chemically synthesized
tttcctgactttttaataattg

SEQ ID NO: 142395 - DNA, 22 bp, Artificial Sequence
  chemically synthesized
cctgactttttaataattgcca

SEQ ID NO: 142396 - DNA, 22 bp, Artificial Sequence
  chemically synthesized
ctgactttttaataattgccat

SEQ ID NO: 142397 - DNA, 22 bp, Artificial Sequence
  chemically synthesized
actttttaataattgccattct

SEQ ID NO: 142398 - DNA, 22 bp, Artificial Sequence
  chemically synthesized
tttaataattgccattctaact

SEQ ID NO: 142399 - DNA, 22 bp, Artificial Sequence
  chemically synthesized
ttaataattgccattctaactg

SEQ ID NO: 142400 - DNA, 22 bp, Artificial Sequence
  chemically synthesized
taataattgccattctaactgg

SEQ ID NO: 142401 - DNA, 22 bp, Artificial Sequence
  chemically synthesized
aataattgccattctaactggc

SEQ ID NO: 142402 - DNA, 22 bp, Artificial Sequence
  chemically synthesized
ataattgccattctaactggca

SEQ ID NO: 142403 - DNA, 22 bp, Artificial Sequence
  chemically synthesized
ccattctaactggcatgagatg

SEQ ID NO: 142404 - DNA, 22 bp, Artificial Sequence
  chemically synthesized
taactggcatgagatggtatct

SEQ ID NO: 142405 - DNA, 22 bp, Artificial Sequence
  chemically synthesized
actggcatgagatggtatctca

SEQ ID NO: 142406 - DNA, 22 bp, Artificial Sequence
  chemically synthesized
gcatgagatggtatctcattgt

SEQ ID NO: 142407 - DNA, 22 bp, Artificial Sequence
  chemically synthesized
attgtggttttgatttgcattt

SEQ ID NO: 142408 - DNA, 22 bp, Artificial Sequence
  chemically synthesized
tggttttgatttgcatttctct

SEQ ID NO: 142409 - DNA, 22 bp, Artificial Sequence
  chemically synthesized
tgatttgcatttctctaatgac

SEQ ID NO: 142410 - DNA, 22 bp, Artificial Sequence
  chemically synthesized
gatttgcatttctctaatgacc

SEQ ID NO: 142411 - DNA, 22 bp, Artificial Sequence
  chemically synthesized
atttgcatttctctaatgacca

SEQ ID NO: 142412 - DNA, 22 bp, Artificial Sequence
  chemically synthesized
gcatttctctaatgaccagtga

SEQ ID NO: 142413 - DNA, 22 bp, Artificial Sequence
  chemically synthesized
catttctctaatgaccagtgat

SEQ ID NO: 142414 - DNA, 22 bp, Artificial Sequence
  chemically synthesized
ctctaatgaccagtgatgatga

SEQ ID NO: 142415 - DNA, 22 bp, Artificial Sequence
  chemically synthesized
tctaatgaccagtgatgatgag

SEQ ID NO: 142416 - DNA, 22 bp, Artificial Sequence
  chemically synthesized
taatgaccagtgatgatgagct

SEQ ID NO: 142417 - DNA, 22 bp, Artificial Sequence
  chemically synthesized
atgaccagtgatgatgagcttc

SEQ ID NO: 142418 - DNA, 22 bp, Artificial Sequence
  chemically synthesized
cttttcatgtgtttcttggcca

SEQ ID NO: 142419 - DNA, 22 bp, Artificial Sequence
  chemically synthesized
ttttcatgtgtttcttggccac

SEQ ID NO: 142420 - DNA, 22 bp, Artificial Sequence
  chemically synthesized
ttcatgtgtttcttggccacat

SEQ ID NO: 142421 - DNA, 22 bp, Artificial Sequence
  chemically synthesized
tcatgtgtttcttggccacata

SEQ ID NO: 142422 - DNA, 22 bp, Artificial Sequence
  chemically synthesized
catgtgtttcttggccacataa

SEQ ID NO: 142423 - DNA, 22 bp, Artificial Sequence
  chemically synthesized
atgtgtttcttggccacataaa

SEQ ID NO: 142424 - DNA, 22 bp, Artificial Sequence
  chemically synthesized
cttggccacataaatgacttct

SEQ ID NO: 142425 - DNA, 22 bp, Artificial Sequence
  chemically synthesized
ttggccacataaatgacttctt

SEQ ID NO: 142426 - DNA, 22 bp, Artificial Sequence
  chemically synthesized
ggccacataaatgacttcttta

SEQ ID NO: 142427 - DNA, 22 bp, Artificial Sequence
  chemically synthesized
gccacataaatgacttctttag

SEQ ID NO: 142428 - DNA, 22 bp, Artificial Sequence
  chemically synthesized
ctttagagaagcatctgttcat

SEQ ID NO: 142429 - DNA, 22 bp, Artificial Sequence
  chemically synthesized
tttagagaagcatctgttcata

SEQ ID NO: 142430 - DNA, 22 bp, Artificial Sequence
  chemically synthesized
tagagaagcatctgttcatatc

SEQ ID NO: 142431 - DNA, 22 bp, Artificial Sequence
  chemically synthesized
agagaagcatctgttcatatcc

SEQ ID NO: 142432 - DNA, 22 bp, Artificial Sequence
  chemically synthesized
gagaagcatctgttcatatcct

SEQ ID NO: 142433 - DNA, 22 bp, Artificial Sequence
  chemically synthesized
ttcatatcctttgtccactttt

SEQ ID NO: 142434 - DNA, 22 bp, Artificial Sequence
  chemically synthesized
atatcctttgtccactttttga

SEQ ID NO: 142435 - DNA, 22 bp, Artificial Sequence
  chemically synthesized
tgtccactttttgatggggtcg

SEQ ID NO: 142436 - DNA, 22 bp, Artificial Sequence
  chemically synthesized
gtccactttttgatggggtcgt

SEQ ID NO: 142437 - DNA, 22 bp, Artificial Sequence
  chemically synthesized
tccactttttgatggggtcgtt

SEQ ID NO: 142438 - DNA, 22 bp, Artificial Sequence
  chemically synthesized
tttgatggggtcgttaggtttt

SEQ ID NO: 142439 - DNA, 22 bp, Artificial Sequence
  chemically synthesized
ttgatggggtcgttaggttttt

SEQ ID NO: 142440 - DNA, 22 bp, Artificial Sequence
  chemically synthesized
tgatggggtcgttaggtttttt

SEQ ID NO: 142441 - DNA, 22 bp, Artificial Sequence
  chemically synthesized
gatggggtcgttaggttttttc

SEQ ID NO: 142442 - DNA, 22 bp, Artificial Sequence
  chemically synthesized
atggggtcgttaggttttttct

SEQ ID NO: 142443 - DNA, 22 bp, Artificial Sequence
  chemically synthesized
ggttttttcttgtaaatttgtt

SEQ ID NO: 142444 - DNA, 22 bp, Artificial Sequence
  chemically synthesized
tttcttgtaaatttgttgaagt

SEQ ID NO: 142445 - DNA, 22 bp, Artificial Sequence
  chemically synthesized
ttcttgtaaatttgttgaagtt

SEQ ID NO: 142446 - DNA, 22 bp, Artificial Sequence
  chemically synthesized
tcttgtaaatttgttgaagttc

SEQ ID NO: 142447 - DNA, 22 bp, Artificial Sequence
  chemically synthesized
cttgtaaatttgttgaagttct

SEQ ID NO: 142448 - DNA, 22 bp, Artificial Sequence
  chemically synthesized
ttgtaaatttgttgaagttctt

SEQ ID NO: 142449 - DNA, 22 bp, Artificial Sequence
  chemically synthesized
gtaaatttgttgaagttctttg

SEQ ID NO: 142450 - DNA, 22 bp, Artificial Sequence
  chemically synthesized
taaatttgttgaagttctttgt

SEQ ID NO: 142451 - DNA, 22 bp, Artificial Sequence
  chemically synthesized
gttgaagttctttgtagatttt

SEQ ID NO: 142452 - DNA, 22 bp, Artificial Sequence
  chemically synthesized
ttgaagttctttgtagattttg

SEQ ID NO: 142453 - DNA, 22 bp, Artificial Sequence
  chemically synthesized
aagttctttgtagattttggat

SEQ ID NO: 142454 - DNA, 22 bp, Artificial Sequence
  chemically synthesized
tttgtagattttggatgttagc

SEQ ID NO: 142455 - DNA, 22 bp, Artificial Sequence
  chemically synthesized
tgtagattttggatgttagccc

SEQ ID NO: 142456 - DNA, 22 bp, Artificial Sequence
  chemically synthesized
gtagattttggatgttagccct

SEQ ID NO: 142457 - DNA, 22 bp, Artificial Sequence
  chemically synthesized
tagattttggatgttagccctt

SEQ ID NO: 142458 - DNA, 22 bp, Artificial Sequence
  chemically synthesized
tggatgttagccctttgtcaga

SEQ ID NO: 142459 - DNA, 22 bp, Artificial Sequence
  chemically synthesized
ggatgttagccctttgtcagat

SEQ ID NO: 142460 - DNA, 22 bp, Artificial Sequence
  chemically synthesized
gatgttagccctttgtcagatg

SEQ ID NO: 142461 - DNA, 22 bp, Artificial Sequence
  chemically synthesized
gccctttgtcagatggatagat

SEQ ID NO: 142462 - DNA, 22 bp, Artificial Sequence
  chemically synthesized
tgtcagatggatagattgcaaa

SEQ ID NO: 142463 - DNA, 22 bp, Artificial Sequence
  chemically synthesized
gtcagatggatagattgcaaaa

SEQ ID NO: 142464 - DNA, 22 bp, Artificial Sequence
  chemically synthesized
tcagatggatagattgcaaaaa

SEQ ID NO: 142465 - DNA, 22 bp, Artificial Sequence
  chemically synthesized
caaaaattttctcccattctgt

SEQ ID NO: 142466 - DNA, 22 bp, Artificial Sequence
  chemically synthesized
tctcccattctgtaggttgcct

SEQ ID NO: 142467 - DNA, 22 bp, Artificial Sequence
  chemically synthesized
ctcccattctgtaggttgcctg

SEQ ID NO: 142468 - DNA, 22 bp, Artificial Sequence
  chemically synthesized
tcccattctgtaggttgcctgt

SEQ ID NO: 142469 - DNA, 22 bp, Artificial Sequence
  chemically synthesized
ccattctgtaggttgcctgttc

SEQ ID NO: 142470 - DNA, 22 bp, Artificial Sequence
  chemically synthesized
tgtaggttgcctgttcactctg

SEQ ID NO: 142471 - DNA, 22 bp, Artificial Sequence
  chemically synthesized
taggttgcctgttcactctgat

SEQ ID NO: 142472 - DNA, 22 bp, Artificial Sequence
  chemically synthesized
cctgttcactctgatgatagtc

SEQ ID NO: 142473 - DNA, 22 bp, Artificial Sequence
  chemically synthesized
ttcactctgatgatagtctttt

SEQ ID NO: 142474 - DNA, 22 bp, Artificial Sequence
  chemically synthesized
actctgatgatagtcttttgct

SEQ ID NO: 142475 - DNA, 22 bp, Artificial Sequence
  chemically synthesized
tgatgatagtcttttgctgtgc

SEQ ID NO: 142476 - DNA, 22 bp, Artificial Sequence
  chemically synthesized
atgatagtcttttgctgtgcag

SEQ ID NO: 142477 - DNA, 22 bp, Artificial Sequence
  chemically synthesized
ttgctgtgcagaagctctttag

SEQ ID NO: 142478 - DNA, 22 bp, Artificial Sequence
  chemically synthesized
tgctgtgcagaagctctttagt

SEQ ID NO: 142479 - DNA, 22 bp, Artificial Sequence
  chemically synthesized
gctgtgcagaagctctttagtt

SEQ ID NO: 142480 - DNA, 22 bp, Artificial Sequence
  chemically synthesized
ctgtgcagaagctctttagttt

SEQ ID NO: 142481 - DNA, 22 bp, Artificial Sequence
  chemically synthesized
tgcagaagctctttagtttaat

SEQ ID NO: 142482 - DNA, 22 bp, Artificial Sequence
  chemically synthesized
tttagtttaattagatcccata

SEQ ID NO: 142483 - DNA, 22 bp, Artificial Sequence
  chemically synthesized
tagtttaattagatcccatatg

SEQ ID NO: 142484 - DNA, 22 bp, Artificial Sequence
  chemically synthesized
agtttaattagatcccatatgt

SEQ ID NO: 142485 - DNA, 22 bp, Artificial Sequence
  chemically synthesized
gtttaattagatcccatatgtc

SEQ ID NO: 142486 - DNA, 22 bp, Artificial Sequence
  chemically synthesized
aattagatcccatatgtcaatt

SEQ ID NO: 142487 - DNA, 22 bp, Artificial Sequence
  chemically synthesized
attagatcccatatgtcaattt

SEQ ID NO: 142488 - DNA, 22 bp, Artificial Sequence
  chemically synthesized
gatcccatatgtcaattttggc

SEQ ID NO: 142489 - DNA, 22 bp, Artificial Sequence
  chemically synthesized
tggcctttgttgtcattgcttt

SEQ ID NO: 142490 - DNA, 22 bp, Artificial Sequence
  chemically synthesized
ggcctttgttgtcattgctttt

SEQ ID NO: 142491 - DNA, 22 bp, Artificial Sequence
  chemically synthesized
gcctttgttgtcattgcttttg

SEQ ID NO: 142492 - DNA, 22 bp, Artificial Sequence
  chemically synthesized
tgttgtcattgcttttgatgtt

SEQ ID NO: 142493 - DNA, 22 bp, Artificial Sequence
  chemically synthesized
gttgtcattgcttttgatgttt

SEQ ID NO: 142494 - DNA, 22 bp, Artificial Sequence
  chemically synthesized
ttgtcattgcttttgatgtttt

SEQ ID NO: 142495 - DNA, 22 bp, Artificial Sequence
  chemically synthesized
tcattgcttttgatgttttagt

SEQ ID NO: 142496 - DNA, 22 bp, Artificial Sequence
  chemically synthesized
cttttgatgttttagtcgtgaa

SEQ ID NO: 142497 - DNA, 22 bp, Artificial Sequence
  chemically synthesized
ttgatgttttagtcgtgaattt

SEQ ID NO: 142498 - DNA, 22 bp, Artificial Sequence
  chemically synthesized
tgatgttttagtcgtgaatttt

SEQ ID NO: 142499 - DNA, 22 bp, Artificial Sequence
  chemically synthesized
gatgttttagtcgtgaattttt

SEQ ID NO: 142500 - DNA, 22 bp, Artificial Sequence
  chemically synthesized
atgttttagtcgtgaatttttg

SEQ ID NO: 142501 - DNA, 22 bp, Artificial Sequence
  chemically synthesized
tagtcgtgaatttttgcccatg

SEQ ID NO: 142502 - DNA, 22 bp, Artificial Sequence
  chemically synthesized
agtcgtgaatttttgcccatgc

SEQ ID NO: 142503 - DNA, 22 bp, Artificial Sequence
  chemically synthesized
gtcgtgaatttttgcccatgcc

SEQ ID NO: 142504 - DNA, 22 bp, Artificial Sequence
  chemically synthesized
ttgcccatgcctatgtcctgaa

SEQ ID NO: 142505 - DNA, 22 bp, Artificial Sequence
  chemically synthesized
tgcccatgcctatgtcctgaat

SEQ ID NO: 142506 - DNA, 22 bp, Artificial Sequence
  chemically synthesized
gcccatgcctatgtcctgaatg

SEQ ID NO: 142507 - DNA, 22 bp, Artificial Sequence
  chemically synthesized
cccatgcctatgtcctgaatgg

SEQ ID NO: 142508 - DNA, 22 bp, Artificial Sequence
  chemically synthesized
tgtcctgaatggtattgcctag

SEQ ID NO: 142509 - DNA, 22 bp, Artificial Sequence
  chemically synthesized
aatggtattgcctaggttatct

SEQ ID NO: 142510 - DNA, 22 bp, Artificial Sequence
  chemically synthesized
cctaggttatcttctaggattt

SEQ ID NO: 142511 - DNA, 22 bp, Artificial Sequence
  chemically synthesized
ggttatcttctaggatttttat

SEQ ID NO: 142512 - DNA, 22 bp, Artificial Sequence
  chemically synthesized
tcttctaggatttttatggttt

SEQ ID NO: 142513 - DNA, 22 bp, Artificial Sequence
  chemically synthesized
ctaggatttttatggttttagg

SEQ ID NO: 142514 - DNA, 22 bp, Artificial Sequence
  chemically synthesized
taggatttttatggttttaggt

SEQ ID NO: 142515 - DNA, 22 bp, Artificial Sequence
  chemically synthesized
ggatttttatggttttaggttg

SEQ ID NO: 142516 - DNA, 22 bp, Artificial Sequence
  chemically synthesized
ttatggttttaggttgcacatt

SEQ ID NO: 142517 - DNA, 22 bp, Artificial Sequence
  chemically synthesized
tatggttttaggttgcacattt

SEQ ID NO: 142518 - DNA, 22 bp, Artificial Sequence
  chemically synthesized
atggttttaggttgcacattta

SEQ ID NO: 142519 - DNA, 22 bp, Artificial Sequence
  chemically synthesized
tggttttaggttgcacatttaa

SEQ ID NO: 142520 - DNA, 22 bp, Artificial Sequence
  chemically synthesized
taggttgcacatttaagtcttt

SEQ ID NO: 142521 - DNA, 22 bp, Artificial Sequence
  chemically synthesized
aggttgcacatttaagtcttta

SEQ ID NO: 142522 - DNA, 22 bp, Artificial Sequence
  chemically synthesized
ggttgcacatttaagtctttaa

SEQ ID NO: 142523 - DNA, 22 bp, Artificial Sequence
  chemically synthesized
cacatttaagtctttaatccac

SEQ ID NO: 142524 - DNA, 22 bp, Artificial Sequence
  chemically synthesized
aagtctttaatccaccttgagt

SEQ ID NO: 142525 - DNA, 22 bp, Artificial Sequence
  chemically synthesized
agtctttaatccaccttgagtt

SEQ ID NO: 142526 - DNA, 22 bp, Artificial Sequence
  chemically synthesized
taatccaccttgagttaatttt

SEQ ID NO: 142527 - DNA, 22 bp, Artificial Sequence
  chemically synthesized
aatccaccttgagttaattttt

SEQ ID NO: 142528 - DNA, 22 bp, Artificial Sequence
  chemically synthesized
atccaccttgagttaatttttg

SEQ ID NO: 142529 - DNA, 22 bp, Artificial Sequence
  chemically synthesized
gagttaatttttgtataaggtg

SEQ ID NO: 142530 - DNA, 22 bp, Artificial Sequence
  chemically synthesized
agttaatttttgtataaggtgt

SEQ ID NO: 142531 - DNA, 22 bp, Artificial Sequence
  chemically synthesized
atttttgtataaggtgtaagga

SEQ ID NO: 142532 - DNA, 22 bp, Artificial Sequence
  chemically synthesized
ttgtataaggtgtaaggaaggg

SEQ ID NO: 142533 - DNA, 22 bp, Artificial Sequence
  chemically synthesized
tgtataaggtgtaaggaagggg

SEQ ID NO: 142534 - DNA, 22 bp, Artificial Sequence
  chemically synthesized
gtataaggtgtaaggaaggggt

SEQ ID NO: 142535 - DNA, 22 bp, Artificial Sequence
  chemically synthesized
tataaggtgtaaggaaggggta

SEQ ID NO: 142536 - DNA, 22 bp, Artificial Sequence
  chemically synthesized
cagttttatgcatattgctagc

SEQ ID NO: 142537 - DNA, 22 bp, Artificial Sequence
  chemically synthesized
agttttatgcatattgctagcc

SEQ ID NO: 142538 - DNA, 22 bp, Artificial Sequence
  chemically synthesized
tatgcatattgctagccagttt

SEQ ID NO: 142539 - DNA, 22 bp, Artificial Sequence
  chemically synthesized
atgcatattgctagccagtttt

SEQ ID NO: 142540 - DNA, 22 bp, Artificial Sequence
  chemically synthesized
tgcatattgctagccagttttt

SEQ ID NO: 142541 - DNA, 22 bp, Artificial Sequence
  chemically synthesized
ctagccagtttttccagcacca

SEQ ID NO: 142542 - DNA, 22 bp, Artificial Sequence
  chemically synthesized
gccagtttttccagcaccattt

SEQ ID NO: 142543 - DNA, 22 bp, Artificial Sequence
  chemically synthesized
ttccagcaccatttattaaata

SEQ ID NO: 142544 - DNA, 22 bp, Artificial Sequence
  chemically synthesized
tccagcaccatttattaaatag

SEQ ID NO: 142545 - DNA, 22 bp, Artificial Sequence
  chemically synthesized
ccagcaccatttattaaatagg

SEQ ID NO: 142546 - DNA, 22 bp, Artificial Sequence
  chemically synthesized
cagcaccatttattaaataggg

SEQ ID NO: 142547 - DNA, 22 bp, Artificial Sequence
  chemically synthesized
attaaatagggaattctttctc

SEQ ID NO: 142548 - DNA, 22 bp, Artificial Sequence
  chemically synthesized
ttaaatagggaattctttctcc

SEQ ID NO: 142549 - DNA, 22 bp, Artificial Sequence
  chemically synthesized
aatagggaattctttctccatt

SEQ ID NO: 142550 - DNA, 22 bp, Artificial Sequence
  chemically synthesized
tttctccattgcttttgtgatg

SEQ ID NO: 142551 - DNA, 22 bp, Artificial Sequence
  chemically synthesized
tctccattgcttttgtgatgtt

SEQ ID NO: 142552 - DNA, 22 bp, Artificial Sequence
  chemically synthesized
ctccattgcttttgtgatgttt

SEQ ID NO: 142553 - DNA, 22 bp, Artificial Sequence
  chemically synthesized
tccattgcttttgtgatgtttg

SEQ ID NO: 142554 - DNA, 22 bp, Artificial Sequence
  chemically synthesized
cattgcttttgtgatgtttgtc

SEQ ID NO: 142555 - DNA, 22 bp, Artificial Sequence
  chemically synthesized
cttttgtgatgtttgtcaaaga

SEQ ID NO: 142556 - DNA, 22 bp, Artificial Sequence
  chemically synthesized
ttgtgatgtttgtcaaagatca

SEQ ID NO: 142557 - DNA, 22 bp, Artificial Sequence
  chemically synthesized
tgtgatgtttgtcaaagatcag

SEQ ID NO: 142558 - DNA, 22 bp, Artificial Sequence
  chemically synthesized
gtgatgtttgtcaaagatcaga

SEQ ID NO: 142559 - DNA, 22 bp, Artificial Sequence
  chemically synthesized
tgatgtttgtcaaagatcagat

SEQ ID NO: 142560 - DNA, 22 bp, Artificial Sequence
  chemically synthesized
gtcaaagatcagatggtcgtag

SEQ ID NO: 142561 - DNA, 22 bp, Artificial Sequence
  chemically synthesized
tcaaagatcagatggtcgtaga

SEQ ID NO: 142562 - DNA, 22 bp, Artificial Sequence
  chemically synthesized
tttctgaggcttctgttctgtt

SEQ ID NO: 142563 - DNA, 22 bp, Artificial Sequence
  chemically synthesized
ctgaggcttctgttctgttcca

SEQ ID NO: 142564 - DNA, 22 bp, Artificial Sequence
  chemically synthesized
tgaggcttctgttctgttccac

SEQ ID NO: 142565 - DNA, 22 bp, Artificial Sequence
  chemically synthesized
aggcttctgttctgttccactg

SEQ ID NO: 142566 - DNA, 22 bp, Artificial Sequence
  chemically synthesized
ctgttctgttccactggtctat

SEQ ID NO: 142567 - DNA, 22 bp, Artificial Sequence
  chemically synthesized
tgttctgttccactggtctata

SEQ ID NO: 142568 - DNA, 22 bp, Artificial Sequence
  chemically synthesized
ttctgttccactggtctatata

SEQ ID NO: 142569 - DNA, 22 bp, Artificial Sequence
  chemically synthesized
tgttccactggtctatatatct

SEQ ID NO: 142570 - DNA, 22 bp, Artificial Sequence
  chemically synthesized
ttccactggtctatatatctgt

SEQ ID NO: 142571 - DNA, 22 bp, Artificial Sequence
  chemically synthesized
cactggtctatatatctgtttt

SEQ ID NO: 142572 - DNA, 22 bp, Artificial Sequence
  chemically synthesized
gtctatatatctgttttggtac

SEQ ID NO: 142573 - DNA, 22 bp, Artificial Sequence
  chemically synthesized
tatatctgttttggtaccagta

SEQ ID NO: 142574 - DNA, 22 bp, Artificial Sequence
  chemically synthesized
ttttggtaccagtaccatgctg

SEQ ID NO: 142575 - DNA, 22 bp, Artificial Sequence
  chemically synthesized
tggtaccagtaccatgctgttt

SEQ ID NO: 142576 - DNA, 22 bp, Artificial Sequence
  chemically synthesized
ggtaccagtaccatgctgtttt

SEQ ID NO: 142577 - DNA, 22 bp, Artificial Sequence
  chemically synthesized
gtaccagtaccatgctgttttt

SEQ ID NO: 142578 - DNA, 22 bp, Artificial Sequence
  chemically synthesized
tttttgttactgtagccttgta

SEQ ID NO: 142579 - DNA, 22 bp, Artificial Sequence
  chemically synthesized
ttgttactgtagccttgtagta

SEQ ID NO: 142580 - DNA, 22 bp, Artificial Sequence
  chemically synthesized
tgttactgtagccttgtagtat

SEQ ID NO: 142581 - DNA, 22 bp, Artificial Sequence
  chemically synthesized
gttactgtagccttgtagtata

SEQ ID NO: 142582 - DNA, 22 bp, Artificial Sequence
  chemically synthesized
ttactgtagccttgtagtatag

SEQ ID NO: 142583 - DNA, 22 bp, Artificial Sequence
  chemically synthesized
ctgtagccttgtagtatagttt

SEQ ID NO: 142584 - DNA, 22 bp, Artificial Sequence
  chemically synthesized
tagccttgtagtatagtttgaa

SEQ ID NO: 142585 - DNA, 22 bp, Artificial Sequence
  chemically synthesized
gtagtatagtttgaagtcaggt

SEQ ID NO: 142586 - DNA, 22 bp, Artificial Sequence
  chemically synthesized
tagtatagtttgaagtcaggta

SEQ ID NO: 142587 - DNA, 22 bp, Artificial Sequence
  chemically synthesized
gaagtcaggtagcatcatgcct

SEQ ID NO: 142588 - DNA, 22 bp, Artificial Sequence
  chemically synthesized
aagtcaggtagcatcatgcctc

SEQ ID NO: 142589 - DNA, 22 bp, Artificial Sequence
  chemically synthesized
cagctttgttctttttgtttag

SEQ ID NO: 142590 - DNA, 22 bp, Artificial Sequence
  chemically synthesized
tgttctttttgtttaggattgt

SEQ ID NO: 142591 - DNA, 22 bp, Artificial Sequence
  chemically synthesized
gttctttttgtttaggattgtc

SEQ ID NO: 142592 - DNA, 22 bp, Artificial Sequence
  chemically synthesized
ttctttttgtttaggattgtct

SEQ ID NO: 142593 - DNA, 22 bp, Artificial Sequence
  chemically synthesized
tttttgtttaggattgtcttgg

SEQ ID NO: 142594 - DNA, 22 bp, Artificial Sequence
  chemically synthesized
tttgtttaggattgtcttggct

SEQ ID NO: 142595 - DNA, 22 bp, Artificial Sequence
  chemically synthesized
ttgtttaggattgtcttggcta

SEQ ID NO: 142596 - DNA, 22 bp, Artificial Sequence
  chemically synthesized
tgtttaggattgtcttggctat

SEQ ID NO: 142597 - DNA, 22 bp, Artificial Sequence
  chemically synthesized
gtttaggattgtcttggctata

SEQ ID NO: 142598 - DNA, 22 bp, Artificial Sequence
  chemically synthesized
tttaggattgtcttggctatat

SEQ ID NO: 142599 - DNA, 22 bp, Artificial Sequence
  chemically synthesized
aggattgtcttggctatatggg

SEQ ID NO: 142600 - DNA, 22 bp, Artificial Sequence
  chemically synthesized
ggattgtcttggctatatgggc

SEQ ID NO: 142601 - DNA, 22 bp, Artificial Sequence
  chemically synthesized
tcttggctatatgggctctttt

SEQ ID NO: 142602 - DNA, 22 bp, Artificial Sequence
  chemically synthesized
ggctatatgggctcttttttga

SEQ ID NO: 142603 - DNA, 22 bp, Artificial Sequence
  chemically synthesized
gctatatgggctcttttttgat

SEQ ID NO: 142604 - DNA, 22 bp, Artificial Sequence
  chemically synthesized
tatgggctcttttttgattcca

SEQ ID NO: 142605 - DNA, 22 bp, Artificial Sequence
  chemically synthesized
ttttttgattccatatgacatt

SEQ ID NO: 142606 - DNA, 22 bp, Artificial Sequence
  chemically synthesized
ttttgattccatatgacattta

SEQ ID NO: 142607 - DNA, 22 bp, Artificial Sequence
  chemically synthesized
tttgattccatatgacatttaa

SEQ ID NO: 142608 - DNA, 22 bp, Artificial Sequence
  chemically synthesized
ttgattccatatgacatttaaa

SEQ ID NO: 142609 - DNA, 22 bp, Artificial Sequence
  chemically synthesized
tgattccatatgacatttaaag

SEQ ID NO: 142610 - DNA, 22 bp, Artificial Sequence
  chemically synthesized
gattccatatgacatttaaagt

SEQ ID NO: 142611 - DNA, 22 bp, Artificial Sequence
  chemically synthesized
attccatatgacatttaaagta

SEQ ID NO: 142612 - DNA, 22 bp, Artificial Sequence
  chemically synthesized
catatgacatttaaagtagttt

SEQ ID NO: 142613 - DNA, 22 bp, Artificial Sequence
  chemically synthesized
aaagtagttttttctaattctt

SEQ ID NO: 142614 - DNA, 22 bp, Artificial Sequence
  chemically synthesized
aagtagttttttctaattcttt

SEQ ID NO: 142615 - DNA, 22 bp, Artificial Sequence
  chemically synthesized
tttctaattctttgaaaaaagt

SEQ ID NO: 142616 - DNA, 22 bp, Artificial Sequence
  chemically synthesized
ttctaattctttgaaaaaagtc

SEQ ID NO: 142617 - DNA, 22 bp, Artificial Sequence
  chemically synthesized
tctaattctttgaaaaaagtca

SEQ ID NO: 142618 - DNA, 22 bp, Artificial Sequence
  chemically synthesized
ctaattctttgaaaaaagtcag

SEQ ID NO: 142619 - DNA, 22 bp, Artificial Sequence
  chemically synthesized
taattctttgaaaaaagtcagt

SEQ ID NO: 142620 - DNA, 22 bp, Artificial Sequence
  chemically synthesized
attctttgaaaaaagtcagtgg

SEQ ID NO: 142621 - DNA, 22 bp, Artificial Sequence
  chemically synthesized
tttgaaaaaagtcagtggtagc

SEQ ID NO: 142622 - DNA, 22 bp, Artificial Sequence
  chemically synthesized
tgaaaaaagtcagtggtagctt

SEQ ID NO: 142623 - DNA, 22 bp, Artificial Sequence
  chemically synthesized
gaaaaaagtcagtggtagcttg

SEQ ID NO: 142624 - DNA, 22 bp, Artificial Sequence
  chemically synthesized
aaaaaagtcagtggtagcttga

SEQ ID NO: 142625 - DNA, 22 bp, Artificial Sequence
  chemically synthesized
gatggggatagcattgaatcta

SEQ ID NO: 142626 - DNA, 22 bp, Artificial Sequence
  chemically synthesized
atggggatagcattgaatctat

SEQ ID NO: 142627 - DNA, 22 bp, Artificial Sequence
  chemically synthesized
aatctataaattactttgggca

SEQ ID NO: 142628 - DNA, 22 bp, Artificial Sequence
  chemically synthesized
taaattactttgggcagtatgg

SEQ ID NO: 142629 - DNA, 22 bp, Artificial Sequence
  chemically synthesized
ctttgggcagtatggccatttt

SEQ ID NO: 142630 - DNA, 22 bp, Artificial Sequence
  chemically synthesized
tgggcagtatggccattttaaa

SEQ ID NO: 142631 - DNA, 22 bp, Artificial Sequence
  chemically synthesized
gggcagtatggccattttaaag

SEQ ID NO: 142632 - DNA, 22 bp, Artificial Sequence
  chemically synthesized
ggcagtatggccattttaaaga

SEQ ID NO: 142633 - DNA, 22 bp, Artificial Sequence
  chemically synthesized
taaagatattgattctttctat

SEQ ID NO: 142634 - DNA, 22 bp, Artificial Sequence
  chemically synthesized
aaagatattgattctttctatc

SEQ ID NO: 142635 - DNA, 22 bp, Artificial Sequence
  chemically synthesized
aagatattgattctttctatct

SEQ ID NO: 142636 - DNA, 22 bp, Artificial Sequence
  chemically synthesized
attctttctatctatgagcatg

SEQ ID NO: 142637 - DNA, 22 bp, Artificial Sequence
  chemically synthesized
tttctatctatgagcatggaat

SEQ ID NO: 142638 - DNA, 22 bp, Artificial Sequence
  chemically synthesized
tctatctatgagcatggaatgt

SEQ ID NO: 142639 - DNA, 22 bp, Artificial Sequence
  chemically synthesized
ctatctatgagcatggaatgtt

SEQ ID NO: 142640 - DNA, 22 bp, Artificial Sequence
  chemically synthesized
tatctatgagcatggaatgttt

SEQ ID NO: 142641 - DNA, 22 bp, Artificial Sequence
  chemically synthesized
tctatgagcatggaatgttttt

SEQ ID NO: 142642 - DNA, 22 bp, Artificial Sequence
  chemically synthesized
tgagcatggaatgtttttccat

SEQ ID NO: 142643 - DNA, 22 bp, Artificial Sequence
  chemically synthesized
ttccatttgtttgtgtcctctc

SEQ ID NO: 142644 - DNA, 22 bp, Artificial Sequence
  chemically synthesized
tccatttgtttgtgtcctctct

SEQ ID NO: 142645 - DNA, 22 bp, Artificial Sequence
  chemically synthesized
ccatttgtttgtgtcctctctt

SEQ ID NO: 142646 - DNA, 22 bp, Artificial Sequence
  chemically synthesized
catttgtttgtgtcctctctta

SEQ ID NO: 142647 - DNA, 22 bp, Artificial Sequence
  chemically synthesized
gtttgtgtcctctcttatttcc

SEQ ID NO: 142648 - DNA, 22 bp, Artificial Sequence
  chemically synthesized
tttgtgtcctctcttatttcct

SEQ ID NO: 142649 - DNA, 22 bp, Artificial Sequence
  chemically synthesized
gtgtcctctcttatttccttga

SEQ ID NO: 142650 - DNA, 22 bp, Artificial Sequence
  chemically synthesized
tgtcctctcttatttccttgag

SEQ ID NO: 142651 - DNA, 22 bp, Artificial Sequence
  chemically synthesized
tcttatttccttgagcagtgag

SEQ ID NO: 142652 - DNA, 22 bp, Artificial Sequence
  chemically synthesized
ttatttccttgagcagtgagtg

SEQ ID NO: 142653 - DNA, 22 bp, Artificial Sequence
  chemically synthesized
atttccttgagcagtgagtggt

SEQ ID NO: 142654 - DNA, 22 bp, Artificial Sequence
  chemically synthesized
tttccttgagcagtgagtggtt

SEQ ID NO: 142655 - DNA, 22 bp, Artificial Sequence
  chemically synthesized
ccttgagcagtgagtggtttgt

SEQ ID NO: 142656 - DNA, 22 bp, Artificial Sequence
  chemically synthesized
cttgagcagtgagtggtttgta

SEQ ID NO: 142657 - DNA, 22 bp, Artificial Sequence
  chemically synthesized
gagcagtgagtggtttgtagct

SEQ ID NO: 142658 - DNA, 22 bp, Artificial Sequence
  chemically synthesized
agcagtgagtggtttgtagctc

SEQ ID NO: 142659 - DNA, 22 bp, Artificial Sequence
  chemically synthesized
gtagctctccttgaagaggttc

SEQ ID NO: 142660 - DNA, 22 bp, Artificial Sequence
  chemically synthesized
tagctctccttgaagaggttct

SEQ ID NO: 142661 - DNA, 22 bp, Artificial Sequence
  chemically synthesized
tccttgaagaggttcttcacat

SEQ ID NO: 142662 - DNA, 22 bp, Artificial Sequence
  chemically synthesized
cttgaagaggttcttcacatcc

SEQ ID NO: 142663 - DNA, 22 bp, Artificial Sequence
  chemically synthesized
gaagaggttcttcacatccctt

SEQ ID NO: 142664 - DNA, 22 bp, Artificial Sequence
  chemically synthesized
aagaggttcttcacatccctta

SEQ ID NO: 142665 - DNA, 22 bp, Artificial Sequence
  chemically synthesized
ttcacatcccttagaagttgta

SEQ ID NO: 142666 - DNA, 22 bp, Artificial Sequence
  chemically synthesized
cacatcccttagaagttgtatt

SEQ ID NO: 142667 - DNA, 22 bp, Artificial Sequence
  chemically synthesized
acatcccttagaagttgtattt

SEQ ID NO: 142668 - DNA, 22 bp, Artificial Sequence
  chemically synthesized
agaagttgtatttctaggtatt

SEQ ID NO: 142669 - DNA, 22 bp, Artificial Sequence
  chemically synthesized
gaagttgtatttctaggtattt

SEQ ID NO: 142670 - DNA, 22 bp, Artificial Sequence
  chemically synthesized
tatttctaggtattttatttta

SEQ ID NO: 142671 - DNA, 22 bp, Artificial Sequence
  chemically synthesized
ctaggtattttattttattctc

SEQ ID NO: 142672 - DNA, 22 bp, Artificial Sequence
  chemically synthesized
taggtattttattttattctct

SEQ ID NO: 142673 - DNA, 22 bp, Artificial Sequence
  chemically synthesized
ggtattttattttattctcttt

SEQ ID NO: 142674 - DNA, 22 bp, Artificial Sequence
  chemically synthesized
tattttattctctttgcagcaa

SEQ ID NO: 142675 - DNA, 22 bp, Artificial Sequence
  chemically synthesized
attttattctctttgcagcaat

SEQ ID NO: 142676 - DNA, 22 bp, Artificial Sequence
  chemically synthesized
ttttattctctttgcagcaatt

SEQ ID NO: 142677 - DNA, 22 bp, Artificial Sequence
  chemically synthesized
tattctctttgcagcaattgtg

SEQ ID NO: 142678 - DNA, 22 bp, Artificial Sequence
  chemically synthesized
attctctttgcagcaattgtga

SEQ ID NO: 142679 - DNA, 22 bp, Artificial Sequence
  chemically synthesized
ttctctttgcagcaattgtgaa

SEQ ID NO: 142680 - DNA, 22 bp, Artificial Sequence
  chemically synthesized
tctttgcagcaattgtgaatgg

SEQ ID NO: 142681 - DNA, 22 bp, Artificial Sequence
  chemically synthesized
tttgcagcaattgtgaatggga

SEQ ID NO: 142682 - DNA, 22 bp, Artificial Sequence
  chemically synthesized
tgcagcaattgtgaatgggagt

SEQ ID NO: 142683 - DNA, 22 bp, Artificial Sequence
  chemically synthesized
gcagcaattgtgaatgggagtt

SEQ ID NO: 142684 - DNA, 22 bp, Artificial Sequence
  chemically synthesized
cagcaattgtgaatgggagttc

SEQ ID NO: 142685 - DNA, 22 bp, Artificial Sequence
  chemically synthesized
tgaatgggagttcacccatgat

SEQ ID NO: 142686 - DNA, 22 bp, Artificial Sequence
  chemically synthesized
acccatgatttggctctctgct

SEQ ID NO: 142687 - DNA, 22 bp, Artificial Sequence
  chemically synthesized
ggctctctgcttgtctattatt

SEQ ID NO: 142688 - DNA, 22 bp, Artificial Sequence
  chemically synthesized
gctctctgcttgtctattattg

SEQ ID NO: 142689 - DNA, 22 bp, Artificial Sequence
  chemically synthesized
tctgcttgtctattattggtgt

SEQ ID NO: 142690 - DNA, 22 bp, Artificial Sequence
  chemically synthesized
tgcttgtctattattggtgtat

SEQ ID NO: 142691 - DNA, 22 bp, Artificial Sequence
  chemically synthesized
cttgtctattattggtgtatag

SEQ ID NO: 142692 - DNA, 22 bp, Artificial Sequence
  chemically synthesized
gtctattattggtgtataggaa

SEQ ID NO: 142693 - DNA, 22 bp, Artificial Sequence
  chemically synthesized
tctattattggtgtataggaac

SEQ ID NO: 142694 - DNA, 22 bp, Artificial Sequence
  chemically synthesized
ttattggtgtataggaacgctt

SEQ ID NO: 142695 - DNA, 22 bp, Artificial Sequence
  chemically synthesized
ttggtgtataggaacgcttgtg

SEQ ID NO: 142696 - DNA, 22 bp, Artificial Sequence
  chemically synthesized
gtgtataggaacgcttgtgatt

SEQ ID NO: 142697 - DNA, 22 bp, Artificial Sequence
  chemically synthesized
gtgatttctgcacactgatttt

SEQ ID NO: 142698 - DNA, 22 bp, Artificial Sequence
  chemically synthesized
tgatttctgcacactgattttg

SEQ ID NO: 142699 - DNA, 22 bp, Artificial Sequence
  chemically synthesized
ctgcacactgattttgtatctt

SEQ ID NO: 142700 - DNA, 22 bp, Artificial Sequence
  chemically synthesized
tgcacactgattttgtatcttg

SEQ ID NO: 142701 - DNA, 22 bp, Artificial Sequence
  chemically synthesized
cacactgattttgtatcttgag

SEQ ID NO: 142702 - DNA, 22 bp, Artificial Sequence
  chemically synthesized
attttgtatcttgagactttgc

SEQ ID NO: 142703 - DNA, 22 bp, Artificial Sequence
  chemically synthesized
tgtatcttgagactttgctgaa

SEQ ID NO: 142704 - DNA, 22 bp, Artificial Sequence
  chemically synthesized
gtatcttgagactttgctgaag

SEQ ID NO: 142705 - DNA, 22 bp, Artificial Sequence
  chemically synthesized
tatcttgagactttgctgaagc

SEQ ID NO: 142706 - DNA, 22 bp, Artificial Sequence
  chemically synthesized
gagactttgctgaagctgttta

SEQ ID NO: 142707 - DNA, 22 bp, Artificial Sequence
  chemically synthesized
agactttgctgaagctgtttat

SEQ ID NO: 142708 - DNA, 22 bp, Artificial Sequence
  chemically synthesized
tgctgaagctgtttatcagctt

SEQ ID NO: 142709 - DNA, 22 bp, Artificial Sequence
  chemically synthesized
gctgaagctgtttatcagctta

SEQ ID NO: 142710 - DNA, 22 bp, Artificial Sequence
  chemically synthesized
ctgaagctgtttatcagcttaa

SEQ ID NO: 142711 - DNA, 22 bp, Artificial Sequence
  chemically synthesized
aagctgtttatcagcttaagat

SEQ ID NO: 142712 - DNA, 22 bp, Artificial Sequence
  chemically synthesized
tttatcagcttaagattttggg

SEQ ID NO: 142713 - DNA, 22 bp, Artificial Sequence
  chemically synthesized
atcagcttaagattttgggctg

SEQ ID NO: 142714 - DNA, 22 bp, Artificial Sequence
  chemically synthesized
tcagcttaagattttgggctga

SEQ ID NO: 142715 - DNA, 22 bp, Artificial Sequence
  chemically synthesized
aagattttgggctgagatgaca

SEQ ID NO: 142716 - DNA, 22 bp, Artificial Sequence
  chemically synthesized
agattttgggctgagatgacag

SEQ ID NO: 142717 - DNA, 22 bp, Artificial Sequence
  chemically synthesized
tgggctgagatgacagggtctt

SEQ ID NO: 142718 - DNA, 22 bp, Artificial Sequence
  chemically synthesized
gggctgagatgacagggtcttc

SEQ ID NO: 142719 - DNA, 22 bp, Artificial Sequence
  chemically synthesized
ggctgagatgacagggtcttct

SEQ ID NO: 142720 - DNA, 22 bp, Artificial Sequence
  chemically synthesized
agatgacagggtcttctaaata

SEQ ID NO: 142721 - DNA, 22 bp, Artificial Sequence
  chemically synthesized
ctaaatatacaatcatgtcatc

SEQ ID NO: 142722 - DNA, 22 bp, Artificial Sequence
  chemically synthesized
taaatatacaatcatgtcatct

SEQ ID NO: 142723 - DNA, 22 bp, Artificial Sequence
  chemically synthesized
aatatacaatcatgtcatctgc

SEQ ID NO: 142724 - DNA, 22 bp, Artificial Sequence
  chemically synthesized
caaacagagacaatttgacttc

SEQ ID NO: 142725 - DNA, 22 bp, Artificial Sequence
  chemically synthesized
gacttcctctcttcctatttga

SEQ ID NO: 142726 - DNA, 22 bp, Artificial Sequence
  chemically synthesized
acttcctctcttcctatttgaa

SEQ ID NO: 142727 - DNA, 22 bp, Artificial Sequence
  chemically synthesized
cctctcttcctatttgaatatg

SEQ ID NO: 142728 - DNA, 22 bp, Artificial Sequence
  chemically synthesized
ctctcttcctatttgaatatgc

SEQ ID NO: 142729 - DNA, 22 bp, Artificial Sequence
  chemically synthesized
tcttcctatttgaatatgcttt

SEQ ID NO: 142730 - DNA, 22 bp, Artificial Sequence
  chemically synthesized
ttcctatttgaatatgctttat

SEQ ID NO: 142731 - DNA, 22 bp, Artificial Sequence
  chemically synthesized
cctatttgaatatgctttattt

SEQ ID NO: 142732 - DNA, 22 bp, Artificial Sequence
  chemically synthesized
ctatttgaatatgctttatttc

SEQ ID NO: 142733 - DNA, 22 bp, Artificial Sequence
  chemically synthesized
tttgaatatgctttatttcttt

SEQ ID NO: 142734 - DNA, 22 bp, Artificial Sequence
  chemically synthesized
gaatatgctttatttctttctc

SEQ ID NO: 142735 - DNA, 22 bp, Artificial Sequence
  chemically synthesized
aatatgctttatttctttctct

SEQ ID NO: 142736 - DNA, 22 bp, Artificial Sequence
  chemically synthesized
tatttctttctcttgcctgatt

SEQ ID NO: 142737 - DNA, 22 bp, Artificial Sequence
  chemically synthesized
atttctttctcttgcctgattg

SEQ ID NO: 142738 - DNA, 22 bp, Artificial Sequence
  chemically synthesized
tttctttctcttgcctgattgt

SEQ ID NO: 142739 - DNA, 22 bp, Artificial Sequence
  chemically synthesized
ctttctcttgcctgattgtcct

SEQ ID NO: 142740 - DNA, 22 bp, Artificial Sequence
  chemically synthesized
tttctcttgcctgattgtcctg

SEQ ID NO: 142741 - DNA, 22 bp, Artificial Sequence
  chemically synthesized
tctcttgcctgattgtcctggc

SEQ ID NO: 142742 - DNA, 22 bp, Artificial Sequence
  chemically synthesized
ctcttgcctgattgtcctggcg

SEQ ID NO: 142743 - DNA, 22 bp, Artificial Sequence
  chemically synthesized
tcttgcctgattgtcctggcga

SEQ ID NO: 142744 - DNA, 22 bp, Artificial Sequence
  chemically synthesized
ttgcctgattgtcctggcgaga

SEQ ID NO: 142745 - DNA, 22 bp, Artificial Sequence
  chemically synthesized
gcctgattgtcctggcgagaac

SEQ ID NO: 142746 - DNA, 22 bp, Artificial Sequence
  chemically synthesized
cctgattgtcctggcgagaact

SEQ ID NO: 142747 - DNA, 22 bp, Artificial Sequence
  chemically synthesized
attgtcctggcgagaacttcca

SEQ ID NO: 142748 - DNA, 22 bp, Artificial Sequence
  chemically synthesized
tcctggcgagaacttccaatac

SEQ ID NO: 142749 - DNA, 22 bp, Artificial Sequence
  chemically synthesized
gcgagaacttccaatactatgt

SEQ ID NO: 142750 - DNA, 22 bp, Artificial Sequence
  chemically synthesized
ccaatactatgttgagtaagag

SEQ ID NO: 142751 - DNA, 22 bp, Artificial Sequence
  chemically synthesized
caatactatgttgagtaagagt

SEQ ID NO: 142752 - DNA, 22 bp, Artificial Sequence
  chemically synthesized
tgttgagtaagagtggcgagag

SEQ ID NO: 142753 - DNA, 22 bp, Artificial Sequence
  chemically synthesized
agtaagagtggcgagagggcat

SEQ ID NO: 142754 - DNA, 22 bp, Artificial Sequence
  chemically synthesized
gtcttgtgccggttttcaaagc

SEQ ID NO: 142755 - DNA, 22 bp, Artificial Sequence
  chemically synthesized
tcttgtgccggttttcaaagca

SEQ ID NO: 142756 - DNA, 22 bp, Artificial Sequence
  chemically synthesized
gtgccggttttcaaagcaaatg

SEQ ID NO: 142757 - DNA, 22 bp, Artificial Sequence
  chemically synthesized
tgccggttttcaaagcaaatga

SEQ ID NO: 142758 - DNA, 22 bp, Artificial Sequence
  chemically synthesized
tcaaagcaaatgatttttaaat

SEQ ID NO: 142759 - DNA, 22 bp, Artificial Sequence
  chemically synthesized
caaagcaaatgatttttaaatt

SEQ ID NO: 142760 - DNA, 22 bp, Artificial Sequence
  chemically synthesized
aaagcaaatgatttttaaattt

SEQ ID NO: 142761 - DNA, 22 bp, Artificial Sequence
  chemically synthesized
ttaaatttccatcttgatttca

SEQ ID NO: 142762 - DNA, 22 bp, Artificial Sequence
  chemically synthesized
taaatttccatcttgatttcat

SEQ ID NO: 142763 - DNA, 22 bp, Artificial Sequence
  chemically synthesized
aaatttccatcttgatttcatt

SEQ ID NO: 142764 - DNA, 22 bp, Artificial Sequence
  chemically synthesized
aatttccatcttgatttcattg

SEQ ID NO: 142765 - DNA, 22 bp, Artificial Sequence
  chemically synthesized
ccatcttgatttcattgttgac

SEQ ID NO: 142766 - DNA, 22 bp, Artificial Sequence
  chemically synthesized
catcttgatttcattgttgacc

SEQ ID NO: 142767 - DNA, 22 bp, Artificial Sequence
  chemically synthesized
gatttcattgttgacccaatga

SEQ ID NO: 142768 - DNA, 22 bp, Artificial Sequence
  chemically synthesized
atttcattgttgacccaatgat

SEQ ID NO: 142769 - DNA, 22 bp, Artificial Sequence
  chemically synthesized
cattgttgacccaatgatcatt

SEQ ID NO: 142770 - DNA, 22 bp, Artificial Sequence
  chemically synthesized
attgttgacccaatgatcattc

SEQ ID NO: 142771 - DNA, 22 bp, Artificial Sequence
  chemically synthesized
ttgacccaatgatcattcagga

SEQ ID NO: 142772 - DNA, 22 bp, Artificial Sequence
  chemically synthesized
acccaatgatcattcaggagca

SEQ ID NO: 142773 - DNA, 22 bp, Artificial Sequence
  chemically synthesized
aggagcaggttatttaatttcc

SEQ ID NO: 142774 - DNA, 22 bp, Artificial Sequence
  chemically synthesized
tttaatttccctgtatttgcat

SEQ ID NO: 142775 - DNA, 22 bp, Artificial Sequence
  chemically synthesized
aatttccctgtatttgcatggt

SEQ ID NO: 142776 - DNA, 22 bp, Artificial Sequence
  chemically synthesized
atttccctgtatttgcatggtt

SEQ ID NO: 142777 - DNA, 22 bp, Artificial Sequence
  chemically synthesized
ccctgtatttgcatggttttga

SEQ ID NO: 142778 - DNA, 22 bp, Artificial Sequence
  chemically synthesized
cctgtatttgcatggttttgaa

SEQ ID NO: 142779 - DNA, 22 bp, Artificial Sequence
  chemically synthesized
tatttgcatggttttgaaggtt

SEQ ID NO: 142780 - DNA, 22 bp, Artificial Sequence
  chemically synthesized
gcatggttttgaaggttccttt

SEQ ID NO: 142781 - DNA, 22 bp, Artificial Sequence
  chemically synthesized
catggttttgaaggttcctttt

SEQ ID NO: 142782 - DNA, 22 bp, Artificial Sequence
  chemically synthesized
tgaaggttccttttgtagttga

SEQ ID NO: 142783 - DNA, 22 bp, Artificial Sequence
  chemically synthesized
gaaggttccttttgtagttgat

SEQ ID NO: 142784 - DNA, 22 bp, Artificial Sequence
  chemically synthesized
aaggttccttttgtagttgatt

SEQ ID NO: 142785 - DNA, 22 bp, Artificial Sequence
  chemically synthesized
cttttgtagttgatttccaatt

SEQ ID NO: 142786 - DNA, 22 bp, Artificial Sequence
  chemically synthesized
ttgtagttgatttccaatttta

SEQ ID NO: 142787 - DNA, 22 bp, Artificial Sequence
  chemically synthesized
tgtagttgatttccaattttat

SEQ ID NO: 142788 - DNA, 22 bp, Artificial Sequence
  chemically synthesized
gtagttgatttccaattttatt

SEQ ID NO: 142789 - DNA, 22 bp, Artificial Sequence
  chemically synthesized
tagttgatttccaattttattc

SEQ ID NO: 142790 - DNA, 22 bp, Artificial Sequence
  chemically synthesized
atttccaattttattctactgt

SEQ ID NO: 142791 - DNA, 22 bp, Artificial Sequence
  chemically synthesized
ccaattttattctactgtggtc

SEQ ID NO: 142792 - DNA, 22 bp, Artificial Sequence
  chemically synthesized
caattttattctactgtggtct

SEQ ID NO: 142793 - DNA, 22 bp, Artificial Sequence
  chemically synthesized
tattctactgtggtctgagaga

SEQ ID NO: 142794 - DNA, 22 bp, Artificial Sequence
  chemically synthesized
attctactgtggtctgagagag

SEQ ID NO: 142795 - DNA, 22 bp, Artificial Sequence
  chemically synthesized
ttctactgtggtctgagagagt

SEQ ID NO: 142796 - DNA, 22 bp, Artificial Sequence
  chemically synthesized
tactgtggtctgagagagtgct

SEQ ID NO: 142797 - DNA, 22 bp, Artificial Sequence
  chemically synthesized
ctgtggtctgagagagtgcttg

SEQ ID NO: 142798 - DNA, 22 bp, Artificial Sequence
  chemically synthesized
tggtctgagagagtgcttgata

SEQ ID NO: 142799 - DNA, 22 bp, Artificial Sequence
  chemically synthesized
agagagtgcttgatataatttc

SEQ ID NO: 142800 - DNA, 22 bp, Artificial Sequence
  chemically synthesized
gatataatttcaatttttaaaa

SEQ ID NO: 142801 - DNA, 22 bp, Artificial Sequence
  chemically synthesized
atataatttcaatttttaaaaa

SEQ ID NO: 142802 - DNA, 22 bp, Artificial Sequence
  chemically synthesized
caatttttaaaaatttattgag

SEQ ID NO: 142803 - DNA, 22 bp, Artificial Sequence
  chemically synthesized
aatttttaaaaatttattgagg

SEQ ID NO: 142804 - DNA, 22 bp, Artificial Sequence
  chemically synthesized
ttaaaaatttattgaggcttgt

SEQ ID NO: 142805 - DNA, 22 bp, Artificial Sequence
  chemically synthesized
taaaaatttattgaggcttgtt

SEQ ID NO: 142806 - DNA, 22 bp, Artificial Sequence
  chemically synthesized
aaaaatttattgaggcttgttt

SEQ ID NO: 142807 - DNA, 22 bp, Artificial Sequence
  chemically synthesized
aaaatttattgaggcttgtttt

SEQ ID NO: 142808 - DNA, 22 bp, Artificial Sequence
  chemically synthesized
attgaggcttgttttgtggcat

SEQ ID NO: 142809 - DNA, 22 bp, Artificial Sequence
  chemically synthesized
ttgaggcttgttttgtggcata

SEQ ID NO: 142810 - DNA, 22 bp, Artificial Sequence
  chemically synthesized
aggcttgttttgtggcatatca

SEQ ID NO: 142811 - DNA, 22 bp, Artificial Sequence
  chemically synthesized
gttttgtggcatatcatatggc

SEQ ID NO: 142812 - DNA, 22 bp, Artificial Sequence
  chemically synthesized
ttttgtggcatatcatatggcc

SEQ ID NO: 142813 - DNA, 22 bp, Artificial Sequence
  chemically synthesized
tgtggcatatcatatggcctat

SEQ ID NO: 142814 - DNA, 22 bp, Artificial Sequence
  chemically synthesized
gtggcatatcatatggcctatc

SEQ ID NO: 142815 - DNA, 22 bp, Artificial Sequence
  chemically synthesized
tggcatatcatatggcctatct

SEQ ID NO: 142816 - DNA, 22 bp, Artificial Sequence
  chemically synthesized
tcttggagaaagttccatgtgc

SEQ ID NO: 142817 - DNA, 22 bp, Artificial Sequence
  chemically synthesized
ggagaaagttccatgtgctgat

SEQ ID NO: 142818 - DNA, 22 bp, Artificial Sequence
  chemically synthesized
gagaaagttccatgtgctgatg

SEQ ID NO: 142819 - DNA, 22 bp, Artificial Sequence
  chemically synthesized
catgtgctgatgaatagaatgt

SEQ ID NO: 142820 - DNA, 22 bp, Artificial Sequence
  chemically synthesized
atgaatagaatgtgtattctgc

SEQ ID NO: 142821 - DNA, 22 bp, Artificial Sequence
  chemically synthesized
tgcagttgttgggtagaatgtc

SEQ ID NO: 142822 - DNA, 22 bp, Artificial Sequence
  chemically synthesized
cagttgttgggtagaatgtcct

SEQ ID NO: 142823 - DNA, 22 bp, Artificial Sequence
  chemically synthesized
ttgggtagaatgtcctgtaaat

SEQ ID NO: 142824 - DNA, 22 bp, Artificial Sequence
  chemically synthesized
ggtagaatgtcctgtaaatatc

SEQ ID NO: 142825 - DNA, 22 bp, Artificial Sequence
  chemically synthesized
taaatatctgttaagtccattt

SEQ ID NO: 142826 - DNA, 22 bp, Artificial Sequence
  chemically synthesized
ttaagtccatttgttctttaaa

SEQ ID NO: 142827 - DNA, 22 bp, Artificial Sequence
  chemically synthesized
agtccatttgttctttaaatcc

SEQ ID NO: 142828 - DNA, 22 bp, Artificial Sequence
  chemically synthesized
gttctttaaatccattgtttct

SEQ ID NO: 142829 - DNA, 22 bp, Artificial Sequence
  chemically synthesized
ttctttaaatccattgtttctt

SEQ ID NO: 142830 - DNA, 22 bp, Artificial Sequence
  chemically synthesized
tttaaatccattgtttctttgt

SEQ ID NO: 142831 - DNA, 22 bp, Artificial Sequence
  chemically synthesized
taaatccattgtttctttgtag

SEQ ID NO: 142832 - DNA, 22 bp, Artificial Sequence
  chemically synthesized
aaatccattgtttctttgtaga

SEQ ID NO: 142833 - DNA, 22 bp, Artificial Sequence
  chemically synthesized
aatccattgtttctttgtagac

SEQ ID NO: 142834 - DNA, 22 bp, Artificial Sequence
  chemically synthesized
tttctttgtagactgtcttgat

SEQ ID NO: 142835 - DNA, 22 bp, Artificial Sequence
  chemically synthesized
ctttgtagactgtcttgatgac

SEQ ID NO: 142836 - DNA, 22 bp, Artificial Sequence
  chemically synthesized
tttgtagactgtcttgatgacc

SEQ ID NO: 142837 - DNA, 22 bp, Artificial Sequence
  chemically synthesized
tgtagactgtcttgatgacctg

SEQ ID NO: 142838 - DNA, 22 bp, Artificial Sequence
  chemically synthesized
gtagactgtcttgatgacctgc

SEQ ID NO: 142839 - DNA, 22 bp, Artificial Sequence
  chemically synthesized
tagactgtcttgatgacctgcc

SEQ ID NO: 142840 - DNA, 22 bp, Artificial Sequence
  chemically synthesized
tcttgatgacctgcctagtgca

SEQ ID NO: 142841 - DNA, 22 bp, Artificial Sequence
  chemically synthesized
gatgacctgcctagtgcagtca

SEQ ID NO: 142842 - DNA, 22 bp, Artificial Sequence
  chemically synthesized
atgacctgcctagtgcagtcag

SEQ ID NO: 142843 - DNA, 22 bp, Artificial Sequence
  chemically synthesized
cctagtgcagtcagtggagtat

SEQ ID NO: 142844 - DNA, 22 bp, Artificial Sequence
  chemically synthesized
gtgcagtcagtggagtattgaa

SEQ ID NO: 142845 - DNA, 22 bp, Artificial Sequence
  chemically synthesized
aagtcccccactattattatgt

SEQ ID NO: 142846 - DNA, 22 bp, Artificial Sequence
  chemically synthesized
ttattatgttgctgtctagtct

SEQ ID NO: 142847 - DNA, 22 bp, Artificial Sequence
  chemically synthesized
ttatgttgctgtctagtctagt

SEQ ID NO: 142848 - DNA, 22 bp, Artificial Sequence
  chemically synthesized
tgttgctgtctagtctagtagt

SEQ ID NO: 142849 - DNA, 22 bp, Artificial Sequence
  chemically synthesized
ctgtctagtctagtagtaattg

SEQ ID NO: 142850 - DNA, 22 bp, Artificial Sequence
  chemically synthesized
tctagtctagtagtaattgttt

SEQ ID NO: 142851 - DNA, 22 bp, Artificial Sequence
  chemically synthesized
gtctagtagtaattgttttata

SEQ ID NO: 142852 - DNA, 22 bp, Artificial Sequence
  chemically synthesized
gtagtaattgttttataaattt

SEQ ID NO: 142853 - DNA, 22 bp, Artificial Sequence
  chemically synthesized
ttttataaatttgggatctcca

SEQ ID NO: 142854 - DNA, 22 bp, Artificial Sequence
  chemically synthesized
tataaatttgggatctccagta

SEQ ID NO: 142855 - DNA, 22 bp, Artificial Sequence
  chemically synthesized
ataaatttgggatctccagtat

SEQ ID NO: 142856 - DNA, 22 bp, Artificial Sequence
  chemically synthesized
taaatttgggatctccagtatt

SEQ ID NO: 142857 - DNA, 22 bp, Artificial Sequence
  chemically synthesized
gggatctccagtattagatgca

SEQ ID NO: 142858 - DNA, 22 bp, Artificial Sequence
  chemically synthesized
ggatctccagtattagatgcat

SEQ ID NO: 142859 - DNA, 22 bp, Artificial Sequence
  chemically synthesized
cagtattagatgcatatatatt

SEQ ID NO: 142860 - DNA, 22 bp, Artificial Sequence
  chemically synthesized
gatgcatatatattaagaattg

SEQ ID NO: 142861 - DNA, 22 bp, Artificial Sequence
  chemically synthesized
agaattgtaatattctcccatt

SEQ ID NO: 142862 - DNA, 22 bp, Artificial Sequence
  chemically synthesized
taatattctcccattggacaag

SEQ ID NO: 142863 - DNA, 22 bp, Artificial Sequence
  chemically synthesized
tcccattggacaagggctttta

SEQ ID NO: 142864 - DNA, 22 bp, Artificial Sequence
  chemically synthesized
ccattggacaagggcttttatc

SEQ ID NO: 142865 - DNA, 22 bp, Artificial Sequence
  chemically synthesized
gacaagggcttttatcattata

SEQ ID NO: 142866 - DNA, 22 bp, Artificial Sequence
  chemically synthesized
ttatcattatatgatgtccctc

SEQ ID NO: 142867 - DNA, 22 bp, Artificial Sequence
  chemically synthesized
tatcattatatgatgtccctct

SEQ ID NO: 142868 - DNA, 22 bp, Artificial Sequence
  chemically synthesized
atcattatatgatgtccctctt

SEQ ID NO: 142869 - DNA, 22 bp, Artificial Sequence
  chemically synthesized
tcattatatgatgtccctcttt

SEQ ID NO: 142870 - DNA, 22 bp, Artificial Sequence
  chemically synthesized
tatgatgtccctctttgtcttt

SEQ ID NO: 142871 - DNA, 22 bp, Artificial Sequence
  chemically synthesized
tttgtcttttttaactgctgtt

SEQ ID NO: 142872 - DNA, 22 bp, Artificial Sequence
  chemically synthesized
tgtcttttttaactgctgtttc

SEQ ID NO: 142873 - DNA, 22 bp, Artificial Sequence
  chemically synthesized
gtcttttttaactgctgtttct

SEQ ID NO: 142874 - DNA, 22 bp, Artificial Sequence
  chemically synthesized
tcttttttaactgctgtttctt

SEQ ID NO: 142875 - DNA, 22 bp, Artificial Sequence
  chemically synthesized
ttttaactgctgtttctttaaa

SEQ ID NO: 142876 - DNA, 22 bp, Artificial Sequence
  chemically synthesized
tttaactgctgtttctttaaag

SEQ ID NO: 142877 - DNA, 22 bp, Artificial Sequence
  chemically synthesized
ttaactgctgtttctttaaagt

SEQ ID NO: 142878 - DNA, 22 bp, Artificial Sequence
  chemically synthesized
taactgctgtttctttaaagtt

SEQ ID NO: 142879 - DNA, 22 bp, Artificial Sequence
  chemically synthesized
aactgctgtttctttaaagttt

SEQ ID NO: 142880 - DNA, 22 bp, Artificial Sequence
  chemically synthesized
actgctgtttctttaaagtttg

SEQ ID NO: 142881 - DNA, 22 bp, Artificial Sequence
  chemically synthesized
ctgtttctttaaagtttgtttt

SEQ ID NO: 142882 - DNA, 22 bp, Artificial Sequence
  chemically synthesized
tttctttaaagtttgttttgtc

SEQ ID NO: 142883 - DNA, 22 bp, Artificial Sequence
  chemically synthesized
ctttaaagtttgttttgtctga

SEQ ID NO: 142884 - DNA, 22 bp, Artificial Sequence
  chemically synthesized
tttaaagtttgttttgtctgac

SEQ ID NO: 142885 - DNA, 22 bp, Artificial Sequence
  chemically synthesized
taaagtttgttttgtctgacat

SEQ ID NO: 142886 - DNA, 22 bp, Artificial Sequence
  chemically synthesized
aaagtttgttttgtctgacata

SEQ ID NO: 142887 - DNA, 22 bp, Artificial Sequence
  chemically synthesized
aagtttgttttgtctgacataa

SEQ ID NO: 142888 - DNA, 22 bp, Artificial Sequence
  chemically synthesized
gttttgtctgacataagaatag

SEQ ID NO: 142889 - DNA, 22 bp, Artificial Sequence
  chemically synthesized
ttttgtctgacataagaatagc

SEQ ID NO: 142890 - DNA, 22 bp, Artificial Sequence
  chemically synthesized
tgtctgacataagaatagctgc

SEQ ID NO: 142891 - DNA, 22 bp, Artificial Sequence
  chemically synthesized
gtctgacataagaatagctgct

SEQ ID NO: 142892 - DNA, 22 bp, Artificial Sequence
  chemically synthesized
tctgacataagaatagctgctt

SEQ ID NO: 142893 - DNA, 22 bp, Artificial Sequence
  chemically synthesized
acataagaatagctgctttggc

SEQ ID NO: 142894 - DNA, 22 bp, Artificial Sequence
  chemically synthesized
ctttggctcgcttttggtgtcc

SEQ ID NO: 142895 - DNA, 22 bp, Artificial Sequence
  chemically synthesized
tggctcgcttttggtgtccatt

SEQ ID NO: 142896 - DNA, 22 bp, Artificial Sequence
  chemically synthesized
ggctcgcttttggtgtccattt

SEQ ID NO: 142897 - DNA, 22 bp, Artificial Sequence
  chemically synthesized
gctcgcttttggtgtccatttg

SEQ ID NO: 142898 - DNA, 22 bp, Artificial Sequence
  chemically synthesized
gcttttggtgtccatttgtgtg

SEQ ID NO: 142899 - DNA, 22 bp, Artificial Sequence
  chemically synthesized
ttggtgtccatttgtgtggaat

SEQ ID NO: 142900 - DNA, 22 bp, Artificial Sequence
  chemically synthesized
tggtgtccatttgtgtggaatg

SEQ ID NO: 142901 - DNA, 22 bp, Artificial Sequence
  chemically synthesized
ggtgtccatttgtgtggaatgt

SEQ ID NO: 142902 - DNA, 22 bp, Artificial Sequence
  chemically synthesized
gtgtccatttgtgtggaatgtc

SEQ ID NO: 142903 - DNA, 22 bp, Artificial Sequence
  chemically synthesized
gtgtggaatgtcattttccacc

SEQ ID NO: 142904 - DNA, 22 bp, Artificial Sequence
  chemically synthesized
tgtggaatgtcattttccaccc

SEQ ID NO: 142905 - DNA, 22 bp, Artificial Sequence
  chemically synthesized
tccacccctttaccttaagttt

SEQ ID NO: 142906 - DNA, 22 bp, Artificial Sequence
  chemically synthesized
ccacccctttaccttaagttta

SEQ ID NO: 142907 - DNA, 22 bp, Artificial Sequence
  chemically synthesized
cacccctttaccttaagtttat

SEQ ID NO: 142908 - DNA, 22 bp, Artificial Sequence
  chemically synthesized
taccttaagtttatgtgagtcc

SEQ ID NO: 142909 - DNA, 22 bp, Artificial Sequence
  chemically synthesized
accttaagtttatgtgagtcct

SEQ ID NO: 142910 - DNA, 22 bp, Artificial Sequence
  chemically synthesized
ccttaagtttatgtgagtcctt

SEQ ID NO: 142911 - DNA, 22 bp, Artificial Sequence
  chemically synthesized
aagtttatgtgagtccttatgt

SEQ ID NO: 142912 - DNA, 22 bp, Artificial Sequence
  chemically synthesized
agtttatgtgagtccttatgtg

SEQ ID NO: 142913 - DNA, 22 bp, Artificial Sequence
  chemically synthesized
atgtgagtccttatgtgttagg

SEQ ID NO: 142914 - DNA, 22 bp, Artificial Sequence
  chemically synthesized
tgtgagtccttatgtgttaggt

SEQ ID NO: 142915 - DNA, 22 bp, Artificial Sequence
  chemically synthesized
atgtgttaggtgagtctcctga

SEQ ID NO: 142916 - DNA, 22 bp, Artificial Sequence
  chemically synthesized
tgtgttaggtgagtctcctgaa

SEQ ID NO: 142917 - DNA, 22 bp, Artificial Sequence
  chemically synthesized
ggtgagtctcctgaaggcggca

SEQ ID NO: 142918 - DNA, 22 bp, Artificial Sequence
  chemically synthesized
ctgaaggcggcagataactggt

SEQ ID NO: 142919 - DNA, 22 bp, Artificial Sequence
  chemically synthesized
aaggcggcagataactggttgg

SEQ ID NO: 142920 - DNA, 22 bp, Artificial Sequence
  chemically synthesized
gttggtgaattcttattcattc

SEQ ID NO: 142921 - DNA, 22 bp, Artificial Sequence
  chemically synthesized
gtgaattcttattcattctgca

SEQ ID NO: 142922 - DNA, 22 bp, Artificial Sequence
  chemically synthesized
ttattcattctgcaattctgta

SEQ ID NO: 142923 - DNA, 22 bp, Artificial Sequence
  chemically synthesized
attcattctgcaattctgtatc

SEQ ID NO: 142924 - DNA, 22 bp, Artificial Sequence
  chemically synthesized
ttcattctgcaattctgtatct

SEQ ID NO: 142925 - DNA, 22 bp, Artificial Sequence
  chemically synthesized
attctgcaattctgtatctttt

SEQ ID NO: 142926 - DNA, 22 bp, Artificial Sequence
  chemically synthesized
tgcaattctgtatcttttaagt

SEQ ID NO: 142927 - DNA, 22 bp, Artificial Sequence
  chemically synthesized
caattctgtatcttttaagtgg

SEQ ID NO: 142928 - DNA, 22 bp, Artificial Sequence
  chemically synthesized
tgtatcttttaagtggagcatt

SEQ ID NO: 142929 - DNA, 22 bp, Artificial Sequence
  chemically synthesized
tatcttttaagtggagcattta

SEQ ID NO: 142930 - DNA, 22 bp, Artificial Sequence
  chemically synthesized
ttaagtggagcatttagtccat

SEQ ID NO: 142931 - DNA, 22 bp, Artificial Sequence
  chemically synthesized
taagtggagcatttagtccatt

SEQ ID NO: 142932 - DNA, 22 bp, Artificial Sequence
  chemically synthesized
aagtggagcatttagtccattt

SEQ ID NO: 142933 - DNA, 22 bp, Artificial Sequence
  chemically synthesized
agtggagcatttagtccattta

SEQ ID NO: 142934 - DNA, 22 bp, Artificial Sequence
  chemically synthesized
agtccatttacattcaacatca

SEQ ID NO: 142935 - DNA, 22 bp, Artificial Sequence
  chemically synthesized
gtccatttacattcaacatcag

SEQ ID NO: 142936 - DNA, 22 bp, Artificial Sequence
  chemically synthesized
acattcaacatcagtattgagg

SEQ ID NO: 142937 - DNA, 22 bp, Artificial Sequence
  chemically synthesized
cattcaacatcagtattgaggt

SEQ ID NO: 142938 - DNA, 22 bp, Artificial Sequence
  chemically synthesized
aacatcagtattgaggtgtgag

SEQ ID NO: 142939 - DNA, 22 bp, Artificial Sequence
  chemically synthesized
aggtgtgaggtactattccatt

SEQ ID NO: 142940 - DNA, 22 bp, Artificial Sequence
  chemically synthesized
ttccattcttcgtggtatttgt

SEQ ID NO: 142941 - DNA, 22 bp, Artificial Sequence
  chemically synthesized
cattcttcgtggtatttgttgc

SEQ ID NO: 142942 - DNA, 22 bp, Artificial Sequence
  chemically synthesized
ttcgtggtatttgttgcctgtg

SEQ ID NO: 142943 - DNA, 22 bp, Artificial Sequence
  chemically synthesized
cgtggtatttgttgcctgtgta

SEQ ID NO: 142944 - DNA, 22 bp, Artificial Sequence
  chemically synthesized
gtggtatttgttgcctgtgtat

SEQ ID NO: 142945 - DNA, 22 bp, Artificial Sequence
  chemically synthesized
gttgcctgtgtatctttttatc

SEQ ID NO: 142946 - DNA, 22 bp, Artificial Sequence
  chemically synthesized
ttgcctgtgtatctttttatct

SEQ ID NO: 142947 - DNA, 22 bp, Artificial Sequence
  chemically synthesized
cctgtgtatctttttatctgta

SEQ ID NO: 142948 - DNA, 22 bp, Artificial Sequence
  chemically synthesized
tgtatctttttatctgtatttt

SEQ ID NO: 142949 - DNA, 22 bp, Artificial Sequence
  chemically synthesized
tttatctgtatttttgttgtat

SEQ ID NO: 142950 - DNA, 22 bp, Artificial Sequence
  chemically synthesized
ttatctgtatttttgttgtata

SEQ ID NO: 142951 - DNA, 22 bp, Artificial Sequence
  chemically synthesized
tatctgtatttttgttgtatat

SEQ ID NO: 142952 - DNA, 22 bp, Artificial Sequence
  chemically synthesized
atctgtatttttgttgtatatg

SEQ ID NO: 142953 - DNA, 22 bp, Artificial Sequence
  chemically synthesized
tctgtatttttgttgtatatgt

SEQ ID NO: 142954 - DNA, 22 bp, Artificial Sequence
  chemically synthesized
tatttttgttgtatatgtccta

SEQ ID NO: 142955 - DNA, 22 bp, Artificial Sequence
  chemically synthesized
ttgttgtatatgtcctatggga

SEQ ID NO: 142956 - DNA, 22 bp, Artificial Sequence
  chemically synthesized
tgttgtatatgtcctatgggat

SEQ ID NO: 142957 - DNA, 22 bp, Artificial Sequence
  chemically synthesized
gttgtatatgtcctatgggatt

SEQ ID NO: 142958 - DNA, 22 bp, Artificial Sequence
  chemically synthesized
ttgtatatgtcctatgggattt

SEQ ID NO: 142959 - DNA, 22 bp, Artificial Sequence
  chemically synthesized
tatatgtcctatgggatttatg

SEQ ID NO: 142960 - DNA, 22 bp, Artificial Sequence
  chemically synthesized
tgggatttatgctttaaagagg

SEQ ID NO: 142961 - DNA, 22 bp, Artificial Sequence
  chemically synthesized
atgctttaaagaggttctgttt

SEQ ID NO: 142962 - DNA, 22 bp, Artificial Sequence
  chemically synthesized
tgctttaaagaggttctgtttt

SEQ ID NO: 142963 - DNA, 22 bp, Artificial Sequence
  chemically synthesized
taaagaggttctgttttgatgt

SEQ ID NO: 142964 - DNA, 22 bp, Artificial Sequence
  chemically synthesized
aaagaggttctgttttgatgtg

SEQ ID NO: 142965 - DNA, 22 bp, Artificial Sequence
  chemically synthesized
aagaggttctgttttgatgtgc

SEQ ID NO: 142966 - DNA, 22 bp, Artificial Sequence
  chemically synthesized
tgttttgatgtgcttccagggt

SEQ ID NO: 142967 - DNA, 22 bp, Artificial Sequence
  chemically synthesized
ttttgatgtgcttccagggttt

SEQ ID NO: 142968 - DNA, 22 bp, Artificial Sequence
  chemically synthesized
tgatgtgcttccagggtttatt

SEQ ID NO: 142969 - DNA, 22 bp, Artificial Sequence
  chemically synthesized
gatgtgcttccagggtttattt

SEQ ID NO: 142970 - DNA, 22 bp, Artificial Sequence
  chemically synthesized
atgtgcttccagggtttatttc

SEQ ID NO: 142971 - DNA, 22 bp, Artificial Sequence
  chemically synthesized
ccagggtttatttcaagattta

SEQ ID NO: 142972 - DNA, 22 bp, Artificial Sequence
  chemically synthesized
cagggtttatttcaagatttag

SEQ ID NO: 142973 - DNA, 22 bp, Artificial Sequence
  chemically synthesized
atttcaagatttagagctcctt

SEQ ID NO: 142974 - DNA, 22 bp, Artificial Sequence
  chemically synthesized
tttcaagatttagagctccttt

SEQ ID NO: 142975 - DNA, 22 bp, Artificial Sequence
  chemically synthesized
caagatttagagctccttttat

SEQ ID NO: 142976 - DNA, 22 bp, Artificial Sequence
  chemically synthesized
aagatttagagctccttttatc

SEQ ID NO: 142977 - DNA, 22 bp, Artificial Sequence
  chemically synthesized
agagctccttttatcagttctt

SEQ ID NO: 142978 - DNA, 22 bp, Artificial Sequence
  chemically synthesized
gagctccttttatcagttcttg

SEQ ID NO: 142979 - DNA, 22 bp, Artificial Sequence
  chemically synthesized
cttttatcagttcttgtagtgt

SEQ ID NO: 142980 - DNA, 22 bp, Artificial Sequence
  chemically synthesized
ttatcagttcttgtagtgttgg

SEQ ID NO: 142981 - DNA, 22 bp, Artificial Sequence
  chemically synthesized
tatcagttcttgtagtgttggc

SEQ ID NO: 142982 - DNA, 22 bp, Artificial Sequence
  chemically synthesized
atcagttcttgtagtgttggct

SEQ ID NO: 142983 - DNA, 22 bp, Artificial Sequence
  chemically synthesized
tcagttcttgtagtgttggctt

SEQ ID NO: 142984 - DNA, 22 bp, Artificial Sequence
  chemically synthesized
ttgtagtgttggcttggtagtg

SEQ ID NO: 142985 - DNA, 22 bp, Artificial Sequence
  chemically synthesized
gtagtgttggcttggtagtgcc

SEQ ID NO: 142986 - DNA, 22 bp, Artificial Sequence
  chemically synthesized
tagtgttggcttggtagtgccg

SEQ ID NO: 142987 - DNA, 22 bp, Artificial Sequence
  chemically synthesized
gcttggtagtgccgaattctct

SEQ ID NO: 142988 - DNA, 22 bp, Artificial Sequence
  chemically synthesized
ggtagtgccgaattctctcagc

SEQ ID NO: 142989 - DNA, 22 bp, Artificial Sequence
  chemically synthesized
gtagtgccgaattctctcagca

SEQ ID NO: 142990 - DNA, 22 bp, Artificial Sequence
  chemically synthesized
tctcagcatttgtttttctgaa

SEQ ID NO: 142991 - DNA, 22 bp, Artificial Sequence
  chemically synthesized
tcagcatttgtttttctgaaaa

SEQ ID NO: 142992 - DNA, 22 bp, Artificial Sequence
  chemically synthesized
agcatttgtttttctgaaaaac

SEQ ID NO: 142993 - DNA, 22 bp, Artificial Sequence
  chemically synthesized
gtttttctgaaaaacactgtgt

SEQ ID NO: 142994 - DNA, 22 bp, Artificial Sequence
  chemically synthesized
tttttctgaaaaacactgtgta

SEQ ID NO: 142995 - DNA, 22 bp, Artificial Sequence
  chemically synthesized
ttctgaaaaacactgtgtattt

SEQ ID NO: 142996 - DNA, 22 bp, Artificial Sequence
  chemically synthesized
tctgaaaaacactgtgtatttt

SEQ ID NO: 142997 - DNA, 22 bp, Artificial Sequence
  chemically synthesized
ctgaaaaacactgtgtattttc

SEQ ID NO: 142998 - DNA, 22 bp, Artificial Sequence
  chemically synthesized
tgaaaaacactgtgtattttct

SEQ ID NO: 142999 - DNA, 22 bp, Artificial Sequence
  chemically synthesized
aaaaacactgtgtattttcttc

SEQ ID NO: 143000 - DNA, 22 bp, Artificial Sequence
  chemically synthesized
tgtattttcttcatttgtgaag

SEQ ID NO: 143001 - DNA, 22 bp, Artificial Sequence
  chemically synthesized
tcttcatttgtgaagcttagtt

SEQ ID NO: 143002 - DNA, 22 bp, Artificial Sequence
  chemically synthesized
cttcatttgtgaagcttagttt

SEQ ID NO: 143003 - DNA, 22 bp, Artificial Sequence
  chemically synthesized
ttcatttgtgaagcttagtttc

SEQ ID NO: 143004 - DNA, 22 bp, Artificial Sequence
  chemically synthesized
catttgtgaagcttagtttcac

SEQ ID NO: 143005 - DNA, 22 bp, Artificial Sequence
  chemically synthesized
atttgtgaagcttagtttcact

SEQ ID NO: 143006 - DNA, 22 bp, Artificial Sequence
  chemically synthesized
gtgaagcttagtttcactggat

SEQ ID NO: 143007 - DNA, 22 bp, Artificial Sequence
  chemically synthesized
tgaagcttagtttcactggata

SEQ ID NO: 143008 - DNA, 22 bp, Artificial Sequence
  chemically synthesized
agtttcactggatataaaattc

SEQ ID NO: 143009 - DNA, 22 bp, Artificial Sequence
  chemically synthesized
gtttcactggatataaaattct

SEQ ID NO: 143010 - DNA, 22 bp, Artificial Sequence
  chemically synthesized
cactggatataaaattcttggc

SEQ ID NO: 143011 - DNA, 22 bp, Artificial Sequence
  chemically synthesized
actggatataaaattcttggct

SEQ ID NO: 143012 - DNA, 22 bp, Artificial Sequence
  chemically synthesized
gatataaaattcttggctgata

SEQ ID NO: 143013 - DNA, 22 bp, Artificial Sequence
  chemically synthesized
ttggctgataattgttttgttt

SEQ ID NO: 143014 - DNA, 22 bp, Artificial Sequence
  chemically synthesized
ggctgataattgttttgtttaa

SEQ ID NO: 143015 - DNA, 22 bp, Artificial Sequence
  chemically synthesized
gctgataattgttttgtttaag

SEQ ID NO: 143016 - DNA, 22 bp, Artificial Sequence
  chemically synthesized
ataattgttttgtttaagaagg

SEQ ID NO: 143017 - DNA, 22 bp, Artificial Sequence
  chemically synthesized
ttttgtttaagaaggctgaaga

SEQ ID NO: 143018 - DNA, 22 bp, Artificial Sequence
  chemically synthesized
tgtttaagaaggctgaagatag

SEQ ID NO: 143019 - DNA, 22 bp, Artificial Sequence
  chemically synthesized
gtttaagaaggctgaagatagg

SEQ ID NO: 143020 - DNA, 22 bp, Artificial Sequence
  chemically synthesized
tttaagaaggctgaagataggg

SEQ ID NO: 143021 - DNA, 22 bp, Artificial Sequence
  chemically synthesized
aagaaggctgaagatagggcca

SEQ ID NO: 143022 - DNA, 22 bp, Artificial Sequence
  chemically synthesized
agaaggctgaagatagggccat

SEQ ID NO: 143023 - DNA, 22 bp, Artificial Sequence
  chemically synthesized
aagatagggccatattcacttc

SEQ ID NO: 143024 - DNA, 22 bp, Artificial Sequence
  chemically synthesized
acttctagcttttacggtttct

SEQ ID NO: 143025 - DNA, 22 bp, Artificial Sequence
  chemically synthesized
ctagcttttacggtttctgctg

SEQ ID NO: 143026 - DNA, 22 bp, Artificial Sequence
  chemically synthesized
tagcttttacggtttctgctga

SEQ ID NO: 143027 - DNA, 22 bp, Artificial Sequence
  chemically synthesized
gcttttacggtttctgctgaga

SEQ ID NO: 143028 - DNA, 22 bp, Artificial Sequence
  chemically synthesized
ttacggtttctgctgagaaatc

SEQ ID NO: 143029 - DNA, 22 bp, Artificial Sequence
  chemically synthesized
tacggtttctgctgagaaatct

SEQ ID NO: 143030 - DNA, 22 bp, Artificial Sequence
  chemically synthesized
acggtttctgctgagaaatctg

SEQ ID NO: 143031 - DNA, 22 bp, Artificial Sequence
  chemically synthesized
cggtttctgctgagaaatctgc

SEQ ID NO: 143032 - DNA, 22 bp, Artificial Sequence
  chemically synthesized
ctgctgagaaatctgctgttaa

SEQ ID NO: 143033 - DNA, 22 bp, Artificial Sequence
  chemically synthesized
tgctgagaaatctgctgttaat

SEQ ID NO: 143034 - DNA, 22 bp, Artificial Sequence
  chemically synthesized
ctgagaaatctgctgttaatct

SEQ ID NO: 143035 - DNA, 22 bp, Artificial Sequence
  chemically synthesized
agaaatctgctgttaatctgat

SEQ ID NO: 143036 - DNA, 22 bp, Artificial Sequence
  chemically synthesized
ctgttaatctgataggttttct

SEQ ID NO: 143037 - DNA, 22 bp, Artificial Sequence
  chemically synthesized
ttaatctgataggttttctttc

SEQ ID NO: 143038 - DNA, 22 bp, Artificial Sequence
  chemically synthesized
atctgataggttttctttcata

SEQ ID NO: 143039 - DNA, 22 bp, Artificial Sequence
  chemically synthesized
ataggttttctttcataggtta

SEQ ID NO: 143040 - DNA, 22 bp, Artificial Sequence
  chemically synthesized
tctttcataggttacctggtag

SEQ ID NO: 143041 - DNA, 22 bp, Artificial Sequence
  chemically synthesized
ctttcataggttacctggtagt

SEQ ID NO: 143042 - DNA, 22 bp, Artificial Sequence
  chemically synthesized
tttcataggttacctggtagtt

SEQ ID NO: 143043 - DNA, 22 bp, Artificial Sequence
  chemically synthesized
tcataggttacctggtagtttc

SEQ ID NO: 143044 - DNA, 22 bp, Artificial Sequence
  chemically synthesized
cataggttacctggtagtttca

SEQ ID NO: 143045 - DNA, 22 bp, Artificial Sequence
  chemically synthesized
ataggttacctggtagtttcac

SEQ ID NO: 143046 - DNA, 22 bp, Artificial Sequence
  chemically synthesized
cctggtagtttcacctcacagc

SEQ ID NO: 143047 - DNA, 22 bp, Artificial Sequence
  chemically synthesized
gtagtttcacctcacagctctt

SEQ ID NO: 143048 - DNA, 22 bp, Artificial Sequence
  chemically synthesized
cacctcacagctcttaagattc

SEQ ID NO: 143049 - DNA, 22 bp, Artificial Sequence
  chemically synthesized
acctcacagctcttaagattct

SEQ ID NO: 143050 - DNA, 22 bp, Artificial Sequence
  chemically synthesized
acagctcttaagattctctttg

SEQ ID NO: 143051 - DNA, 22 bp, Artificial Sequence
  chemically synthesized
ttaagattctctttgtctttag

SEQ ID NO: 143052 - DNA, 22 bp, Artificial Sequence
  chemically synthesized
aagattctctttgtctttagat

SEQ ID NO: 143053 - DNA, 22 bp, Artificial Sequence
  chemically synthesized
agattctctttgtctttagata

SEQ ID NO: 143054 - DNA, 22 bp, Artificial Sequence
  chemically synthesized
tctttgtctttagataactttg

SEQ ID NO: 143055 - DNA, 22 bp, Artificial Sequence
  chemically synthesized
tttgtctttagataactttgga

SEQ ID NO: 143056 - DNA, 22 bp, Artificial Sequence
  chemically synthesized
tgtctttagataactttggata

SEQ ID NO: 143057 - DNA, 22 bp, Artificial Sequence
  chemically synthesized
gtctttagataactttggatac

SEQ ID NO: 143058 - DNA, 22 bp, Artificial Sequence
  chemically synthesized
tctttagataactttggatact

SEQ ID NO: 143059 - DNA, 22 bp, Artificial Sequence
  chemically synthesized
tagataactttggatactctga

SEQ ID NO: 143060 - DNA, 22 bp, Artificial Sequence
  chemically synthesized
agataactttggatactctgat

SEQ ID NO: 143061 - DNA, 22 bp, Artificial Sequence
  chemically synthesized
gataactttggatactctgatg

SEQ ID NO: 143062 - DNA, 22 bp, Artificial Sequence
  chemically synthesized
tggatactctgatgacaatgta

SEQ ID NO: 143063 - DNA, 22 bp, Artificial Sequence
  chemically synthesized
ggatactctgatgacaatgtac

SEQ ID NO: 143064 - DNA, 22 bp, Artificial Sequence
  chemically synthesized
gatactctgatgacaatgtacc

SEQ ID NO: 143065 - DNA, 22 bp, Artificial Sequence
  chemically synthesized
tgatgacaatgtacctaggcaa

SEQ ID NO: 143066 - DNA, 22 bp, Artificial Sequence
  chemically synthesized
atgacaatgtacctaggcaatg

SEQ ID NO: 143067 - DNA, 22 bp, Artificial Sequence
  chemically synthesized
ggcaatgatatttttgcaatga

SEQ ID NO: 143068 - DNA, 22 bp, Artificial Sequence
  chemically synthesized
ttgcaatgaatttcccaggtgt

SEQ ID NO: 143069 - DNA, 22 bp, Artificial Sequence
  chemically synthesized
tgcaatgaatttcccaggtgtt

SEQ ID NO: 143070 - DNA, 22 bp, Artificial Sequence
  chemically synthesized
gcaatgaatttcccaggtgttt

SEQ ID NO: 143071 - DNA, 22 bp, Artificial Sequence
  chemically synthesized
caatgaatttcccaggtgttta

SEQ ID NO: 143072 - DNA, 22 bp, Artificial Sequence
  chemically synthesized
cccaggtgtttattgagcttct

SEQ ID NO: 143073 - DNA, 22 bp, Artificial Sequence
  chemically synthesized
ccaggtgtttattgagcttctt

SEQ ID NO: 143074 - DNA, 22 bp, Artificial Sequence
  chemically synthesized
attgagcttcttgtatttggat

SEQ ID NO: 143075 - DNA, 22 bp, Artificial Sequence
  chemically synthesized
ttgagcttcttgtatttggata

SEQ ID NO: 143076 - DNA, 22 bp, Artificial Sequence
  chemically synthesized
agcttcttgtatttggatatct

SEQ ID NO: 143077 - DNA, 22 bp, Artificial Sequence
  chemically synthesized
cttgtatttggatatctaggtc

SEQ ID NO: 143078 - DNA, 22 bp, Artificial Sequence
  chemically synthesized
ttgtatttggatatctaggtct

SEQ ID NO: 143079 - DNA, 22 bp, Artificial Sequence
  chemically synthesized
gtatttggatatctaggtctct

SEQ ID NO: 143080 - DNA, 22 bp, Artificial Sequence
  chemically synthesized
tatttggatatctaggtctcta

SEQ ID NO: 143081 - DNA, 22 bp, Artificial Sequence
  chemically synthesized
ggatatctaggtctctagcaag

SEQ ID NO: 143082 - DNA, 22 bp, Artificial Sequence
  chemically synthesized
gatatctaggtctctagcaagg

SEQ ID NO: 143083 - DNA, 22 bp, Artificial Sequence
  chemically synthesized
ggtctctagcaaggtgggggaa

SEQ ID NO: 143084 - DNA, 22 bp, Artificial Sequence
  chemically synthesized
tagcaaggtgggggaagttttc

SEQ ID NO: 143085 - DNA, 22 bp, Artificial Sequence
  chemically synthesized
gcaaggtgggggaagttttcct

SEQ ID NO: 143086 - DNA, 22 bp, Artificial Sequence
  chemically synthesized
tccttgattatttccctggata

SEQ ID NO: 143087 - DNA, 22 bp, Artificial Sequence
  chemically synthesized
ccttgattatttccctggataa

SEQ ID NO: 143088 - DNA, 22 bp, Artificial Sequence
  chemically synthesized
cttgattatttccctggataag

SEQ ID NO: 143089 - DNA, 22 bp, Artificial Sequence
  chemically synthesized
gattatttccctggataagttt

SEQ ID NO: 143090 - DNA, 22 bp, Artificial Sequence
  chemically synthesized
attatttccctggataagtttt

SEQ ID NO: 143091 - DNA, 22 bp, Artificial Sequence
  chemically synthesized
tttccctggataagttttccaa

SEQ ID NO: 143092 - DNA, 22 bp, Artificial Sequence
  chemically synthesized
ccctggataagttttccaaact

SEQ ID NO: 143093 - DNA, 22 bp, Artificial Sequence
  chemically synthesized
cctggataagttttccaaactt

SEQ ID NO: 143094 - DNA, 22 bp, Artificial Sequence
  chemically synthesized
gataagttttccaaacttttag

SEQ ID NO: 143095 - DNA, 22 bp, Artificial Sequence
  chemically synthesized
tccaaacttttagatttctctt

SEQ ID NO: 143096 - DNA, 22 bp, Artificial Sequence
  chemically synthesized
ccaaacttttagatttctcttc

SEQ ID NO: 143097 - DNA, 22 bp, Artificial Sequence
  chemically synthesized
caaacttttagatttctcttct

SEQ ID NO: 143098 - DNA, 22 bp, Artificial Sequence
  chemically synthesized
ttagatttctcttctttctcag

SEQ ID NO: 143099 - DNA, 22 bp, Artificial Sequence
  chemically synthesized
tagatttctcttctttctcagg

SEQ ID NO: 143100 - DNA, 22 bp, Artificial Sequence
  chemically synthesized
agatttctcttctttctcagga

SEQ ID NO: 143101 - DNA, 22 bp, Artificial Sequence
  chemically synthesized
gatttctcttctttctcaggaa

SEQ ID NO: 143102 - DNA, 22 bp, Artificial Sequence
  chemically synthesized
ctcttctttctcaggaatgctg

SEQ ID NO: 143103 - DNA, 22 bp, Artificial Sequence
  chemically synthesized
tcttctttctcaggaatgctga

SEQ ID NO: 143104 - DNA, 22 bp, Artificial Sequence
  chemically synthesized
ttctttctcaggaatgctgatt

SEQ ID NO: 143105 - DNA, 22 bp, Artificial Sequence
  chemically synthesized
ctttctcaggaatgctgattat

SEQ ID NO: 143106 - DNA, 22 bp, Artificial Sequence
  chemically synthesized
tttctcaggaatgctgattatt

SEQ ID NO: 143107 - DNA, 22 bp, Artificial Sequence
  chemically synthesized
tctcaggaatgctgattattct

SEQ ID NO: 143108 - DNA, 22 bp, Artificial Sequence
  chemically synthesized
ctcaggaatgctgattattctt

SEQ ID NO: 143109 - DNA, 22 bp, Artificial Sequence
  chemically synthesized
tcaggaatgctgattattctta

SEQ ID NO: 143110 - DNA, 22 bp, Artificial Sequence
  chemically synthesized
aggaatgctgattattcttagg

SEQ ID NO: 143111 - DNA, 22 bp, Artificial Sequence
  chemically synthesized
attattcttaggtttgattgtt

SEQ ID NO: 143112 - DNA, 22 bp, Artificial Sequence
  chemically synthesized
ttcttaggtttgattgtttaac

SEQ ID NO: 143113 - DNA, 22 bp, Artificial Sequence
  chemically synthesized
ttaggtttgattgtttaacata

SEQ ID NO: 143114 - DNA, 22 bp, Artificial Sequence
  chemically synthesized
aggtttgattgtttaacataat

SEQ ID NO: 143115 - DNA, 22 bp, Artificial Sequence
  chemically synthesized
ggtttgattgtttaacataatc

SEQ ID NO: 143116 - DNA, 22 bp, Artificial Sequence
  chemically synthesized
gattgtttaacataatcccaga

SEQ ID NO: 143117 - DNA, 22 bp, Artificial Sequence
  chemically synthesized
attgtttaacataatcccagat

SEQ ID NO: 143118 - DNA, 22 bp, Artificial Sequence
  chemically synthesized
tttaacataatcccagatttct

SEQ ID NO: 143119 - DNA, 22 bp, Artificial Sequence
  chemically synthesized
aacataatcccagatttcttgg

SEQ ID NO: 143120 - DNA, 22 bp, Artificial Sequence
  chemically synthesized
acataatcccagatttcttgga

SEQ ID NO: 143121 - DNA, 22 bp, Artificial Sequence
  chemically synthesized
cttggaggctttgttcatattt

SEQ ID NO: 143122 - DNA, 22 bp, Artificial Sequence
  chemically synthesized
ttggaggctttgttcatatttt

SEQ ID NO: 143123 - DNA, 22 bp, Artificial Sequence
  chemically synthesized
ggaggctttgttcatattttct

SEQ ID NO: 143124 - DNA, 22 bp, Artificial Sequence
  chemically synthesized
gaggctttgttcatattttctt

SEQ ID NO: 143125 - DNA, 22 bp, Artificial Sequence
  chemically synthesized
tgttcatattttcttattcttt

SEQ ID NO: 143126 - DNA, 22 bp, Artificial Sequence
  chemically synthesized
gttcatattttcttattctttt

SEQ ID NO: 143127 - DNA, 22 bp, Artificial Sequence
  chemically synthesized
ttcatattttcttattcttttt

SEQ ID NO: 143128 - DNA, 22 bp, Artificial Sequence
  chemically synthesized
atattttcttattcttttttct

SEQ ID NO: 143129 - DNA, 22 bp, Artificial Sequence
  chemically synthesized
tcttattcttttttctttgtct

SEQ ID NO: 143130 - DNA, 22 bp, Artificial Sequence
  chemically synthesized
cttattcttttttctttgtctt

SEQ ID NO: 143131 - DNA, 22 bp, Artificial Sequence
  chemically synthesized
ttattcttttttctttgtcttt

SEQ ID NO: 143132 - DNA, 22 bp, Artificial Sequence
  chemically synthesized
attcttttttctttgtctttgt

SEQ ID NO: 143133 - DNA, 22 bp, Artificial Sequence
  chemically synthesized
ttcttttttctttgtctttgtt

SEQ ID NO: 143134 - DNA, 22 bp, Artificial Sequence
  chemically synthesized
ttttttctttgtctttgttgga

SEQ ID NO: 143135 - DNA, 22 bp, Artificial Sequence
  chemically synthesized
ttttctttgtctttgttggatt

SEQ ID NO: 143136 - DNA, 22 bp, Artificial Sequence
  chemically synthesized
tttctttgtctttgttggattg

SEQ ID NO: 143137 - DNA, 22 bp, Artificial Sequence
  chemically synthesized
ttctttgtctttgttggattgg

SEQ ID NO: 143138 - DNA, 22 bp, Artificial Sequence
  chemically synthesized
tctttgtctttgttggattggg

SEQ ID NO: 143139 - DNA, 22 bp, Artificial Sequence
  chemically synthesized
ctttgtctttgttggattgggt

SEQ ID NO: 143140 - DNA, 22 bp, Artificial Sequence
  chemically synthesized
tttgtctttgttggattgggtt

SEQ ID NO: 143141 - DNA, 22 bp, Artificial Sequence
  chemically synthesized
tgtctttgttggattgggttaa

SEQ ID NO: 143142 - DNA, 22 bp, Artificial Sequence
  chemically synthesized
gtctttgttggattgggttaat

SEQ ID NO: 143143 - DNA, 22 bp, Artificial Sequence
  chemically synthesized
tctttgttggattgggttaatt

SEQ ID NO: 143144 - DNA, 22 bp, Artificial Sequence
  chemically synthesized
tgttggattgggttaattcaaa

SEQ ID NO: 143145 - DNA, 22 bp, Artificial Sequence
  chemically synthesized
gttggattgggttaattcaaaa

SEQ ID NO: 143146 - DNA, 22 bp, Artificial Sequence
  chemically synthesized
ttggattgggttaattcaaaaa

SEQ ID NO: 143147 - DNA, 22 bp, Artificial Sequence
  chemically synthesized
gattgggttaattcaaaaactt

SEQ ID NO: 143148 - DNA, 22 bp, Artificial Sequence
  chemically synthesized
ggttaattcaaaaactttgtct

SEQ ID NO: 143149 - DNA, 22 bp, Artificial Sequence
  chemically synthesized
attcaaaaactttgtcttcaag

SEQ ID NO: 143150 - DNA, 22 bp, Artificial Sequence
  chemically synthesized
aaaaactttgtcttcaagctct

SEQ ID NO: 143151 - DNA, 22 bp, Artificial Sequence
  chemically synthesized
tgtcttcaagctctgaatttct

SEQ ID NO: 143152 - DNA, 22 bp, Artificial Sequence
  chemically synthesized
gtcttcaagctctgaatttctt

SEQ ID NO: 143153 - DNA, 22 bp, Artificial Sequence
  chemically synthesized
tcttcaagctctgaatttcttc

SEQ ID NO: 143154 - DNA, 22 bp, Artificial Sequence
  chemically synthesized
caagctctgaatttcttctgct

SEQ ID NO: 143155 - DNA, 22 bp, Artificial Sequence
  chemically synthesized
aagctctgaatttcttctgctt

SEQ ID NO: 143156 - DNA, 22 bp, Artificial Sequence
  chemically synthesized
tgaatttcttctgcttggattc

SEQ ID NO: 143157 - DNA, 22 bp, Artificial Sequence
  chemically synthesized
aatttcttctgcttggattcta

SEQ ID NO: 143158 - DNA, 22 bp, Artificial Sequence
  chemically synthesized
cttctgcttggattctattgct

SEQ ID NO: 143159 - DNA, 22 bp, Artificial Sequence
  chemically synthesized
ttctgcttggattctattgctg

SEQ ID NO: 143160 - DNA, 22 bp, Artificial Sequence
  chemically synthesized
ctgcttggattctattgctgag

SEQ ID NO: 143161 - DNA, 22 bp, Artificial Sequence
  chemically synthesized
tgcttggattctattgctgaga

SEQ ID NO: 143162 - DNA, 22 bp, Artificial Sequence
  chemically synthesized
cttggattctattgctgagact

SEQ ID NO: 143163 - DNA, 22 bp, Artificial Sequence
  chemically synthesized
ggattctattgctgagactttc

SEQ ID NO: 143164 - DNA, 22 bp, Artificial Sequence
  chemically synthesized
gattctattgctgagactttct

SEQ ID NO: 143165 - DNA, 22 bp, Artificial Sequence
  chemically synthesized
tattgctgagactttctagagc

SEQ ID NO: 143166 - DNA, 22 bp, Artificial Sequence
  chemically synthesized
ttgctgagactttctagagcat

SEQ ID NO: 143167 - DNA, 22 bp, Artificial Sequence
  chemically synthesized
ctgagactttctagagcatttt

SEQ ID NO: 143168 - DNA, 22 bp, Artificial Sequence
  chemically synthesized
agactttctagagcattttgca

SEQ ID NO: 143169 - DNA, 22 bp, Artificial Sequence
  chemically synthesized
tctagagcattttgcatttcta

SEQ ID NO: 143170 - DNA, 22 bp, Artificial Sequence
  chemically synthesized
ctagagcattttgcatttctat

SEQ ID NO: 143171 - DNA, 22 bp, Artificial Sequence
  chemically synthesized
tagagcattttgcatttctata

SEQ ID NO: 143172 - DNA, 22 bp, Artificial Sequence
  chemically synthesized
gagcattttgcatttctataag

SEQ ID NO: 143173 - DNA, 22 bp, Artificial Sequence
  chemically synthesized
tgcatttctataagtgcatcca

SEQ ID NO: 143174 - DNA, 22 bp, Artificial Sequence
  chemically synthesized
gcatttctataagtgcatccat

SEQ ID NO: 143175 - DNA, 22 bp, Artificial Sequence
  chemically synthesized
catttctataagtgcatccatt

SEQ ID NO: 143176 - DNA, 22 bp, Artificial Sequence
  chemically synthesized
ctataagtgcatccattcatcc

SEQ ID NO: 143177 - DNA, 22 bp, Artificial Sequence
  chemically synthesized
tataagtgcatccattcatcca

SEQ ID NO: 143178 - DNA, 22 bp, Artificial Sequence
  chemically synthesized
taagtgcatccattcatccatt

SEQ ID NO: 143179 - DNA, 22 bp, Artificial Sequence
  chemically synthesized
atccattgtttcctgaagtttt

SEQ ID NO: 143180 - DNA, 22 bp, Artificial Sequence
  chemically synthesized
tttcctgaagttttgaatgttt

SEQ ID NO: 143181 - DNA, 22 bp, Artificial Sequence
  chemically synthesized
cctgaagttttgaatgtttttt

SEQ ID NO: 143182 - DNA, 22 bp, Artificial Sequence
  chemically synthesized
ctgaagttttgaatgtttttta

SEQ ID NO: 143183 - DNA, 22 bp, Artificial Sequence
  chemically synthesized
aagttttgaatgttttttattt

SEQ ID NO: 143184 - DNA, 22 bp, Artificial Sequence
  chemically synthesized
tgaatgttttttatttatgcta

SEQ ID NO: 143185 - DNA, 22 bp, Artificial Sequence
  chemically synthesized
gaatgttttttatttatgctat

SEQ ID NO: 143186 - DNA, 22 bp, Artificial Sequence
  chemically synthesized
aatgttttttatttatgctatc

SEQ ID NO: 143187 - DNA, 22 bp, Artificial Sequence
  chemically synthesized
tttatttatgctatctctttaa

SEQ ID NO: 143188 - DNA, 22 bp, Artificial Sequence
  chemically synthesized
ttatttatgctatctctttaac

SEQ ID NO: 143189 - DNA, 22 bp, Artificial Sequence
  chemically synthesized
tatttatgctatctctttaact

SEQ ID NO: 143190 - DNA, 22 bp, Artificial Sequence
  chemically synthesized
atttatgctatctctttaactg

SEQ ID NO: 143191 - DNA, 22 bp, Artificial Sequence
  chemically synthesized
tttatgctatctctttaactga

SEQ ID NO: 143192 - DNA, 22 bp, Artificial Sequence
  chemically synthesized
atgctatctctttaactgaaga

SEQ ID NO: 143193 - DNA, 22 bp, Artificial Sequence
  chemically synthesized
tgctatctctttaactgaagat

SEQ ID NO: 143194 - DNA, 22 bp, Artificial Sequence
  chemically synthesized
tctctttaactgaagatttctc

SEQ ID NO: 143195 - DNA, 22 bp, Artificial Sequence
  chemically synthesized
tttaactgaagatttctcccct

SEQ ID NO: 143196 - DNA, 22 bp, Artificial Sequence
  chemically synthesized
taactgaagatttctcccctca

SEQ ID NO: 143197 - DNA, 22 bp, Artificial Sequence
  chemically synthesized
aactgaagatttctcccctcat

SEQ ID NO: 143198 - DNA, 22 bp, Artificial Sequence
  chemically synthesized
actgaagatttctcccctcatt

SEQ ID NO: 143199 - DNA, 22 bp, Artificial Sequence
  chemically synthesized
aagatttctcccctcatttctt

SEQ ID NO: 143200 - DNA, 22 bp, Artificial Sequence
  chemically synthesized
ctcccctcatttcttgtatcat

SEQ ID NO: 143201 - DNA, 22 bp, Artificial Sequence
  chemically synthesized
tcccctcatttcttgtatcata

SEQ ID NO: 143202 - DNA, 22 bp, Artificial Sequence
  chemically synthesized
ccctcatttcttgtatcatatt

SEQ ID NO: 143203 - DNA, 22 bp, Artificial Sequence
  chemically synthesized
atttcttgtatcatatttttgg

SEQ ID NO: 143204 - DNA, 22 bp, Artificial Sequence
  chemically synthesized
cttgtatcatatttttggtttt

SEQ ID NO: 143205 - DNA, 22 bp, Artificial Sequence
  chemically synthesized
ttgtatcatatttttggttttt

SEQ ID NO: 143206 - DNA, 22 bp, Artificial Sequence
  chemically synthesized
gtatcatatttttggttttttt

SEQ ID NO: 143207 - DNA, 22 bp, Artificial Sequence
  chemically synthesized
tatcatatttttggttttttta

SEQ ID NO: 143208 - DNA, 22 bp, Artificial Sequence
  chemically synthesized
ttggtttttttaaaattggact

SEQ ID NO: 143209 - DNA, 22 bp, Artificial Sequence
  chemically synthesized
tggtttttttaaaattggactt

SEQ ID NO: 143210 - DNA, 22 bp, Artificial Sequence
  chemically synthesized
ggtttttttaaaattggacttc

SEQ ID NO: 143211 - DNA, 22 bp, Artificial Sequence
  chemically synthesized
gtttttttaaaattggacttca

SEQ ID NO: 143212 - DNA, 22 bp, Artificial Sequence
  chemically synthesized
ttttaaaattggacttcacctt

SEQ ID NO: 143213 - DNA, 22 bp, Artificial Sequence
  chemically synthesized
tttaaaattggacttcaccttc

SEQ ID NO: 143214 - DNA, 22 bp, Artificial Sequence
  chemically synthesized
ttaaaattggacttcaccttcc

SEQ ID NO: 143215 - DNA, 22 bp, Artificial Sequence
  chemically synthesized
taaaattggacttcaccttcct

SEQ ID NO: 143216 - DNA, 22 bp, Artificial Sequence
  chemically synthesized
aaaattggacttcaccttcctc

SEQ ID NO: 143217 - DNA, 22 bp, Artificial Sequence
  chemically synthesized
aaattggacttcaccttcctcg

SEQ ID NO: 143218 - DNA, 22 bp, Artificial Sequence
  chemically synthesized
gacttcaccttcctcggatgcc

SEQ ID NO: 143219 - DNA, 22 bp, Artificial Sequence
  chemically synthesized
caccttcctcggatgcctcctt

SEQ ID NO: 143220 - DNA, 22 bp, Artificial Sequence
  chemically synthesized
accttcctcggatgcctccttg

SEQ ID NO: 143221 - DNA, 22 bp, Artificial Sequence
  chemically synthesized
cctcggatgcctccttgattag

SEQ ID NO: 143222 - DNA, 22 bp, Artificial Sequence
  chemically synthesized
ctcggatgcctccttgattagc

SEQ ID NO: 143223 - DNA, 22 bp, Artificial Sequence
  chemically synthesized
ggatgcctccttgattagctta

SEQ ID NO: 143224 - DNA, 22 bp, Artificial Sequence
  chemically synthesized
cttgattagcttaataactgac

SEQ ID NO: 143225 - DNA, 22 bp, Artificial Sequence
  chemically synthesized
gattagcttaataactgacctt

SEQ ID NO: 143226 - DNA, 22 bp, Artificial Sequence
  chemically synthesized
attagcttaataactgaccttc

SEQ ID NO: 143227 - DNA, 22 bp, Artificial Sequence
  chemically synthesized
gcttaataactgaccttctgaa

SEQ ID NO: 143228 - DNA, 22 bp, Artificial Sequence
  chemically synthesized
aataactgaccttctgaattat

SEQ ID NO: 143229 - DNA, 22 bp, Artificial Sequence
  chemically synthesized
ataactgaccttctgaattatt

SEQ ID NO: 143230 - DNA, 22 bp, Artificial Sequence
  chemically synthesized
accttctgaattatttttcagg

SEQ ID NO: 143231 - DNA, 22 bp, Artificial Sequence
  chemically synthesized
ctgaattatttttcaggtaaat

SEQ ID NO: 143232 - DNA, 22 bp, Artificial Sequence
  chemically synthesized
tgaattatttttcaggtaaatc

SEQ ID NO: 143233 - DNA, 22 bp, Artificial Sequence
  chemically synthesized
aattatttttcaggtaaatcag

SEQ ID NO: 143234 - DNA, 22 bp, Artificial Sequence
  chemically synthesized
tttttcaggtaaatcagggatt

SEQ ID NO: 143235 - DNA, 22 bp, Artificial Sequence
  chemically synthesized
ttcaggtaaatcagggatttct

SEQ ID NO: 143236 - DNA, 22 bp, Artificial Sequence
  chemically synthesized
tcaggtaaatcagggatttctt

SEQ ID NO: 143237 - DNA, 22 bp, Artificial Sequence
  chemically synthesized
caggtaaatcagggatttcttc

SEQ ID NO: 143238 - DNA, 22 bp, Artificial Sequence
  chemically synthesized
aggtaaatcagggatttcttct

SEQ ID NO: 143239 - DNA, 22 bp, Artificial Sequence
  chemically synthesized
cttcttggtttggatgcattgc

SEQ ID NO: 143240 - DNA, 22 bp, Artificial Sequence
  chemically synthesized
ttcttggtttggatgcattgct

SEQ ID NO: 143241 - DNA, 22 bp, Artificial Sequence
  chemically synthesized
cttggtttggatgcattgctgg

SEQ ID NO: 143242 - DNA, 22 bp, Artificial Sequence
  chemically synthesized
ttggtttggatgcattgctggt

SEQ ID NO: 143243 - DNA, 22 bp, Artificial Sequence
  chemically synthesized
ggtttggatgcattgctggtga

SEQ ID NO: 143244 - DNA, 22 bp, Artificial Sequence
  chemically synthesized
gtttggatgcattgctggtgag

SEQ ID NO: 143245 - DNA, 22 bp, Artificial Sequence
  chemically synthesized
ggatgcattgctggtgagctag

SEQ ID NO: 143246 - DNA, 22 bp, Artificial Sequence
  chemically synthesized
gatgcattgctggtgagctagt

SEQ ID NO: 143247 - DNA, 22 bp, Artificial Sequence
  chemically synthesized
ctggtgagctagtatgattttt

SEQ ID NO: 143248 - DNA, 22 bp, Artificial Sequence
  chemically synthesized
gtgagctagtatgattttttgg

SEQ ID NO: 143249 - DNA, 22 bp, Artificial Sequence
  chemically synthesized
gtatgattttttggggggtgtt

SEQ ID NO: 143250 - DNA, 22 bp, Artificial Sequence
  chemically synthesized
tttggggggtgttaaagaacct

SEQ ID NO: 143251 - DNA, 22 bp, Artificial Sequence
  chemically synthesized
ttggggggtgttaaagaacctt

SEQ ID NO: 143252 - DNA, 22 bp, Artificial Sequence
  chemically synthesized
tggggggtgttaaagaaccttg

SEQ ID NO: 143253 - DNA, 22 bp, Artificial Sequence
  chemically synthesized
ggggggtgttaaagaaccttgt

SEQ ID NO: 143254 - DNA, 22 bp, Artificial Sequence
  chemically synthesized
gggggtgttaaagaaccttgtt

SEQ ID NO: 143255 - DNA, 22 bp, Artificial Sequence
  chemically synthesized
aagaaccttgtttttcatatta

SEQ ID NO: 143256 - DNA, 22 bp, Artificial Sequence
  chemically synthesized
gtttttcatattaccagagtta

SEQ ID NO: 143257 - DNA, 22 bp, Artificial Sequence
  chemically synthesized
tttttcatattaccagagttag

SEQ ID NO: 143258 - DNA, 22 bp, Artificial Sequence
  chemically synthesized
ttcatattaccagagttagttt

SEQ ID NO: 143259 - DNA, 22 bp, Artificial Sequence
  chemically synthesized
tcatattaccagagttagtttt

SEQ ID NO: 143260 - DNA, 22 bp, Artificial Sequence
  chemically synthesized
catattaccagagttagttttc

SEQ ID NO: 143261 - DNA, 22 bp, Artificial Sequence
  chemically synthesized
atattaccagagttagttttct

SEQ ID NO: 143262 - DNA, 22 bp, Artificial Sequence
  chemically synthesized
ccagagttagttttctggttcc

SEQ ID NO: 143263 - DNA, 22 bp, Artificial Sequence
  chemically synthesized
gttttctggttccttctcactt

SEQ ID NO: 143264 - DNA, 22 bp, Artificial Sequence
  chemically synthesized
tctggttccttctcacttgggt

SEQ ID NO: 143265 - DNA, 22 bp, Artificial Sequence
  chemically synthesized
ctggttccttctcacttgggta

SEQ ID NO: 143266 - DNA, 22 bp, Artificial Sequence
  chemically synthesized
tggttccttctcacttgggtag

SEQ ID NO: 143267 - DNA, 22 bp, Artificial Sequence
  chemically synthesized
gttccttctcacttgggtaggc

SEQ ID NO: 143268 - DNA, 22 bp, Artificial Sequence
  chemically synthesized
cttctcacttgggtaggctctg

SEQ ID NO: 143269 - DNA, 22 bp, Artificial Sequence
  chemically synthesized
ctcacttgggtaggctctgtca

SEQ ID NO: 143270 - DNA, 22 bp, Artificial Sequence
  chemically synthesized
tcacttgggtaggctctgtcag

SEQ ID NO: 143271 - DNA, 22 bp, Artificial Sequence
  chemically synthesized
acttgggtaggctctgtcagag

SEQ ID NO: 143272 - DNA, 22 bp, Artificial Sequence
  chemically synthesized
gggtaggctctgtcagagggaa

SEQ ID NO: 143273 - DNA, 22 bp, Artificial Sequence
  chemically synthesized
ggtaggctctgtcagagggaaa

SEQ ID NO: 143274 - DNA, 22 bp, Artificial Sequence
  chemically synthesized
tgtcagagggaaagtctaggcc

SEQ ID NO: 143275 - DNA, 22 bp, Artificial Sequence
  chemically synthesized
tcagagggaaagtctaggcctc

SEQ ID NO: 143276 - DNA, 22 bp, Artificial Sequence
  chemically synthesized
ggcctcaaggctgagacttttg

SEQ ID NO: 143277 - DNA, 22 bp, Artificial Sequence
  chemically synthesized
aaggctgagacttttgtcccat

SEQ ID NO: 143278 - DNA, 22 bp, Artificial Sequence
  chemically synthesized
agacttttgtcccatgaggtgt

SEQ ID NO: 143279 - DNA, 22 bp, Artificial Sequence
  chemically synthesized
ttgtcccatgaggtgttccctt

SEQ ID NO: 143280 - DNA, 22 bp, Artificial Sequence
  chemically synthesized
tgtcccatgaggtgttcccttg

SEQ ID NO: 143281 - DNA, 22 bp, Artificial Sequence
  chemically synthesized
gtcccatgaggtgttcccttga

SEQ ID NO: 143282 - DNA, 22 bp, Artificial Sequence
  chemically synthesized
tcccatgaggtgttcccttgat

SEQ ID NO: 143283 - DNA, 22 bp, Artificial Sequence
  chemically synthesized
ccttgatgtagcacagtccccc

SEQ ID NO: 143284 - DNA, 22 bp, Artificial Sequence
  chemically synthesized
gatgtagcacagtccccctttt

SEQ ID NO: 143285 - DNA, 22 bp, Artificial Sequence
  chemically synthesized
atgtagcacagtcccccttttc

SEQ ID NO: 143286 - DNA, 22 bp, Artificial Sequence
  chemically synthesized
ttcctaggcgtggggcttcctg

SEQ ID NO: 143287 - DNA, 22 bp, Artificial Sequence
  chemically synthesized
tcctaggcgtggggcttcctga

SEQ ID NO: 143288 - DNA, 22 bp, Artificial Sequence
  chemically synthesized
cctaggcgtggggcttcctgag

SEQ ID NO: 143289 - DNA, 22 bp, Artificial Sequence
  chemically synthesized
ctaggcgtggggcttcctgaga

SEQ ID NO: 143290 - DNA, 22 bp, Artificial Sequence
  chemically synthesized
ggcgtggggcttcctgagagcc

SEQ ID NO: 143291 - DNA, 22 bp, Artificial Sequence
  chemically synthesized
cctgagagccgaactgtagtga

SEQ ID NO: 143292 - DNA, 22 bp, Artificial Sequence
  chemically synthesized
ctgagagccgaactgtagtgat

SEQ ID NO: 143293 - DNA, 22 bp, Artificial Sequence
  chemically synthesized
agagccgaactgtagtgattgt

SEQ ID NO: 143294 - DNA, 22 bp, Artificial Sequence
  chemically synthesized
tagtgattgttatctctcttct

SEQ ID NO: 143295 - DNA, 22 bp, Artificial Sequence
  chemically synthesized
ttatctctcttctggatctagc

SEQ ID NO: 143296 - DNA, 22 bp, Artificial Sequence
  chemically synthesized
tctctcttctggatctagccac

SEQ ID NO: 143297 - DNA, 22 bp, Artificial Sequence
  chemically synthesized
tcttctggatctagccacccat

SEQ ID NO: 143298 - DNA, 22 bp, Artificial Sequence
  chemically synthesized
ttctggatctagccacccatca

SEQ ID NO: 143299 - DNA, 22 bp, Artificial Sequence
  chemically synthesized
ctggatctagccacccatcagg

SEQ ID NO: 143300 - DNA, 22 bp, Artificial Sequence
  chemically synthesized
tggatctagccacccatcaggt

SEQ ID NO: 143301 - DNA, 22 bp, Artificial Sequence
  chemically synthesized
gatctagccacccatcaggtct

SEQ ID NO: 143302 - DNA, 22 bp, Artificial Sequence
  chemically synthesized
gccacccatcaggtctaccaga

SEQ ID NO: 143303 - DNA, 22 bp, Artificial Sequence
  chemically synthesized
ccagactccaggctggtactgg

SEQ ID NO: 143304 - DNA, 22 bp, Artificial Sequence
  chemically synthesized
caggctggtactggggtttgtc

SEQ ID NO: 143305 - DNA, 22 bp, Artificial Sequence
  chemically synthesized
gtactggggtttgtctgcacag

SEQ ID NO: 143306 - DNA, 22 bp, Artificial Sequence
  chemically synthesized
gggtttgtctgcacagagtctt

SEQ ID NO: 143307 - DNA, 22 bp, Artificial Sequence
  chemically synthesized
gtctgcacagagtcttgtgacg

SEQ ID NO: 143308 - DNA, 22 bp, Artificial Sequence
  chemically synthesized
tctgcacagagtcttgtgacgt

SEQ ID NO: 143309 - DNA, 22 bp, Artificial Sequence
  chemically synthesized
cacagagtcttgtgacgtgaac

SEQ ID NO: 143310 - DNA, 22 bp, Artificial Sequence
  chemically synthesized
gtgacgtgaaccatctgtgggt

SEQ ID NO: 143311 - DNA, 22 bp, Artificial Sequence
  chemically synthesized
tgacgtgaaccatctgtgggtc

SEQ ID NO: 143312 - DNA, 22 bp, Artificial Sequence
  chemically synthesized
tgggtctctcagccatagatac

SEQ ID NO: 143313 - DNA, 22 bp, Artificial Sequence
  chemically synthesized
tcagccatagatacaaccacct

SEQ ID NO: 143314 - DNA, 22 bp, Artificial Sequence
  chemically synthesized
agccatagatacaaccacctgc

SEQ ID NO: 143315 - DNA, 22 bp, Artificial Sequence
  chemically synthesized
ctccaatggaggtggcagagga

SEQ ID NO: 143316 - DNA, 22 bp, Artificial Sequence
  chemically synthesized
caatggaggtggcagaggatga

SEQ ID NO: 143317 - DNA, 22 bp, Artificial Sequence
  chemically synthesized
tgtgagggtccttacttttggt

SEQ ID NO: 143318 - DNA, 22 bp, Artificial Sequence
  chemically synthesized
tgagggtccttacttttggttg

SEQ ID NO: 143319 - DNA, 22 bp, Artificial Sequence
  chemically synthesized
acttttggttgttcaatgcact

SEQ ID NO: 143320 - DNA, 22 bp, Artificial Sequence
  chemically synthesized
cttttggttgttcaatgcacta

SEQ ID NO: 143321 - DNA, 22 bp, Artificial Sequence
  chemically synthesized
ttggttgttcaatgcactattt

SEQ ID NO: 143322 - DNA, 22 bp, Artificial Sequence
  chemically synthesized
tggttgttcaatgcactatttt

SEQ ID NO: 143323 - DNA, 22 bp, Artificial Sequence
  chemically synthesized
ggttgttcaatgcactattttt

SEQ ID NO: 143324 - DNA, 22 bp, Artificial Sequence
  chemically synthesized
gttgttcaatgcactatttttg

SEQ ID NO: 143325 - DNA, 22 bp, Artificial Sequence
  chemically synthesized
ttcaatgcactatttttgtgct

SEQ ID NO: 143326 - DNA, 22 bp, Artificial Sequence
  chemically synthesized
aatgcactatttttgtgctggt

SEQ ID NO: 143327 - DNA, 22 bp, Artificial Sequence
  chemically synthesized
tttttgtgctggttggcctcct

SEQ ID NO: 143328 - DNA, 22 bp, Artificial Sequence
  chemically synthesized
ttgtgctggttggcctcctgcc

SEQ ID NO: 143329 - DNA, 22 bp, Artificial Sequence
  chemically synthesized
tgtgctggttggcctcctgcca

SEQ ID NO: 143330 - DNA, 22 bp, Artificial Sequence
  chemically synthesized
gtgctggttggcctcctgccag

SEQ ID NO: 143331 - DNA, 22 bp, Artificial Sequence
  chemically synthesized
tgctggttggcctcctgccagg

SEQ ID NO: 143332 - DNA, 22 bp, Artificial Sequence
  chemically synthesized
gttggcctcctgccaggaggtg

SEQ ID NO: 143333 - DNA, 22 bp, Artificial Sequence
  chemically synthesized
gcctcctgccaggaggtggcac

SEQ ID NO: 143334 - DNA, 22 bp, Artificial Sequence
  chemically synthesized
ctgccaggaggtggcactttct

SEQ ID NO: 143335 - DNA, 22 bp, Artificial Sequence
  chemically synthesized
ccaggaggtggcactttctaga

SEQ ID NO: 143336 - DNA, 22 bp, Artificial Sequence
  chemically synthesized
tctagaaagcatcagcagaggc

SEQ ID NO: 143337 - DNA, 22 bp, Artificial Sequence
  chemically synthesized
ctagaaagcatcagcagaggca

SEQ ID NO: 143338 - DNA, 22 bp, Artificial Sequence
  chemically synthesized
tagaaagcatcagcagaggcag

SEQ ID NO: 143339 - DNA, 22 bp, Artificial Sequence
  chemically synthesized
gaaagcatcagcagaggcagtc

SEQ ID NO: 143340 - DNA, 22 bp, Artificial Sequence
  chemically synthesized
ggggggctggggcaccctagaa

SEQ ID NO: 143341 - DNA, 22 bp, Artificial Sequence
  chemically synthesized
gggcaccctagaactcccaaga

SEQ ID NO: 143342 - DNA, 22 bp, Artificial Sequence
  chemically synthesized
gaactcccaagaatatatgccc

SEQ ID NO: 143343 - DNA, 22 bp, Artificial Sequence
  chemically synthesized
ccaagaatatatgccctttgtc

SEQ ID NO: 143344 - DNA, 22 bp, Artificial Sequence
  chemically synthesized
tgtcttcagctaccagggtgag

SEQ ID NO: 143345 - DNA, 22 bp, Artificial Sequence
  chemically synthesized
gtcttcagctaccagggtgagt

SEQ ID NO: 143346 - DNA, 22 bp, Artificial Sequence
  chemically synthesized
tcttcagctaccagggtgagta

SEQ ID NO: 143347 - DNA, 22 bp, Artificial Sequence
  chemically synthesized
cagctaccagggtgagtaagga

SEQ ID NO: 143348 - DNA, 22 bp, Artificial Sequence
  chemically synthesized
agctaccagggtgagtaaggaa

SEQ ID NO: 143349 - DNA, 22 bp, Artificial Sequence
  chemically synthesized
ccagggtgagtaaggaaggacc

SEQ ID NO: 143350 - DNA, 22 bp, Artificial Sequence
  chemically synthesized
gtcgtgtctgagctcagagtct

SEQ ID NO: 143351 - DNA, 22 bp, Artificial Sequence
  chemically synthesized
agctcagagtctccttgggcag

SEQ ID NO: 143352 - DNA, 22 bp, Artificial Sequence
  chemically synthesized
agagtctccttgggcaggtctt

SEQ ID NO: 143353 - DNA, 22 bp, Artificial Sequence
  chemically synthesized
cttgggcaggtctttctgtggc

SEQ ID NO: 143354 - DNA, 22 bp, Artificial Sequence
  chemically synthesized
gggcaggtctttctgtggctac

SEQ ID NO: 143355 - DNA, 22 bp, Artificial Sequence
  chemically synthesized
ggcaggtctttctgtggctact

SEQ ID NO: 143356 - DNA, 22 bp, Artificial Sequence
  chemically synthesized
tctgtggctactgtgggaggat

SEQ ID NO: 143357 - DNA, 22 bp, Artificial Sequence
  chemically synthesized
ctgtggctactgtgggaggatg

SEQ ID NO: 143358 - DNA, 22 bp, Artificial Sequence
  chemically synthesized
tgtggctactgtgggaggatgg

SEQ ID NO: 143359 - DNA, 22 bp, Artificial Sequence
  chemically synthesized
tggctactgtgggaggatgggg

SEQ ID NO: 143360 - DNA, 22 bp, Artificial Sequence
  chemically synthesized
ctgtgggaggatgggggtgtag

SEQ ID NO: 143361 - DNA, 22 bp, Artificial Sequence
  chemically synthesized
tgggaggatgggggtgtagttt

SEQ ID NO: 143362 - DNA, 22 bp, Artificial Sequence
  chemically synthesized
ccaggtcaatggatttatgttc

SEQ ID NO: 143363 - DNA, 22 bp, Artificial Sequence
  chemically synthesized
caggtcaatggatttatgttcc

SEQ ID NO: 143364 - DNA, 22 bp, Artificial Sequence
  chemically synthesized
atgttcctaggacaattatggc

SEQ ID NO: 143365 - DNA, 22 bp, Artificial Sequence
  chemically synthesized
tgttcctaggacaattatggct

SEQ ID NO: 143366 - DNA, 22 bp, Artificial Sequence
  chemically synthesized
ctaggacaattatggctgcctc

SEQ ID NO: 143367 - DNA, 22 bp, Artificial Sequence
  chemically synthesized
ggacaattatggctgcctctgc

SEQ ID NO: 143368 - DNA, 22 bp, Artificial Sequence
  chemically synthesized
tggctgcctctgctgtgtcatg

SEQ ID NO: 143369 - DNA, 22 bp, Artificial Sequence
  chemically synthesized
cctctgctgtgtcatgcaggtc

SEQ ID NO: 143370 - DNA, 22 bp, Artificial Sequence
  chemically synthesized
tgctgtgtcatgcaggtcatca

SEQ ID NO: 143371 - DNA, 22 bp, Artificial Sequence
  chemically synthesized
ctgtgtcatgcaggtcatcagg

SEQ ID NO: 143372 - DNA, 22 bp, Artificial Sequence
  chemically synthesized
tgtcatgcaggtcatcaggaaa

SEQ ID NO: 143373 - DNA, 22 bp, Artificial Sequence
  chemically synthesized
gcccagctcccatgcaactcaa

SEQ ID NO: 143374 - DNA, 22 bp, Artificial Sequence
  chemically synthesized
cccagctcccatgcaactcaaa

SEQ ID NO: 143375 - DNA, 22 bp, Artificial Sequence
  chemically synthesized
ccatgcaactcaaaaggttggt

SEQ ID NO: 143376 - DNA, 22 bp, Artificial Sequence
  chemically synthesized
aaaaggttggtctcacttccag

SEQ ID NO: 143377 - DNA, 22 bp, Artificial Sequence
  chemically synthesized
gtctcacttccagcgtgcaccc

SEQ ID NO: 143378 - DNA, 22 bp, Artificial Sequence
  chemically synthesized
acttccagcgtgcaccctcccc

SEQ ID NO: 143379 - DNA, 22 bp, Artificial Sequence
  chemically synthesized
ccagcgtgcaccctcccccgca

SEQ ID NO: 143380 - DNA, 22 bp, Artificial Sequence
  chemically synthesized
cagcgtgcaccctcccccgcaa

SEQ ID NO: 143381 - DNA, 22 bp, Artificial Sequence
  chemically synthesized
ccccgcaacagcaccgaatctg

SEQ ID NO: 143382 - DNA, 22 bp, Artificial Sequence
  chemically synthesized
tttccatgcagtcagtgagcaa

SEQ ID NO: 143383 - DNA, 22 bp, Artificial Sequence
  chemically synthesized
ccatgcagtcagtgagcaaggc

SEQ ID NO: 143384 - DNA, 22 bp, Artificial Sequence
  chemically synthesized
catgcagtcagtgagcaaggct

SEQ ID NO: 143385 - DNA, 22 bp, Artificial Sequence
  chemically synthesized
agaacttgccccaggctaccag

SEQ ID NO: 143386 - DNA, 22 bp, Artificial Sequence
  chemically synthesized
gccccaggctaccagctgcgaa

SEQ ID NO: 143387 - DNA, 22 bp, Artificial Sequence
  chemically synthesized
ccccaggctaccagctgcgaaa

SEQ ID NO: 143388 - DNA, 22 bp, Artificial Sequence
  chemically synthesized
ccagctgcgaaaccaagtaggg

SEQ ID NO: 143389 - DNA, 22 bp, Artificial Sequence
  chemically synthesized
cgaaaccaagtagggctgtcct

SEQ ID NO: 143390 - DNA, 22 bp, Artificial Sequence
  chemically synthesized
tcctacttccctgccagtggag

SEQ ID NO: 143391 - DNA, 22 bp, Artificial Sequence
  chemically synthesized
cttccctgccagtggagtctgc

SEQ ID NO: 143392 - DNA, 22 bp, Artificial Sequence
  chemically synthesized
ccctgccagtggagtctgcaca

SEQ ID NO: 143393 - DNA, 22 bp, Artificial Sequence
  chemically synthesized
cctgccagtggagtctgcacac

SEQ ID NO: 143394 - DNA, 22 bp, Artificial Sequence
  chemically synthesized
ccagtggagtctgcacaccaaa

SEQ ID NO: 143395 - DNA, 22 bp, Artificial Sequence
  chemically synthesized
cacaccaaattcatgtcccccc

SEQ ID NO: 143396 - DNA, 22 bp, Artificial Sequence
  chemically synthesized
atgtccccccaccaaccccccc

SEQ ID NO: 143397 - DNA, 22 bp, Artificial Sequence
  chemically synthesized
cccagcccctagatctggccag

SEQ ID NO: 143398 - DNA, 22 bp, Artificial Sequence
  chemically synthesized
gatctggccaggtggagatttt

SEQ ID NO: 143399 - DNA, 22 bp, Artificial Sequence
  chemically synthesized
gccaggtggagattttcttttt

SEQ ID NO: 143400 - DNA, 22 bp, Artificial Sequence
  chemically synthesized
tctttttcctgtcatcttttcc

SEQ ID NO: 143401 - DNA, 22 bp, Artificial Sequence
  chemically synthesized
ctttttcctgtcatcttttccc

SEQ ID NO: 143402 - DNA, 22 bp, Artificial Sequence
  chemically synthesized
tttttcctgtcatcttttccca

SEQ ID NO: 143403 - DNA, 22 bp, Artificial Sequence
  chemically synthesized
tttcctgtcatcttttcccagt

SEQ ID NO: 143404 - DNA, 22 bp, Artificial Sequence
  chemically synthesized
ttcctgtcatcttttcccagtt

SEQ ID NO: 143405 - DNA, 22 bp, Artificial Sequence
  chemically synthesized
tcctgtcatcttttcccagttc

SEQ ID NO: 143406 - DNA, 22 bp, Artificial Sequence
  chemically synthesized
cctgtcatcttttcccagttcc

SEQ ID NO: 143407 - DNA, 22 bp, Artificial Sequence
  chemically synthesized
ctgtcatcttttcccagttcct

SEQ ID NO: 143408 - DNA, 22 bp, Artificial Sequence
  chemically synthesized
tcatcttttcccagttcctctg

SEQ ID NO: 143409 - DNA, 22 bp, Artificial Sequence
  chemically synthesized
ttcccagttcctctggcagccc

SEQ ID NO: 143410 - DNA, 22 bp, Artificial Sequence
  chemically synthesized
tcccagttcctctggcagccct

SEQ ID NO: 143411 - DNA, 22 bp, Artificial Sequence
  chemically synthesized
cccagttcctctggcagccctc

SEQ ID NO: 143412 - DNA, 22 bp, Artificial Sequence
  chemically synthesized
ccagttcctctggcagccctcc

SEQ ID NO: 143413 - DNA, 22 bp, Artificial Sequence
  chemically synthesized
ctctggcagccctcccaaatga

SEQ ID NO: 143414 - DNA, 22 bp, Artificial Sequence
  chemically synthesized
tggcagccctcccaaatgaccc

SEQ ID NO: 143415 - DNA, 22 bp, Artificial Sequence
  chemically synthesized
gcagccctcccaaatgacccct

SEQ ID NO: 143416 - DNA, 22 bp, Artificial Sequence
  chemically synthesized
ccaaatgacccctgtgaggcaa

SEQ ID NO: 143417 - DNA, 22 bp, Artificial Sequence
  chemically synthesized
tgaggcaaggcagaaatggctt

SEQ ID NO: 143418 - DNA, 22 bp, Artificial Sequence
  chemically synthesized
cctaggggacccagagagccca

SEQ ID NO: 143419 - DNA, 22 bp, Artificial Sequence
  chemically synthesized
ctaggggacccagagagcccac

SEQ ID NO: 143420 - DNA, 22 bp, Artificial Sequence
  chemically synthesized
ggggacccagagagcccacagg

SEQ ID NO: 143421 - DNA, 22 bp, Artificial Sequence
  chemically synthesized
ttcccgctgcttcctctacccc

SEQ ID NO: 143422 - DNA, 22 bp, Artificial Sequence
  chemically synthesized
tcccgctgcttcctctacccct

SEQ ID NO: 143423 - DNA, 22 bp, Artificial Sequence
  chemically synthesized
cccgctgcttcctctacccctg

SEQ ID NO: 143424 - DNA, 22 bp, Artificial Sequence
  chemically synthesized
ccgctgcttcctctacccctgt

SEQ ID NO: 143425 - DNA, 22 bp, Artificial Sequence
  chemically synthesized
cttcctctacccctgtattttg

SEQ ID NO: 143426 - DNA, 22 bp, Artificial Sequence
  chemically synthesized
cctctacccctgtattttgctt

SEQ ID NO: 143427 - DNA, 22 bp, Artificial Sequence
  chemically synthesized
ctctacccctgtattttgcttg

SEQ ID NO: 143428 - DNA, 22 bp, Artificial Sequence
  chemically synthesized
tacccctgtattttgcttggcc

SEQ ID NO: 143429 - DNA, 22 bp, Artificial Sequence
  chemically synthesized
cccctgtattttgcttggccct

SEQ ID NO: 143430 - DNA, 22 bp, Artificial Sequence
  chemically synthesized
tattttgcttggccctctaaat

SEQ ID NO: 143431 - DNA, 22 bp, Artificial Sequence
  chemically synthesized
tgcttggccctctaaattgact

SEQ ID NO: 143432 - DNA, 22 bp, Artificial Sequence
  chemically synthesized
gcttggccctctaaattgactc

SEQ ID NO: 143433 - DNA, 22 bp, Artificial Sequence
  chemically synthesized
cttggccctctaaattgactca

SEQ ID NO: 143434 - DNA, 22 bp, Artificial Sequence
  chemically synthesized
ggccctctaaattgactcagct

SEQ ID NO: 143435 - DNA, 22 bp, Artificial Sequence
  chemically synthesized
gccctctaaattgactcagctc

SEQ ID NO: 143436 - DNA, 22 bp, Artificial Sequence
  chemically synthesized
taaattgactcagctccaggta

SEQ ID NO: 143437 - DNA, 22 bp, Artificial Sequence
  chemically synthesized
aattgactcagctccaggtaag

SEQ ID NO: 143438 - DNA, 22 bp, Artificial Sequence
  chemically synthesized
actcagctccaggtaaggtcag

SEQ ID NO: 143439 - DNA, 22 bp, Artificial Sequence
  chemically synthesized
agctccaggtaaggtcagaatc

SEQ ID NO: 143440 - DNA, 22 bp, Artificial Sequence
  chemically synthesized
caggtaaggtcagaatcttctc

SEQ ID NO: 143441 - DNA, 22 bp, Artificial Sequence
  chemically synthesized
ctcctgtggtctagatcttcag

SEQ ID NO: 143442 - DNA, 22 bp, Artificial Sequence
  chemically synthesized
tcctgtggtctagatcttcagg

SEQ ID NO: 143443 - DNA, 22 bp, Artificial Sequence
  chemically synthesized
ctgtggtctagatcttcaggtt

SEQ ID NO: 143444 - DNA, 22 bp, Artificial Sequence
  chemically synthesized
tggtctagatcttcaggttccc

SEQ ID NO: 143445 - DNA, 22 bp, Artificial Sequence
  chemically synthesized
gatcttcaggttccccagtgag

SEQ ID NO: 143446 - DNA, 22 bp, Artificial Sequence
  chemically synthesized
caggttccccagtgaggatgtg

SEQ ID NO: 143447 - DNA, 22 bp, Artificial Sequence
  chemically synthesized
aggttccccagtgaggatgtgt

SEQ ID NO: 143448 - DNA, 22 bp, Artificial Sequence
  chemically synthesized
cccagtgaggatgtgtgtttgg

SEQ ID NO: 143449 - DNA, 22 bp, Artificial Sequence
  chemically synthesized
gggggtagacggtccccctttt

SEQ ID NO: 143450 - DNA, 22 bp, Artificial Sequence
  chemically synthesized
ggggtagacggtcccccttttc

SEQ ID NO: 143451 - DNA, 22 bp, Artificial Sequence
  chemically synthesized
ttccacttccacagtttgggca

SEQ ID NO: 143452 - DNA, 22 bp, Artificial Sequence
  chemically synthesized
tccacttccacagtttgggcac

SEQ ID NO: 143453 - DNA, 22 bp, Artificial Sequence
  chemically synthesized
ccacttccacagtttgggcact

SEQ ID NO: 143454 - DNA, 22 bp, Artificial Sequence
  chemically synthesized
cacttccacagtttgggcactc

SEQ ID NO: 143455 - DNA, 22 bp, Artificial Sequence
  chemically synthesized
ccacagtttgggcactcacaat

SEQ ID NO: 143456 - DNA, 22 bp, Artificial Sequence
  chemically synthesized
cacagtttgggcactcacaata

SEQ ID NO: 143457 - DNA, 22 bp, Artificial Sequence
  chemically synthesized
gggcactcacaatatttggggt

SEQ ID NO: 143458 - DNA, 22 bp, Artificial Sequence
  chemically synthesized
ggcactcacaatatttggggtg

SEQ ID NO: 143459 - DNA, 22 bp, Artificial Sequence
  chemically synthesized
acaatatttggggtgtttcccg

SEQ ID NO: 143460 - DNA, 22 bp, Artificial Sequence
  chemically synthesized
ggggtgtttcccgggtcctgca

SEQ ID NO: 143461 - DNA, 22 bp, Artificial Sequence
  chemically synthesized
gggtgtttcccgggtcctgcag

SEQ ID NO: 143462 - DNA, 22 bp, Artificial Sequence
  chemically synthesized
cccgggtcctgcaggagcaatc

SEQ ID NO: 143463 - DNA, 22 bp, Artificial Sequence
  chemically synthesized
ccgggtcctgcaggagcaatct

SEQ ID NO: 143464 - DNA, 22 bp, Artificial Sequence
  chemically synthesized
caggagcaatctgcttctttca

SEQ ID NO: 143465 - DNA, 22 bp, Artificial Sequence
  chemically synthesized
cttctttcagagggtgtgtgcg

SEQ ID NO: 143466 - DNA, 22 bp, Artificial Sequence
  chemically synthesized
ctttcagagggtgtgtgcgttc

SEQ ID NO: 143467 - DNA, 22 bp, Artificial Sequence
  chemically synthesized
tttcagagggtgtgtgcgttct

SEQ ID NO: 143468 - DNA, 22 bp, Artificial Sequence
  chemically synthesized
tcagagggtgtgtgcgttctct

SEQ ID NO: 143469 - DNA, 22 bp, Artificial Sequence
  chemically synthesized
cagagggtgtgtgcgttctctc

SEQ ID NO: 143470 - DNA, 22 bp, Artificial Sequence
  chemically synthesized
agagggtgtgtgcgttctctca

SEQ ID NO: 143471 - DNA, 22 bp, Artificial Sequence
  chemically synthesized
tctcagctttcttgatttattt

SEQ ID NO: 143472 - DNA, 22 bp, Artificial Sequence
  chemically synthesized
tcagctttcttgatttatttct

SEQ ID NO: 143473 - DNA, 22 bp, Artificial Sequence
  chemically synthesized
agctttcttgatttatttctgc

SEQ ID NO: 143474 - DNA, 22 bp, Artificial Sequence
  chemically synthesized
tcttgatttatttctgcaggtg

SEQ ID NO: 143475 - DNA, 22 bp, Artificial Sequence
  chemically synthesized
cttgatttatttctgcaggtgg

SEQ ID NO: 143476 - DNA, 22 bp, Artificial Sequence
  chemically synthesized
ttgatttatttctgcaggtggt

SEQ ID NO: 143477 - DNA, 22 bp, Artificial Sequence
  chemically synthesized
gatttatttctgcaggtggttc

SEQ ID NO: 143478 - DNA, 22 bp, Artificial Sequence
  chemically synthesized
atttatttctgcaggtggttct

SEQ ID NO: 143479 - DNA, 22 bp, Artificial Sequence
  chemically synthesized
atttctgcaggtggttctgcaa

SEQ ID NO: 143480 - DNA, 22 bp, Artificial Sequence
  chemically synthesized
tttctgcaggtggttctgcaaa

SEQ ID NO: 143481 - DNA, 22 bp, Artificial Sequence
  chemically synthesized
ctgcaggtggttctgcaaaaaa

SEQ ID NO: 143482 - DNA, 22 bp, Artificial Sequence
  chemically synthesized
tgcaggtggttctgcaaaaaaa

SEQ ID NO: 143483 - DNA, 22 bp, Artificial Sequence
  chemically synthesized
caggtggttctgcaaaaaaaat

SEQ ID NO: 143484 - DNA, 22 bp, Artificial Sequence
  chemically synthesized
tgcaaaaaaaattcctgatggg

SEQ ID NO: 143485 - DNA, 22 bp, Artificial Sequence
  chemically synthesized
caaaaaaaattcctgatgggag

SEQ ID NO: 143486 - DNA, 22 bp, Artificial Sequence
  chemically synthesized
ctgatgggagacttcacatgct

SEQ ID NO: 143487 - DNA, 22 bp, Artificial Sequence
  chemically synthesized
atgggagacttcacatgctgct

SEQ ID NO: 143488 - DNA, 22 bp, Artificial Sequence
  chemically synthesized
cacatgctgctctgtgcatccg

SEQ ID NO: 143489 - DNA, 22 bp, Artificial Sequence
  chemically synthesized
acatgctgctctgtgcatccga

SEQ ID NO: 143490 - DNA, 22 bp, Artificial Sequence
  chemically synthesized
ctctgtgcatccgagtgggagc

SEQ ID NO: 143491 - DNA, 22 bp, Artificial Sequence
  chemically synthesized
tgtgcatccgagtgggagctgc

SEQ ID NO: 143492 - DNA, 22 bp, Artificial Sequence
  chemically synthesized
tgcatccgagtgggagctgcaa

SEQ ID NO: 143493 - DNA, 22 bp, Artificial Sequence
  chemically synthesized
caatgtacttctgctgcctccc

SEQ ID NO: 143494 - DNA, 22 bp, Artificial Sequence
  chemically synthesized
ctgctgcctcccatctgccatc

SEQ ID NO: 143495 - DNA, 22 bp, Artificial Sequence
  chemically synthesized
tgctgcctcccatctgccatca

SEQ ID NO: 143496 - DNA, 22 bp, Artificial Sequence
  chemically synthesized
ctgcctcccatctgccatcacc

SEQ ID NO: 143497 - DNA, 22 bp, Artificial Sequence
  chemically synthesized
cctcccatctgccatcaccctc

SEQ ID NO: 143498 - DNA, 22 bp, Artificial Sequence
  chemically synthesized
ccatctgccatcaccctctaat

SEQ ID NO: 143499 - DNA, 22 bp, Artificial Sequence
  chemically synthesized
ccatcaccctctaatttgtcgg

SEQ ID NO: 143500 - DNA, 22 bp, Artificial Sequence
  chemically synthesized
taatttgtcggtaatatgcatt

SEQ ID NO: 143501 - DNA, 22 bp, Artificial Sequence
  chemically synthesized
atttgtcggtaatatgcatttt

SEQ ID NO: 143502 - DNA, 22 bp, Artificial Sequence
  chemically synthesized
gtcggtaatatgcatttttaat

SEQ ID NO: 143503 - DNA, 22 bp, Artificial Sequence
  chemically synthesized
tcggtaatatgcatttttaatc

SEQ ID NO: 143504 - DNA, 22 bp, Artificial Sequence
  chemically synthesized
ttaatcaatctttttttctctc

SEQ ID NO: 143505 - DNA, 22 bp, Artificial Sequence
  chemically synthesized
taatcaatctttttttctctct

SEQ ID NO: 143506 - DNA, 22 bp, Artificial Sequence
  chemically synthesized
aatcaatctttttttctctctc

SEQ ID NO: 143507 - DNA, 22 bp, Artificial Sequence
  chemically synthesized
atcaatctttttttctctctct

SEQ ID NO: 143508 - DNA, 22 bp, Artificial Sequence
  chemically synthesized
tttttctctctctctctttttc

SEQ ID NO: 143509 - DNA, 22 bp, Artificial Sequence
  chemically synthesized
ttttctctctctctctttttct

SEQ ID NO: 143510 - DNA, 22 bp, Artificial Sequence
  chemically synthesized
tttctctctctctctttttctt

SEQ ID NO: 143511 - DNA, 22 bp, Artificial Sequence
  chemically synthesized
ttctctctctctctttttcttc

SEQ ID NO: 143512 - DNA, 22 bp, Artificial Sequence
  chemically synthesized
tctctctctctctttttcttct

SEQ ID NO: 143513 - DNA, 22 bp, Artificial Sequence
  chemically synthesized
ctctctctctctttttcttctc

SEQ ID NO: 143514 - DNA, 22 bp, Artificial Sequence
  chemically synthesized
tctctctctctttttcttctcc

SEQ ID NO: 143515 - DNA, 22 bp, Artificial Sequence
  chemically synthesized
tctctctctttttcttctcccc

SEQ ID NO: 143516 - DNA, 22 bp, Artificial Sequence
  chemically synthesized
tctctctttttcttctccccca

SEQ ID NO: 143517 - DNA, 22 bp, Artificial Sequence
  chemically synthesized
tctctttttcttctcccccaaa

SEQ ID NO: 143518 - DNA, 22 bp, Artificial Sequence
  chemically synthesized
tctttttcttctcccccaaaac

SEQ ID NO: 143519 - DNA, 22 bp, Artificial Sequence
  chemically synthesized
tttttcttctcccccaaaacta

SEQ ID NO: 143520 - DNA, 22 bp, Artificial Sequence
  chemically synthesized
tttcttctcccccaaaactata

SEQ ID NO: 143521 - DNA, 22 bp, Artificial Sequence
  chemically synthesized
ttcttctcccccaaaactatac

SEQ ID NO: 143522 - DNA, 22 bp, Artificial Sequence
  chemically synthesized
tcttctcccccaaaactatact

SEQ ID NO: 143523 - DNA, 22 bp, Artificial Sequence
  chemically synthesized
cttctcccccaaaactatactg

SEQ ID NO: 143524 - DNA, 22 bp, Artificial Sequence
  chemically synthesized
ttctcccccaaaactatactgc

SEQ ID NO: 143525 - DNA, 22 bp, Artificial Sequence
  chemically synthesized
ctcccccaaaactatactgccc

SEQ ID NO: 143526 - DNA, 22 bp, Artificial Sequence
  chemically synthesized
tcccccaaaactatactgccct

SEQ ID NO: 143527 - DNA, 22 bp, Artificial Sequence
  chemically synthesized
ccccaaaactatactgcccttt

SEQ ID NO: 143528 - DNA, 22 bp, Artificial Sequence
  chemically synthesized
tactgccctttgatatcaagga

SEQ ID NO: 143529 - DNA, 22 bp, Artificial Sequence
  chemically synthesized
ccctttgatatcaaggaatcaa

SEQ ID NO: 143530 - DNA, 22 bp, Artificial Sequence
  chemically synthesized
tgatatcaaggaatcaaggacg

SEQ ID NO: 143531 - DNA, 22 bp, Artificial Sequence
  chemically synthesized
gatatcaaggaatcaaggacgt

SEQ ID NO: 143532 - DNA, 22 bp, Artificial Sequence
  chemically synthesized
atatcaaggaatcaaggacgtg

SEQ ID NO: 143533 - DNA, 22 bp, Artificial Sequence
  chemically synthesized
aggggtgggcagtggatacact

SEQ ID NO: 143534 - DNA, 22 bp, Artificial Sequence
  chemically synthesized
tttaccccttagggagctatat

SEQ ID NO: 143535 - DNA, 22 bp, Artificial Sequence
  chemically synthesized
taccccttagggagctatatct

SEQ ID NO: 143536 - DNA, 22 bp, Artificial Sequence
  chemically synthesized
accccttagggagctatatcta

SEQ ID NO: 143537 - DNA, 22 bp, Artificial Sequence
  chemically synthesized
ccccttagggagctatatctag

SEQ ID NO: 143538 - DNA, 22 bp, Artificial Sequence
  chemically synthesized
agggagctatatctagatttag

SEQ ID NO: 143539 - DNA, 22 bp, Artificial Sequence
  chemically synthesized
gggagctatatctagatttaga

SEQ ID NO: 143540 - DNA, 22 bp, Artificial Sequence
  chemically synthesized
tatctagatttagatattgcca

SEQ ID NO: 143541 - DNA, 22 bp, Artificial Sequence
  chemically synthesized
gatttagatattgccaattcaa

SEQ ID NO: 143542 - DNA, 22 bp, Artificial Sequence
  chemically synthesized
agatattgccaattcaagataa

SEQ ID NO: 143543 - DNA, 22 bp, Artificial Sequence
  chemically synthesized
gatattgccaattcaagataac

SEQ ID NO: 143544 - DNA, 22 bp, Artificial Sequence
  chemically synthesized
ccaattcaagataacttaattg

SEQ ID NO: 143545 - DNA, 22 bp, Artificial Sequence
  chemically synthesized
aagataacttaattgaaagcaa

SEQ ID NO: 143546 - DNA, 22 bp, Artificial Sequence
  chemically synthesized
aattgaaagcaaattcataatg

SEQ ID NO: 143547 - DNA, 22 bp, Artificial Sequence
  chemically synthesized
attgaaagcaaattcataatga

SEQ ID NO: 143548 - DNA, 22 bp, Artificial Sequence
  chemically synthesized
aaagcaaattcataatgaatac

SEQ ID NO: 143549 - DNA, 22 bp, Artificial Sequence
  chemically synthesized
ataatgaatacacacacacaca

SEQ ID NO: 143550 - DNA, 22 bp, Artificial Sequence
  chemically synthesized
catgacaagatttttaatagtt

SEQ ID NO: 143551 - DNA, 22 bp, Artificial Sequence
  chemically synthesized
ttaatagttgaaagaataacta

SEQ ID NO: 143552 - DNA, 22 bp, Artificial Sequence
  chemically synthesized
taatagttgaaagaataactaa

SEQ ID NO: 143553 - DNA, 22 bp, Artificial Sequence
  chemically synthesized
aatagttgaaagaataactaat

SEQ ID NO: 143554 - DNA, 22 bp, Artificial Sequence
  chemically synthesized
atagttgaaagaataactaata

SEQ ID NO: 143555 - DNA, 22 bp, Artificial Sequence
  chemically synthesized
aaagaataactaataattgtcc

SEQ ID NO: 143556 - DNA, 22 bp, Artificial Sequence
  chemically synthesized
ataattgtccacaggcaataag

SEQ ID NO: 143557 - DNA, 22 bp, Artificial Sequence
  chemically synthesized
tccacaggcaataagggctttt

SEQ ID NO: 143558 - DNA, 22 bp, Artificial Sequence
  chemically synthesized
tttaagcaaaacagttgtgata

SEQ ID NO: 143559 - DNA, 22 bp, Artificial Sequence
  chemically synthesized
ttaagcaaaacagttgtgataa

SEQ ID NO: 143560 - DNA, 22 bp, Artificial Sequence
  chemically synthesized
taagcaaaacagttgtgataaa

SEQ ID NO: 143561 - DNA, 22 bp, Artificial Sequence
  chemically synthesized
aagcaaaacagttgtgataaac

SEQ ID NO: 143562 - DNA, 22 bp, Artificial Sequence
  chemically synthesized
agcaaaacagttgtgataaaca

SEQ ID NO: 143563 - DNA, 22 bp, Artificial Sequence
  chemically synthesized
tgataaacaggtcattcttaga

SEQ ID NO: 143564 - DNA, 22 bp, Artificial Sequence
  chemically synthesized
ttagaatagtaatccagccaat

SEQ ID NO: 143565 - DNA, 22 bp, Artificial Sequence
  chemically synthesized
agaatagtaatccagccaatag

SEQ ID NO: 143566 - DNA, 22 bp, Artificial Sequence
  chemically synthesized
gaatagtaatccagccaatagt

SEQ ID NO: 143567 - DNA, 22 bp, Artificial Sequence
  chemically synthesized
cttagagattatgtcattacca

SEQ ID NO: 143568 - DNA, 22 bp, Artificial Sequence
  chemically synthesized
agagattatgtcattaccagag

SEQ ID NO: 143569 - DNA, 22 bp, Artificial Sequence
  chemically synthesized
gagattatgtcattaccagagt

SEQ ID NO: 143570 - DNA, 22 bp, Artificial Sequence
  chemically synthesized
tgtcattaccagagttaaaatt

SEQ ID NO: 143571 - DNA, 22 bp, Artificial Sequence
  chemically synthesized
ccagagttaaaattctataatg

SEQ ID NO: 143572 - DNA, 22 bp, Artificial Sequence
  chemically synthesized
aaattctataatggcttctcac

SEQ ID NO: 143573 - DNA, 22 bp, Artificial Sequence
  chemically synthesized
tataatggcttctcactcccta

SEQ ID NO: 143574 - DNA, 22 bp, Artificial Sequence
  chemically synthesized
taatggcttctcactccctacc

SEQ ID NO: 143575 - DNA, 22 bp, Artificial Sequence
  chemically synthesized
ctcactccctaccactgaggac

SEQ ID NO: 143576 - DNA, 22 bp, Artificial Sequence
  chemically synthesized
tcactccctaccactgaggaca

SEQ ID NO: 143577 - DNA, 22 bp, Artificial Sequence
  chemically synthesized
actccctaccactgaggacaag

SEQ ID NO: 143578 - DNA, 22 bp, Artificial Sequence
  chemically synthesized
cctaccactgaggacaagttta

SEQ ID NO: 143579 - DNA, 22 bp, Artificial Sequence
  chemically synthesized
ccactgaggacaagtttatgtc

SEQ ID NO: 143580 - DNA, 22 bp, Artificial Sequence
  chemically synthesized
aggacaagtttatgtccttagg

SEQ ID NO: 143581 - DNA, 22 bp, Artificial Sequence
  chemically synthesized
atgtccttaggtttatgcttcc

SEQ ID NO: 143582 - DNA, 22 bp, Artificial Sequence
  chemically synthesized
tgtccttaggtttatgcttccc

SEQ ID NO: 143583 - DNA, 22 bp, Artificial Sequence
  chemically synthesized
aggtttatgcttccctgaaaca

SEQ ID NO: 143584 - DNA, 22 bp, Artificial Sequence
  chemically synthesized
ggtttatgcttccctgaaacaa

SEQ ID NO: 143585 - DNA, 22 bp, Artificial Sequence
  chemically synthesized
atgcttccctgaaacaatacca

SEQ ID NO: 143586 - DNA, 22 bp, Artificial Sequence
  chemically synthesized
tgcttccctgaaacaataccac

SEQ ID NO: 143587 - DNA, 22 bp, Artificial Sequence
  chemically synthesized
ccctgaaacaataccacctgct

SEQ ID NO: 143588 - DNA, 22 bp, Artificial Sequence
  chemically synthesized
cctgaaacaataccacctgcta

SEQ ID NO: 143589 - DNA, 22 bp, Artificial Sequence
  chemically synthesized
aaacaataccacctgctattct

SEQ ID NO: 143590 - DNA, 22 bp, Artificial Sequence
  chemically synthesized
ctattctccactttacatatca

SEQ ID NO: 143591 - DNA, 22 bp, Artificial Sequence
  chemically synthesized
ttctccactttacatatcaacg

SEQ ID NO: 143592 - DNA, 22 bp, Artificial Sequence
  chemically synthesized
tccactttacatatcaacggca

SEQ ID NO: 143593 - DNA, 22 bp, Artificial Sequence
  chemically synthesized
cactttacatatcaacggcact

SEQ ID NO: 143594 - DNA, 22 bp, Artificial Sequence
  chemically synthesized
tacatatcaacggcactggttc

SEQ ID NO: 143595 - DNA, 22 bp, Artificial Sequence
  chemically synthesized
acatatcaacggcactggttct

SEQ ID NO: 143596 - DNA, 22 bp, Artificial Sequence
  chemically synthesized
catatcaacggcactggttctt

SEQ ID NO: 143597 - DNA, 22 bp, Artificial Sequence
  chemically synthesized
gttctttatctaactctctggc

SEQ ID NO: 143598 - DNA, 22 bp, Artificial Sequence
  chemically synthesized
tttatctaactctctggcacag

SEQ ID NO: 143599 - DNA, 22 bp, Artificial Sequence
  chemically synthesized
tatctaactctctggcacagca

SEQ ID NO: 143600 - DNA, 22 bp, Artificial Sequence
  chemically synthesized
atctaactctctggcacagcag

SEQ ID NO: 143601 - DNA, 22 bp, Artificial Sequence
  chemically synthesized
tctaactctctggcacagcagg

SEQ ID NO: 143602 - DNA, 22 bp, Artificial Sequence
  chemically synthesized
actctctggcacagcaggagtt

SEQ ID NO: 143603 - DNA, 22 bp, Artificial Sequence
  chemically synthesized
tctggcacagcaggagtttgtt

SEQ ID NO: 143604 - DNA, 22 bp, Artificial Sequence
  chemically synthesized
tggcacagcaggagtttgtttt

SEQ ID NO: 143605 - DNA, 22 bp, Artificial Sequence
  chemically synthesized
gcacagcaggagtttgttttct

SEQ ID NO: 143606 - DNA, 22 bp, Artificial Sequence
  chemically synthesized
gttttcttctgcttcagagctt

SEQ ID NO: 143607 - DNA, 22 bp, Artificial Sequence
  chemically synthesized
ttttcttctgcttcagagcttt

SEQ ID NO: 143608 - DNA, 22 bp, Artificial Sequence
  chemically synthesized
tcttctgcttcagagctttgaa

SEQ ID NO: 143609 - DNA, 22 bp, Artificial Sequence
  chemically synthesized
cttctgcttcagagctttgaat

SEQ ID NO: 143610 - DNA, 22 bp, Artificial Sequence
  chemically synthesized
ttctgcttcagagctttgaatt

SEQ ID NO: 143611 - DNA, 22 bp, Artificial Sequence
  chemically synthesized
ctgcttcagagctttgaattta

SEQ ID NO: 143612 - DNA, 22 bp, Artificial Sequence
  chemically synthesized
tgcttcagagctttgaatttac

SEQ ID NO: 143613 - DNA, 22 bp, Artificial Sequence
  chemically synthesized
cttcagagctttgaatttacta

SEQ ID NO: 143614 - DNA, 22 bp, Artificial Sequence
  chemically synthesized
cagagctttgaatttactattt

SEQ ID NO: 143615 - DNA, 22 bp, Artificial Sequence
  chemically synthesized
agagctttgaatttactatttc

SEQ ID NO: 143616 - DNA, 22 bp, Artificial Sequence
  chemically synthesized
tgaatttactatttcagcttct

SEQ ID NO: 143617 - DNA, 22 bp, Artificial Sequence
  chemically synthesized
gaatttactatttcagcttcta

SEQ ID NO: 143618 - DNA, 22 bp, Artificial Sequence
  chemically synthesized
aatttactatttcagcttctaa

SEQ ID NO: 143619 - DNA, 22 bp, Artificial Sequence
  chemically synthesized
actatttcagcttctaaacttt

SEQ ID NO: 143620 - DNA, 22 bp, Artificial Sequence
  chemically synthesized
ctatttcagcttctaaacttta

SEQ ID NO: 143621 - DNA, 22 bp, Artificial Sequence
  chemically synthesized
tttcagcttctaaactttattt

SEQ ID NO: 143622 - DNA, 22 bp, Artificial Sequence
  chemically synthesized
cagcttctaaactttatttggc

SEQ ID NO: 143623 - DNA, 22 bp, Artificial Sequence
  chemically synthesized
agcttctaaactttatttggca

SEQ ID NO: 143624 - DNA, 22 bp, Artificial Sequence
  chemically synthesized
ctaaactttatttggcaatgcc

SEQ ID NO: 143625 - DNA, 22 bp, Artificial Sequence
  chemically synthesized
taaactttatttggcaatgcct

SEQ ID NO: 143626 - DNA, 22 bp, Artificial Sequence
  chemically synthesized
aactttatttggcaatgccttc

SEQ ID NO: 143627 - DNA, 22 bp, Artificial Sequence
  chemically synthesized
tatttggcaatgccttcccatg

SEQ ID NO: 143628 - DNA, 22 bp, Artificial Sequence
  chemically synthesized
atttggcaatgccttcccatgg

SEQ ID NO: 143629 - DNA, 22 bp, Artificial Sequence
  chemically synthesized
tttggcaatgccttcccatggc

SEQ ID NO: 143630 - DNA, 22 bp, Artificial Sequence
  chemically synthesized
ggcaatgccttcccatggcaga

SEQ ID NO: 143631 - DNA, 22 bp, Artificial Sequence
  chemically synthesized
gcaatgccttcccatggcagat

SEQ ID NO: 143632 - DNA, 22 bp, Artificial Sequence
  chemically synthesized
cccatggcagattccttctgtc

SEQ ID NO: 143633 - DNA, 22 bp, Artificial Sequence
  chemically synthesized
ccatggcagattccttctgtca

SEQ ID NO: 143634 - DNA, 22 bp, Artificial Sequence
  chemically synthesized
cttctgtcattttgcctctgtt

SEQ ID NO: 143635 - DNA, 22 bp, Artificial Sequence
  chemically synthesized
ctgtcattttgcctctgttcga

SEQ ID NO: 143636 - DNA, 22 bp, Artificial Sequence
  chemically synthesized
tgtcattttgcctctgttcgaa

SEQ ID NO: 143637 - DNA, 22 bp, Artificial Sequence
  chemically synthesized
tcattttgcctctgttcgaata

SEQ ID NO: 143638 - DNA, 22 bp, Artificial Sequence
  chemically synthesized
tgcctctgttcgaatactttct

SEQ ID NO: 143639 - DNA, 22 bp, Artificial Sequence
  chemically synthesized
gcctctgttcgaatactttctc

SEQ ID NO: 143640 - DNA, 22 bp, Artificial Sequence
  chemically synthesized
cctctgttcgaatactttctcc

SEQ ID NO: 143641 - DNA, 22 bp, Artificial Sequence
  chemically synthesized
tgttcgaatactttctccttaa

SEQ ID NO: 143642 - DNA, 22 bp, Artificial Sequence
  chemically synthesized
ttcgaatactttctccttaatt

SEQ ID NO: 143643 - DNA, 22 bp, Artificial Sequence
  chemically synthesized
gaatactttctccttaatttca

SEQ ID NO: 143644 - DNA, 22 bp, Artificial Sequence
  chemically synthesized
tctccttaatttcattcttagt

SEQ ID NO: 143645 - DNA, 22 bp, Artificial Sequence
  chemically synthesized
ctccttaatttcattcttagtt

SEQ ID NO: 143646 - DNA, 22 bp, Artificial Sequence
  chemically synthesized
tccttaatttcattcttagtta

SEQ ID NO: 143647 - DNA, 22 bp, Artificial Sequence
  chemically synthesized
cttaatttcattcttagttaat

SEQ ID NO: 143648 - DNA, 22 bp, Artificial Sequence
  chemically synthesized
aatttcattcttagttaataat

SEQ ID NO: 143649 - DNA, 22 bp, Artificial Sequence
  chemically synthesized
atttcattcttagttaataata

SEQ ID NO: 143650 - DNA, 22 bp, Artificial Sequence
  chemically synthesized
cattcttagttaataatatctg

SEQ ID NO: 143651 - DNA, 22 bp, Artificial Sequence
  chemically synthesized
attcttagttaataatatctga

SEQ ID NO: 143652 - DNA, 22 bp, Artificial Sequence
  chemically synthesized
ttagttaataatatctgaaatt

SEQ ID NO: 143653 - DNA, 22 bp, Artificial Sequence
  chemically synthesized
agttaataatatctgaaattat

SEQ ID NO: 143654 - DNA, 22 bp, Artificial Sequence
  chemically synthesized
gttaataatatctgaaattatt

SEQ ID NO: 143655 - DNA, 22 bp, Artificial Sequence
  chemically synthesized
ataatatctgaaattattttgt

SEQ ID NO: 143656 - DNA, 22 bp, Artificial Sequence
  chemically synthesized
aaattattttgttgtttaactt

SEQ ID NO: 143657 - DNA, 22 bp, Artificial Sequence
  chemically synthesized
ttttgttgtttaacttaattat

SEQ ID NO: 143658 - DNA, 22 bp, Artificial Sequence
  chemically synthesized
tgttgtttaacttaattattaa

SEQ ID NO: 143659 - DNA, 22 bp, Artificial Sequence
  chemically synthesized
gttgtttaacttaattattaat

SEQ ID NO: 143660 - DNA, 22 bp, Artificial Sequence
  chemically synthesized
ttgtttaacttaattattaatt

SEQ ID NO: 143661 - DNA, 22 bp, Artificial Sequence
  chemically synthesized
tttaacttaattattaatttta

SEQ ID NO: 143662 - DNA, 22 bp, Artificial Sequence
  chemically synthesized
aacttaattattaattttatgt

SEQ ID NO: 143663 - DNA, 22 bp, Artificial Sequence
  chemically synthesized
acttaattattaattttatgta

SEQ ID NO: 143664 - DNA, 22 bp, Artificial Sequence
  chemically synthesized
aattattaattttatgtatgtt

SEQ ID NO: 143665 - DNA, 22 bp, Artificial Sequence
  chemically synthesized
attattaattttatgtatgttc

SEQ ID NO: 143666 - DNA, 22 bp, Artificial Sequence
  chemically synthesized
ttaattttatgtatgttctacc

SEQ ID NO: 143667 - DNA, 22 bp, Artificial Sequence
  chemically synthesized
attttatgtatgttctacctag

SEQ ID NO: 143668 - DNA, 22 bp, Artificial Sequence
  chemically synthesized
tatgtatgttctacctagatta

SEQ ID NO: 143669 - DNA, 22 bp, Artificial Sequence
  chemically synthesized
atgtatgttctacctagattat

SEQ ID NO: 143670 - DNA, 22 bp, Artificial Sequence
  chemically synthesized
tgtatgttctacctagattata

SEQ ID NO: 143671 - DNA, 22 bp, Artificial Sequence
  chemically synthesized
tacctagattataatcttcaga

SEQ ID NO: 143672 - DNA, 22 bp, Artificial Sequence
  chemically synthesized
cctagattataatcttcagagg

SEQ ID NO: 143673 - DNA, 22 bp, Artificial Sequence
  chemically synthesized
gattataatcttcagaggaaag

SEQ ID NO: 143674 - DNA, 22 bp, Artificial Sequence
  chemically synthesized
taatcttcagaggaaagtttta

SEQ ID NO: 143675 - DNA, 22 bp, Artificial Sequence
  chemically synthesized
cagaggaaagttttattctctg

SEQ ID NO: 143676 - DNA, 22 bp, Artificial Sequence
  chemically synthesized
agaggaaagttttattctctga

SEQ ID NO: 143677 - DNA, 22 bp, Artificial Sequence
  chemically synthesized
tattctctgacttatttaactt

SEQ ID NO: 143678 - DNA, 22 bp, Artificial Sequence
  chemically synthesized
attctctgacttatttaactta

SEQ ID NO: 143679 - DNA, 22 bp, Artificial Sequence
  chemically synthesized
ttctctgacttatttaacttaa

SEQ ID NO: 143680 - DNA, 22 bp, Artificial Sequence
  chemically synthesized
tctgacttatttaacttaaatg

SEQ ID NO: 143681 - DNA, 22 bp, Artificial Sequence
  chemically synthesized
tgacttatttaacttaaatgcc

SEQ ID NO: 143682 - DNA, 22 bp, Artificial Sequence
  chemically synthesized
acttatttaacttaaatgccca

SEQ ID NO: 143683 - DNA, 22 bp, Artificial Sequence
  chemically synthesized
atttaacttaaatgcccactac

SEQ ID NO: 143684 - DNA, 22 bp, Artificial Sequence
  chemically synthesized
tttaacttaaatgcccactact

SEQ ID NO: 143685 - DNA, 22 bp, Artificial Sequence
  chemically synthesized
aacttaaatgcccactacttta

SEQ ID NO: 143686 - DNA, 22 bp, Artificial Sequence
  chemically synthesized
acttaaatgcccactactttaa

SEQ ID NO: 143687 - DNA, 22 bp, Artificial Sequence
  chemically synthesized
aaatgcccactactttaaaaat

SEQ ID NO: 143688 - DNA, 22 bp, Artificial Sequence
  chemically synthesized
aatgcccactactttaaaaatt

SEQ ID NO: 143689 - DNA, 22 bp, Artificial Sequence
  chemically synthesized
ctttaaaaattatgacatttat

SEQ ID NO: 143690 - DNA, 22 bp, Artificial Sequence
  chemically synthesized
taaaaattatgacatttattta

SEQ ID NO: 143691 - DNA, 22 bp, Artificial Sequence
  chemically synthesized
aaaaattatgacatttatttaa

SEQ ID NO: 143692 - DNA, 22 bp, Artificial Sequence
  chemically synthesized
aaaattatgacatttatttaac

SEQ ID NO: 143693 - DNA, 22 bp, Artificial Sequence
  chemically synthesized
tgacatttatttaacagatatt

SEQ ID NO: 143694 - DNA, 22 bp, Artificial Sequence
  chemically synthesized
atttaacagatatttgctgaac

SEQ ID NO: 143695 - DNA, 22 bp, Artificial Sequence
  chemically synthesized
tttaacagatatttgctgaaca

SEQ ID NO: 143696 - DNA, 22 bp, Artificial Sequence
  chemically synthesized
aacagatatttgctgaacaaat

SEQ ID NO: 143697 - DNA, 22 bp, Artificial Sequence
  chemically synthesized
acagatatttgctgaacaaatg

SEQ ID NO: 143698 - DNA, 22 bp, Artificial Sequence
  chemically synthesized
gctgaacaaatgtttgaaaata

SEQ ID NO: 143699 - DNA, 22 bp, Artificial Sequence
  chemically synthesized
ctgaacaaatgtttgaaaatac

SEQ ID NO: 143700 - DNA, 22 bp, Artificial Sequence
  chemically synthesized
aacaaatgtttgaaaatacatg

SEQ ID NO: 143701 - DNA, 22 bp, Artificial Sequence
  chemically synthesized
gaaaatacatgggaaagaatgc

SEQ ID NO: 143702 - DNA, 22 bp, Artificial Sequence
  chemically synthesized
aaaatacatgggaaagaatgct

SEQ ID NO: 143703 - DNA, 22 bp, Artificial Sequence
  chemically synthesized
gaaaacacttgaaattgcttgt

SEQ ID NO: 143704 - DNA, 22 bp, Artificial Sequence
  chemically synthesized
aaaacacttgaaattgcttgtg

SEQ ID NO: 143705 - DNA, 22 bp, Artificial Sequence
  chemically synthesized
gaaattgcttgtgtaaagaaac

SEQ ID NO: 143706 - DNA, 22 bp, Artificial Sequence
  chemically synthesized
aaattgcttgtgtaaagaaaca

SEQ ID NO: 143707 - DNA, 22 bp, Artificial Sequence
  chemically synthesized
cttgtgtaaagaaacagtttta

SEQ ID NO: 143708 - DNA, 22 bp, Artificial Sequence
  chemically synthesized
gtgtaaagaaacagttttatca

SEQ ID NO: 143709 - DNA, 22 bp, Artificial Sequence
  chemically synthesized
tgtaaagaaacagttttatcag

SEQ ID NO: 143710 - DNA, 22 bp, Artificial Sequence
  chemically synthesized
tatcagttaggatttaatcaat

SEQ ID NO: 143711 - DNA, 22 bp, Artificial Sequence
  chemically synthesized
atcagttaggatttaatcaatg

SEQ ID NO: 143712 - DNA, 22 bp, Artificial Sequence
  chemically synthesized
tcagttaggatttaatcaatgt

SEQ ID NO: 143713 - DNA, 22 bp, Artificial Sequence
  chemically synthesized
ggatttaatcaatgtcagaagc

SEQ ID NO: 143714 - DNA, 22 bp, Artificial Sequence
  chemically synthesized
aatcaatgtcagaagcaatgat

SEQ ID NO: 143715 - DNA, 22 bp, Artificial Sequence
  chemically synthesized
atcaatgtcagaagcaatgata

SEQ ID NO: 143716 - DNA, 22 bp, Artificial Sequence
  chemically synthesized
tggataaggagaaatcaacaaa

SEQ ID NO: 143717 - DNA, 22 bp, Artificial Sequence
  chemically synthesized
ttaaaagatattgcctcaaaag

SEQ ID NO: 143718 - DNA, 22 bp, Artificial Sequence
  chemically synthesized
aaaagatattgcctcaaaagca

SEQ ID NO: 143719 - DNA, 22 bp, Artificial Sequence
  chemically synthesized
aaagatattgcctcaaaagcat

SEQ ID NO: 143720 - DNA, 22 bp, Artificial Sequence
  chemically synthesized
cctcaaaagcataagaggaaat

SEQ ID NO: 143721 - DNA, 22 bp, Artificial Sequence
  chemically synthesized
aaaagcataagaggaaataagg

SEQ ID NO: 143722 - DNA, 22 bp, Artificial Sequence
  chemically synthesized
atacatgacttttagaacactg

SEQ ID NO: 143723 - DNA, 22 bp, Artificial Sequence
  chemically synthesized
tacatgacttttagaacactgc

SEQ ID NO: 143724 - DNA, 22 bp, Artificial Sequence
  chemically synthesized
ttagaacactgccttggttttt

SEQ ID NO: 143725 - DNA, 22 bp, Artificial Sequence
  chemically synthesized
tagaacactgccttggtttttg

SEQ ID NO: 143726 - DNA, 22 bp, Artificial Sequence
  chemically synthesized
agaacactgccttggtttttgg

SEQ ID NO: 143727 - DNA, 22 bp, Artificial Sequence
  chemically synthesized
gaacactgccttggtttttgga

SEQ ID NO: 143728 - DNA, 22 bp, Artificial Sequence
  chemically synthesized
ccttggtttttggataaatggg

SEQ ID NO: 143729 - DNA, 22 bp, Artificial Sequence
  chemically synthesized
ggtttttggataaatggggaag

SEQ ID NO: 143730 - DNA, 22 bp, Artificial Sequence
  chemically synthesized
gtttttggataaatggggaagt

SEQ ID NO: 143731 - DNA, 22 bp, Artificial Sequence
  chemically synthesized
ttggataaatggggaagttgtt

SEQ ID NO: 143732 - DNA, 22 bp, Artificial Sequence
  chemically synthesized
tggataaatggggaagttgttt

SEQ ID NO: 143733 - DNA, 22 bp, Artificial Sequence
  chemically synthesized
ggataaatggggaagttgtttg

SEQ ID NO: 143734 - DNA, 22 bp, Artificial Sequence
  chemically synthesized
gataaatggggaagttgtttga

SEQ ID NO: 143735 - DNA, 22 bp, Artificial Sequence
  chemically synthesized
tttgaaaacaggagggatccta

SEQ ID NO: 143736 - DNA, 22 bp, Artificial Sequence
  chemically synthesized
gaaaacaggagggatcctagat

SEQ ID NO: 143737 - DNA, 22 bp, Artificial Sequence
  chemically synthesized
aaaacaggagggatcctagata

SEQ ID NO: 143738 - DNA, 22 bp, Artificial Sequence
  chemically synthesized
gatattccttagtctgaggagg

SEQ ID NO: 143739 - DNA, 22 bp, Artificial Sequence
  chemically synthesized
cttagtctgaggaggagcaatt

SEQ ID NO: 143740 - DNA, 22 bp, Artificial Sequence
  chemically synthesized
agtctgaggaggagcaattaag

SEQ ID NO: 143741 - DNA, 22 bp, Artificial Sequence
  chemically synthesized
gtctgaggaggagcaattaaga

SEQ ID NO: 143742 - DNA, 22 bp, Artificial Sequence
  chemically synthesized
aggaggagcaattaagattcac

SEQ ID NO: 143743 - DNA, 22 bp, Artificial Sequence
  chemically synthesized
agattcacttgtttagaggctg

SEQ ID NO: 143744 - DNA, 22 bp, Artificial Sequence
  chemically synthesized
acttgtttagaggctgggagtg

SEQ ID NO: 143745 - DNA, 22 bp, Artificial Sequence
  chemically synthesized
gtttagaggctgggagtggtgg

SEQ ID NO: 143746 - DNA, 22 bp, Artificial Sequence
  chemically synthesized
tttagaggctgggagtggtggc

SEQ ID NO: 143747 - DNA, 22 bp, Artificial Sequence
  chemically synthesized
agaggctgggagtggtggctca

SEQ ID NO: 143748 - DNA, 22 bp, Artificial Sequence
  chemically synthesized
gaggctgggagtggtggctcac

SEQ ID NO: 143749 - DNA, 22 bp, Artificial Sequence
  chemically synthesized
ggagtggtggctcacgcctgta

SEQ ID NO: 143750 - DNA, 22 bp, Artificial Sequence
  chemically synthesized
acgcctgtaatcccagaatttt

SEQ ID NO: 143751 - DNA, 22 bp, Artificial Sequence
  chemically synthesized
taatcccagaattttgggaggc

SEQ ID NO: 143752 - DNA, 22 bp, Artificial Sequence
  chemically synthesized
tgggaggccaaggcaggcagat

SEQ ID NO: 143753 - DNA, 22 bp, Artificial Sequence
  chemically synthesized
gggaggccaaggcaggcagatc

SEQ ID NO: 143754 - DNA, 22 bp, Artificial Sequence
  chemically synthesized
ggaggccaaggcaggcagatca

SEQ ID NO: 143755 - DNA, 22 bp, Artificial Sequence
  chemically synthesized
aggtcaagagttcaagaccaac

SEQ ID NO: 143756 - DNA, 22 bp, Artificial Sequence
  chemically synthesized
aagaccaacctggccaacatgg

SEQ ID NO: 143757 - DNA, 22 bp, Artificial Sequence
  chemically synthesized
gccaacatggtgaaatcccatc

SEQ ID NO: 143758 - DNA, 22 bp, Artificial Sequence
  chemically synthesized
tacaaaaatacaaaaattagac

SEQ ID NO: 143759 - DNA, 22 bp, Artificial Sequence
  chemically synthesized
caaaaatacaaaaattagacag

SEQ ID NO: 143760 - DNA, 22 bp, Artificial Sequence
  chemically synthesized
gacaggcatgatggcaagtgcc

SEQ ID NO: 143761 - DNA, 22 bp, Artificial Sequence
  chemically synthesized
taatcccagctacttgggaggc

SEQ ID NO: 143762 - DNA, 22 bp, Artificial Sequence
  chemically synthesized
cttgggaggctgaggaaggaga

SEQ ID NO: 143763 - DNA, 22 bp, Artificial Sequence
  chemically synthesized
gggaggctgaggaaggagaatt

SEQ ID NO: 143764 - DNA, 22 bp, Artificial Sequence
  chemically synthesized
ggaggctgaggaaggagaattg

SEQ ID NO: 143765 - DNA, 22 bp, Artificial Sequence
  chemically synthesized
aggaaggagaattgcttgaacc

SEQ ID NO: 143766 - DNA, 22 bp, Artificial Sequence
  chemically synthesized
cttgaacctggaaggcaggagt

SEQ ID NO: 143767 - DNA, 22 bp, Artificial Sequence
  chemically synthesized
gaacctggaaggcaggagttgc

SEQ ID NO: 143768 - DNA, 22 bp, Artificial Sequence
  chemically synthesized
aacctggaaggcaggagttgca

SEQ ID NO: 143769 - DNA, 22 bp, Artificial Sequence
  chemically synthesized
gaaggcaggagttgcagtgagc

SEQ ID NO: 143770 - DNA, 22 bp, Artificial Sequence
  chemically synthesized
cagtgagccgagatcataccac

SEQ ID NO: 143771 - DNA, 22 bp, Artificial Sequence
  chemically synthesized
cactccagcctgggtgacagaa

SEQ ID NO: 143772 - DNA, 22 bp, Artificial Sequence
  chemically synthesized
cagcctgggtgacagaacaaga

SEQ ID NO: 143773 - DNA, 22 bp, Artificial Sequence
  chemically synthesized
ggtgacagaacaagactctgtc

SEQ ID NO: 143774 - DNA, 22 bp, Artificial Sequence
  chemically synthesized
tgtctcaaaaaaaaaaaagaga

SEQ ID NO: 143775 - DNA, 22 bp, Artificial Sequence
  chemically synthesized
tctcaaaaaaaaaaaagagaga

SEQ ID NO: 143776 - DNA, 22 bp, Artificial Sequence
  chemically synthesized
aaaaaaaaaaaagagagattca

SEQ ID NO: 143777 - DNA, 22 bp, Artificial Sequence
  chemically synthesized
aaaagattcacttgtttaggcc

SEQ ID NO: 143778 - DNA, 22 bp, Artificial Sequence
  chemically synthesized
acttgtttaggccttagcgggc

SEQ ID NO: 143779 - DNA, 22 bp, Artificial Sequence
  chemically synthesized
gtttaggccttagcgggcttag

SEQ ID NO: 143780 - DNA, 22 bp, Artificial Sequence
  chemically synthesized
tttaggccttagcgggcttaga

SEQ ID NO: 143781 - DNA, 22 bp, Artificial Sequence
  chemically synthesized
aggccttagcgggcttagacac

SEQ ID NO: 143782 - DNA, 22 bp, Artificial Sequence
  chemically synthesized
ggccttagcgggcttagacacc

SEQ ID NO: 143783 - DNA, 22 bp, Artificial Sequence
  chemically synthesized
agcgggcttagacaccagtctc

SEQ ID NO: 143784 - DNA, 22 bp, Artificial Sequence
  chemically synthesized
gcgggcttagacaccagtctct

SEQ ID NO: 143785 - DNA, 22 bp, Artificial Sequence
  chemically synthesized
agacaccagtctctgacacatt

SEQ ID NO: 143786 - DNA, 22 bp, Artificial Sequence
  chemically synthesized
gacaccagtctctgacacattc

SEQ ID NO: 143787 - DNA, 22 bp, Artificial Sequence
  chemically synthesized
tgacacattcttaaaggtcagg

SEQ ID NO: 143788 - DNA, 22 bp, Artificial Sequence
  chemically synthesized
acacattcttaaaggtcaggct

SEQ ID NO: 143789 - DNA, 22 bp, Artificial Sequence
  chemically synthesized
ttaaaggtcaggctctacaaat

SEQ ID NO: 143790 - DNA, 22 bp, Artificial Sequence
  chemically synthesized
aaaggtcaggctctacaaatgg

SEQ ID NO: 143791 - DNA, 22 bp, Artificial Sequence
  chemically synthesized
aaggtcaggctctacaaatgga

SEQ ID NO: 143792 - DNA, 22 bp, Artificial Sequence
  chemically synthesized
tacaaatggaacccaaccagac

SEQ ID NO: 143793 - DNA, 22 bp, Artificial Sequence
  chemically synthesized
caaatggaacccaaccagactc

SEQ ID NO: 143794 - DNA, 22 bp, Artificial Sequence
  chemically synthesized
tcagatatggccaaagatctat

SEQ ID NO: 143795 - DNA, 22 bp, Artificial Sequence
  chemically synthesized
agatatggccaaagatctatac

SEQ ID NO: 143796 - DNA, 22 bp, Artificial Sequence
  chemically synthesized
tacacacccatctcacagatcc

SEQ ID NO: 143797 - DNA, 22 bp, Artificial Sequence
  chemically synthesized
acagatcccctatcttaaagag

SEQ ID NO: 143798 - DNA, 22 bp, Artificial Sequence
  chemically synthesized
tcttaaagagaccctaatttgg

SEQ ID NO: 143799 - DNA, 22 bp, Artificial Sequence
  chemically synthesized
aaagagaccctaatttgggttc

SEQ ID NO: 143800 - DNA, 22 bp, Artificial Sequence
  chemically synthesized
aagagaccctaatttgggttca

SEQ ID NO: 143801 - DNA, 22 bp, Artificial Sequence
  chemically synthesized
atttgggttcacctcagtctct

SEQ ID NO: 143802 - DNA, 22 bp, Artificial Sequence
  chemically synthesized
gggttcacctcagtctctataa

SEQ ID NO: 143803 - DNA, 22 bp, Artificial Sequence
  chemically synthesized
ggttcacctcagtctctataat

SEQ ID NO: 143804 - DNA, 22 bp, Artificial Sequence
  chemically synthesized
acctcagtctctataatctgta

SEQ ID NO: 143805 - DNA, 22 bp, Artificial Sequence
  chemically synthesized
agtctctataatctgtaccagc

SEQ ID NO: 143806 - DNA, 22 bp, Artificial Sequence
  chemically synthesized
tataatctgtaccagcatacca

SEQ ID NO: 143807 - DNA, 22 bp, Artificial Sequence
  chemically synthesized
taatctgtaccagcataccaat

SEQ ID NO: 143808 - DNA, 22 bp, Artificial Sequence
  chemically synthesized
taccagcataccaataaaaatc

SEQ ID NO: 143809 - DNA, 22 bp, Artificial Sequence
  chemically synthesized
tctcacccatccttagattgag

SEQ ID NO: 143810 - DNA, 22 bp, Artificial Sequence
  chemically synthesized
ctcacccatccttagattgaga

SEQ ID NO: 143811 - DNA, 22 bp, Artificial Sequence
  chemically synthesized
tcacccatccttagattgagag

SEQ ID NO: 143812 - DNA, 22 bp, Artificial Sequence
  chemically synthesized
acccatccttagattgagagaa

SEQ ID NO: 143813 - DNA, 22 bp, Artificial Sequence
  chemically synthesized
agattgagagaagtcacttatt

SEQ ID NO: 143814 - DNA, 22 bp, Artificial Sequence
  chemically synthesized
gattgagagaagtcacttatta

SEQ ID NO: 143815 - DNA, 22 bp, Artificial Sequence
  chemically synthesized
agagaagtcacttattattatg

SEQ ID NO: 143816 - DNA, 22 bp, Artificial Sequence
  chemically synthesized
attattatgtgagtaactggaa

SEQ ID NO: 143817 - DNA, 22 bp, Artificial Sequence
  chemically synthesized
ttattatgtgagtaactggaag

SEQ ID NO: 143818 - DNA, 22 bp, Artificial Sequence
  chemically synthesized
ttatgtgagtaactggaagata

SEQ ID NO: 143819 - DNA, 22 bp, Artificial Sequence
  chemically synthesized
tgtgagtaactggaagatactg

SEQ ID NO: 143820 - DNA, 22 bp, Artificial Sequence
  chemically synthesized
gaagatactgataagttgacaa

SEQ ID NO: 143821 - DNA, 22 bp, Artificial Sequence
  chemically synthesized
ataagttgacaaatctttttct

SEQ ID NO: 143822 - DNA, 22 bp, Artificial Sequence
  chemically synthesized
acaaatctttttctttcctttc

SEQ ID NO: 143823 - DNA, 22 bp, Artificial Sequence
  chemically synthesized
tttctttcctttcttattcaac

SEQ ID NO: 143824 - DNA, 22 bp, Artificial Sequence
  chemically synthesized
ttctttcctttcttattcaact

SEQ ID NO: 143825 - DNA, 22 bp, Artificial Sequence
  chemically synthesized
tctttcctttcttattcaactt

SEQ ID NO: 143826 - DNA, 22 bp, Artificial Sequence
  chemically synthesized
ctttcctttcttattcaacttt

SEQ ID NO: 143827 - DNA, 22 bp, Artificial Sequence
  chemically synthesized
tttcctttcttattcaactttt

SEQ ID NO: 143828 - DNA, 22 bp, Artificial Sequence
  chemically synthesized
tcctttcttattcaacttttat

SEQ ID NO: 143829 - DNA, 22 bp, Artificial Sequence
  chemically synthesized
cctttcttattcaacttttatt

SEQ ID NO: 143830 - DNA, 22 bp, Artificial Sequence
  chemically synthesized
ctttcttattcaacttttattt

SEQ ID NO: 143831 - DNA, 22 bp, Artificial Sequence
  chemically synthesized
tcttattcaacttttattttaa

SEQ ID NO: 143832 - DNA, 22 bp, Artificial Sequence
  chemically synthesized
cttattcaacttttattttaac

SEQ ID NO: 143833 - DNA, 22 bp, Artificial Sequence
  chemically synthesized
ttattcaacttttattttaact

SEQ ID NO: 143834 - DNA, 22 bp, Artificial Sequence
  chemically synthesized
attcaacttttattttaacttc

SEQ ID NO: 143835 - DNA, 22 bp, Artificial Sequence
  chemically synthesized
ttcaacttttattttaacttcc

SEQ ID NO: 143836 - DNA, 22 bp, Artificial Sequence
  chemically synthesized
aacttttattttaacttccaaa

SEQ ID NO: 143837 - DNA, 22 bp, Artificial Sequence
  chemically synthesized
ttattttaacttccaaagaaca

SEQ ID NO: 143838 - DNA, 22 bp, Artificial Sequence
  chemically synthesized
tattttaacttccaaagaacaa

SEQ ID NO: 143839 - DNA, 22 bp, Artificial Sequence
  chemically synthesized
attttaacttccaaagaacaag

SEQ ID NO: 143840 - DNA, 22 bp, Artificial Sequence
  chemically synthesized
ttttaacttccaaagaacaagt

SEQ ID NO: 143841 - DNA, 22 bp, Artificial Sequence
  chemically synthesized
taacttccaaagaacaagtgca

SEQ ID NO: 143842 - DNA, 22 bp, Artificial Sequence
  chemically synthesized
aacttccaaagaacaagtgcaa

SEQ ID NO: 143843 - DNA, 22 bp, Artificial Sequence
  chemically synthesized
acttccaaagaacaagtgcaat

SEQ ID NO: 143844 - DNA, 22 bp, Artificial Sequence
  chemically synthesized
ccaaagaacaagtgcaatatgt

SEQ ID NO: 143845 - DNA, 22 bp, Artificial Sequence
  chemically synthesized
caaagaacaagtgcaatatgtg

SEQ ID NO: 143846 - DNA, 22 bp, Artificial Sequence
  chemically synthesized
tgttgcgcaggtcaacatgtat

SEQ ID NO: 143847 - DNA, 22 bp, Artificial Sequence
  chemically synthesized
gttgcgcaggtcaacatgtatc

SEQ ID NO: 143848 - DNA, 22 bp, Artificial Sequence
  chemically synthesized
ttgcgcaggtcaacatgtatct

SEQ ID NO: 143849 - DNA, 22 bp, Artificial Sequence
  chemically synthesized
cgcaggtcaacatgtatctttc

SEQ ID NO: 143850 - DNA, 22 bp, Artificial Sequence
  chemically synthesized
tctggtcttttagccgcctaac

SEQ ID NO: 143851 - DNA, 22 bp, Artificial Sequence
  chemically synthesized
ctggtcttttagccgcctaaca

SEQ ID NO: 143852 - DNA, 22 bp, Artificial Sequence
  chemically synthesized
tggtcttttagccgcctaacac

SEQ ID NO: 143853 - DNA, 22 bp, Artificial Sequence
  chemically synthesized
gtcttttagccgcctaacactt

SEQ ID NO: 143854 - DNA, 22 bp, Artificial Sequence
  chemically synthesized
ttagccgcctaacactttgagc

SEQ ID NO: 143855 - DNA, 22 bp, Artificial Sequence
  chemically synthesized
tagccgcctaacactttgagca

SEQ ID NO: 143856 - DNA, 22 bp, Artificial Sequence
  chemically synthesized
agccgcctaacactttgagcag

SEQ ID NO: 143857 - DNA, 22 bp, Artificial Sequence
  chemically synthesized
gccgcctaacactttgagcaga

SEQ ID NO: 143858 - DNA, 22 bp, Artificial Sequence
  chemically synthesized
acactttgagcagatataagcc

SEQ ID NO: 143859 - DNA, 22 bp, Artificial Sequence
  chemically synthesized
tgagcagatataagccttacac

SEQ ID NO: 143860 - DNA, 22 bp, Artificial Sequence
  chemically synthesized
gagcagatataagccttacaca

SEQ ID NO: 143861 - DNA, 22 bp, Artificial Sequence
  chemically synthesized
agcagatataagccttacacag

SEQ ID NO: 143862 - DNA, 22 bp, Artificial Sequence
  chemically synthesized
acacaggattatgaagtctgaa

SEQ ID NO: 143863 - DNA, 22 bp, Artificial Sequence
  chemically synthesized
cacaggattatgaagtctgaaa

SEQ ID NO: 143864 - DNA, 22 bp, Artificial Sequence
  chemically synthesized
tgaagtctgaaaggattccacc

SEQ ID NO: 143865 - DNA, 22 bp, Artificial Sequence
  chemically synthesized
aaaggattccaccaatattatt

SEQ ID NO: 143866 - DNA, 22 bp, Artificial Sequence
  chemically synthesized
caccaatattattataattcct

SEQ ID NO: 143867 - DNA, 22 bp, Artificial Sequence
  chemically synthesized
ttataattcctatcaacctgat

SEQ ID NO: 143868 - DNA, 22 bp, Artificial Sequence
  chemically synthesized
taattcctatcaacctgatagg

SEQ ID NO: 143869 - DNA, 22 bp, Artificial Sequence
  chemically synthesized
ctatcaacctgataggttaggg

SEQ ID NO: 143870 - DNA, 22 bp, Artificial Sequence
  chemically synthesized
tcaacctgataggttaggggaa

SEQ ID NO: 143871 - DNA, 22 bp, Artificial Sequence
  chemically synthesized
ataggttaggggaaggtagagc

SEQ ID NO: 143872 - DNA, 22 bp, Artificial Sequence
  chemically synthesized
ggggaaggtagagctctcctcc

SEQ ID NO: 143873 - DNA, 22 bp, Artificial Sequence
  chemically synthesized
tcctccaataagccagatttcc

SEQ ID NO: 143874 - DNA, 22 bp, Artificial Sequence
  chemically synthesized
ctccaataagccagatttccag

SEQ ID NO: 143875 - DNA, 22 bp, Artificial Sequence
  chemically synthesized
caataagccagatttccagagt

SEQ ID NO: 143876 - DNA, 22 bp, Artificial Sequence
  chemically synthesized
ccagagtttctgacgtcataat

SEQ ID NO: 143877 - DNA, 22 bp, Artificial Sequence
  chemically synthesized
cagagtttctgacgtcataatc

SEQ ID NO: 143878 - DNA, 22 bp, Artificial Sequence
  chemically synthesized
ctgacgtcataatctaccaagg

SEQ ID NO: 143879 - DNA, 22 bp, Artificial Sequence
  chemically synthesized
tgacgtcataatctaccaaggt

SEQ ID NO: 143880 - DNA, 22 bp, Artificial Sequence
  chemically synthesized
acgtcataatctaccaaggtca

SEQ ID NO: 143881 - DNA, 22 bp, Artificial Sequence
  chemically synthesized
ccaaggtcatggatcgagttca

SEQ ID NO: 143882 - DNA, 22 bp, Artificial Sequence
  chemically synthesized
agagaaaaaacaaaagcaaaac

SEQ ID NO: 143883 - DNA, 22 bp, Artificial Sequence
  chemically synthesized
ccaaaaaataaaaatcccaaag

SEQ ID NO: 143884 - DNA, 22 bp, Artificial Sequence
  chemically synthesized
cctgccatgttaagtggccaat

SEQ ID NO: 143885 - DNA, 22 bp, Artificial Sequence
  chemically synthesized
ctgccatgttaagtggccaata

SEQ ID NO: 143886 - DNA, 22 bp, Artificial Sequence
  chemically synthesized
ccatgttaagtggccaatatgt

SEQ ID NO: 143887 - DNA, 22 bp, Artificial Sequence
  chemically synthesized
agtggccaatatgtcagaaaca

SEQ ID NO: 143888 - DNA, 22 bp, Artificial Sequence
  chemically synthesized
agttacagataaagatgtctaa

SEQ ID NO: 143889 - DNA, 22 bp, Artificial Sequence
  chemically synthesized
cagataaagatgtctaaactac

SEQ ID NO: 143890 - DNA, 22 bp, Artificial Sequence
  chemically synthesized
aactacagtgacatcccagctg

SEQ ID NO: 143891 - DNA, 22 bp, Artificial Sequence
  chemically synthesized
cagtgacatcccagctgtcaca

SEQ ID NO: 143892 - DNA, 22 bp, Artificial Sequence
  chemically synthesized
tcacagtgtgtggactattagt

SEQ ID NO: 143893 - DNA, 22 bp, Artificial Sequence
  chemically synthesized
ttagtcaataaaacagtccctg

SEQ ID NO: 143894 - DNA, 22 bp, Artificial Sequence
  chemically synthesized
gtcaataaaacagtccctgcct

SEQ ID NO: 143895 - DNA, 22 bp, Artificial Sequence
  chemically synthesized
cctcttaagagttgttttccat

SEQ ID NO: 143896 - DNA, 22 bp, Artificial Sequence
  chemically synthesized
ttaagagttgttttccatgcaa

SEQ ID NO: 143897 - DNA, 22 bp, Artificial Sequence
  chemically synthesized
aagagttgttttccatgcaaat

SEQ ID NO: 143898 - DNA, 22 bp, Artificial Sequence
  chemically synthesized
agagttgttttccatgcaaata

SEQ ID NO: 143899 - DNA, 22 bp, Artificial Sequence
  chemically synthesized
ttttccatgcaaatacatgtct

SEQ ID NO: 143900 - DNA, 22 bp, Artificial Sequence
  chemically synthesized
tccatgcaaatacatgtcttat

SEQ ID NO: 143901 - DNA, 22 bp, Artificial Sequence
  chemically synthesized
ccatgcaaatacatgtcttatg

SEQ ID NO: 143902 - DNA, 22 bp, Artificial Sequence
  chemically synthesized
catgcaaatacatgtcttatgt

SEQ ID NO: 143903 - DNA, 22 bp, Artificial Sequence
  chemically synthesized
atgtcttagaataagattccct

SEQ ID NO: 143904 - DNA, 22 bp, Artificial Sequence
  chemically synthesized
tgtcttagaataagattcccta

SEQ ID NO: 143905 - DNA, 22 bp, Artificial Sequence
  chemically synthesized
agaataagattccctaagaagt

SEQ ID NO: 143906 - DNA, 22 bp, Artificial Sequence
  chemically synthesized
gaataagattccctaagaagtg

SEQ ID NO: 143907 - DNA, 22 bp, Artificial Sequence
  chemically synthesized
cctaagaagtgaacctagcatt

SEQ ID NO: 143908 - DNA, 22 bp, Artificial Sequence
  chemically synthesized
agaagtgaacctagcatttata

SEQ ID NO: 143909 - DNA, 22 bp, Artificial Sequence
  chemically synthesized
gcatttatacaagataattaat

SEQ ID NO: 143910 - DNA, 22 bp, Artificial Sequence
  chemically synthesized
atacaagataattaattctaat

SEQ ID NO: 143911 - DNA, 22 bp, Artificial Sequence
  chemically synthesized
tacaagataattaattctaatc

SEQ ID NO: 143912 - DNA, 22 bp, Artificial Sequence
  chemically synthesized
attctaatccatagtatctggt

SEQ ID NO: 143913 - DNA, 22 bp, Artificial Sequence
  chemically synthesized
taatccatagtatctggtaaag

SEQ ID NO: 143914 - DNA, 22 bp, Artificial Sequence
  chemically synthesized
atccatagtatctggtaaagag

SEQ ID NO: 143915 - DNA, 22 bp, Artificial Sequence
  chemically synthesized
gtaaagagcattctaccatcat

SEQ ID NO: 143916 - DNA, 22 bp, Artificial Sequence
  chemically synthesized
taccatcatctttaccgagcat

SEQ ID NO: 143917 - DNA, 22 bp, Artificial Sequence
  chemically synthesized
ccatcatctttaccgagcatag

SEQ ID NO: 143918 - DNA, 22 bp, Artificial Sequence
  chemically synthesized
taccgagcatagaagagctaca

SEQ ID NO: 143919 - DNA, 22 bp, Artificial Sequence
  chemically synthesized
accgagcatagaagagctacac

SEQ ID NO: 143920 - DNA, 22 bp, Artificial Sequence
  chemically synthesized
ccgagcatagaagagctacacc

SEQ ID NO: 143921 - DNA, 22 bp, Artificial Sequence
  chemically synthesized
caccaaaaccctgggtcatcag

SEQ ID NO: 143922 - DNA, 22 bp, Artificial Sequence
  chemically synthesized
ggtcatcagccagcacatacac

SEQ ID NO: 143923 - DNA, 22 bp, Artificial Sequence
  chemically synthesized
atccagtgataaatacacatca

SEQ ID NO: 143924 - DNA, 22 bp, Artificial Sequence
  chemically synthesized
tccagtgataaatacacatcat

SEQ ID NO: 143925 - DNA, 22 bp, Artificial Sequence
  chemically synthesized
catacatacctgaatataaaaa

SEQ ID NO: 143926 - DNA, 22 bp, Artificial Sequence
  chemically synthesized
aatataaaaaaaatacttttgc

SEQ ID NO: 143927 - DNA, 22 bp, Artificial Sequence
  chemically synthesized
ttgctgagatgaaacaggcgtg

SEQ ID NO: 143928 - DNA, 22 bp, Artificial Sequence
  chemically synthesized
tgctgagatgaaacaggcgtga

SEQ ID NO: 143929 - DNA, 22 bp, Artificial Sequence
  chemically synthesized
gctgagatgaaacaggcgtgat

SEQ ID NO: 143930 - DNA, 22 bp, Artificial Sequence
  chemically synthesized
ctgagatgaaacaggcgtgatt

SEQ ID NO: 143931 - DNA, 22 bp, Artificial Sequence
  chemically synthesized
agatgaaacaggcgtgatttat

SEQ ID NO: 143932 - DNA, 22 bp, Artificial Sequence
  chemically synthesized
atttcaaataggtacggataag

SEQ ID NO: 143933 - DNA, 22 bp, Artificial Sequence
  chemically synthesized
tttcaaataggtacggataagt

SEQ ID NO: 143934 - DNA, 22 bp, Artificial Sequence
  chemically synthesized
caaataggtacggataagtaga

SEQ ID NO: 143935 - DNA, 22 bp, Artificial Sequence
  chemically synthesized
aaataggtacggataagtagat

SEQ ID NO: 143936 - DNA, 22 bp, Artificial Sequence
  chemically synthesized
aagtaaggattcagtcttatat

SEQ ID NO: 143937 - DNA, 22 bp, Artificial Sequence
  chemically synthesized
agtcttatattatattacataa

SEQ ID NO: 143938 - DNA, 22 bp, Artificial Sequence
  chemically synthesized
atattatattacataacattaa

SEQ ID NO: 143939 - DNA, 22 bp, Artificial Sequence
  chemically synthesized
tattatattacataacattaat

SEQ ID NO: 143940 - DNA, 22 bp, Artificial Sequence
  chemically synthesized
tattacataacattaatctatt

SEQ ID NO: 143941 - DNA, 22 bp, Artificial Sequence
  chemically synthesized
cataacattaatctattcctgc

SEQ ID NO: 143942 - DNA, 22 bp, Artificial Sequence
  chemically synthesized
atctattcctgcactgaaactg

SEQ ID NO: 143943 - DNA, 22 bp, Artificial Sequence
  chemically synthesized
ttcctgcactgaaactgttgct

SEQ ID NO: 143944 - DNA, 22 bp, Artificial Sequence
  chemically synthesized
ctgcactgaaactgttgcttta

SEQ ID NO: 143945 - DNA, 22 bp, Artificial Sequence
  chemically synthesized
cactgaaactgttgctttatag

SEQ ID NO: 143946 - DNA, 22 bp, Artificial Sequence
  chemically synthesized
aaactgttgctttataggattt

SEQ ID NO: 143947 - DNA, 22 bp, Artificial Sequence
  chemically synthesized
ttgctttataggatttttcact

SEQ ID NO: 143948 - DNA, 22 bp, Artificial Sequence
  chemically synthesized
ctttataggatttttcactaca

SEQ ID NO: 143949 - DNA, 22 bp, Artificial Sequence
  chemically synthesized
tataggatttttcactacacta

SEQ ID NO: 143950 - DNA, 22 bp, Artificial Sequence
  chemically synthesized
ataggatttttcactacactaa

SEQ ID NO: 143951 - DNA, 22 bp, Artificial Sequence
  chemically synthesized
taggatttttcactacactaat

SEQ ID NO: 143952 - DNA, 22 bp, Artificial Sequence
  chemically synthesized
ttcactacactaatgagaactt

SEQ ID NO: 143953 - DNA, 22 bp, Artificial Sequence
  chemically synthesized
tcactacactaatgagaactta

SEQ ID NO: 143954 - DNA, 22 bp, Artificial Sequence
  chemically synthesized
cactacactaatgagaacttaa

SEQ ID NO: 143955 - DNA, 22 bp, Artificial Sequence
  chemically synthesized
actacactaatgagaacttaag

SEQ ID NO: 143956 - DNA, 22 bp, Artificial Sequence
  chemically synthesized
cactaatgagaacttaagagat

SEQ ID NO: 143957 - DNA, 22 bp, Artificial Sequence
  chemically synthesized
atgagaacttaagagataatgg

SEQ ID NO: 143958 - DNA, 22 bp, Artificial Sequence
  chemically synthesized
aagagataatggcctaaaacca

SEQ ID NO: 143959 - DNA, 22 bp, Artificial Sequence
  chemically synthesized
agagataatggcctaaaaccac

SEQ ID NO: 143960 - DNA, 22 bp, Artificial Sequence
  chemically synthesized
aaaccacagagagtatattcaa

SEQ ID NO: 143961 - DNA, 22 bp, Artificial Sequence
  chemically synthesized
aaagataagtatagcacttctt

SEQ ID NO: 143962 - DNA, 22 bp, Artificial Sequence
  chemically synthesized
cttatttggaaaccaatgctta

SEQ ID NO: 143963 - DNA, 22 bp, Artificial Sequence
  chemically synthesized
ttatttggaaaccaatgcttac

SEQ ID NO: 143964 - DNA, 22 bp, Artificial Sequence
  chemically synthesized
atttggaaaccaatgcttacta

SEQ ID NO: 143965 - DNA, 22 bp, Artificial Sequence
  chemically synthesized
tttggaaaccaatgcttactaa

SEQ ID NO: 143966 - DNA, 22 bp, Artificial Sequence
  chemically synthesized
ggaaaccaatgcttactaaatg

SEQ ID NO: 143967 - DNA, 22 bp, Artificial Sequence
  chemically synthesized
gaaaccaatgcttactaaatga

SEQ ID NO: 143968 - DNA, 22 bp, Artificial Sequence
  chemically synthesized
actaaatgagactaagacgtgt

SEQ ID NO: 143969 - DNA, 22 bp, Artificial Sequence
  chemically synthesized
ctaaatgagactaagacgtgtc

SEQ ID NO: 143970 - DNA, 22 bp, Artificial Sequence
  chemically synthesized
aatgagactaagacgtgtccca

SEQ ID NO: 143971 - DNA, 22 bp, Artificial Sequence
  chemically synthesized
agacgtgtcccatcaaaaatcc

SEQ ID NO: 143972 - DNA, 22 bp, Artificial Sequence
  chemically synthesized
gacctatgcctaaaacacattt

SEQ ID NO: 143973 - DNA, 22 bp, Artificial Sequence
  chemically synthesized
tgcctaaaacacatttcacaat

SEQ ID NO: 143974 - DNA, 22 bp, Artificial Sequence
  chemically synthesized
aaacacatttcacaatccctga

SEQ ID NO: 143975 - DNA, 22 bp, Artificial Sequence
  chemically synthesized
cacaatccctgaacttttcaaa

SEQ ID NO: 143976 - DNA, 22 bp, Artificial Sequence
  chemically synthesized
acaatccctgaacttttcaaaa

SEQ ID NO: 143977 - DNA, 22 bp, Artificial Sequence
  chemically synthesized
aacttttcaaaaattggtacat

SEQ ID NO: 143978 - DNA, 22 bp, Artificial Sequence
  chemically synthesized
ttcaaaaattggtacatgcttt

SEQ ID NO: 143979 - DNA, 22 bp, Artificial Sequence
  chemically synthesized
tcaaaaattggtacatgcttta

SEQ ID NO: 143980 - DNA, 22 bp, Artificial Sequence
  chemically synthesized
caaaaattggtacatgctttaa

SEQ ID NO: 143981 - DNA, 22 bp, Artificial Sequence
  chemically synthesized
aaaaattggtacatgctttaac

SEQ ID NO: 143982 - DNA, 22 bp, Artificial Sequence
  chemically synthesized
gtacatgctttaactttaaact

SEQ ID NO: 143983 - DNA, 22 bp, Artificial Sequence
  chemically synthesized
taactttaaactacaggcctca

SEQ ID NO: 143984 - DNA, 22 bp, Artificial Sequence
  chemically synthesized
aactttaaactacaggcctcac

SEQ ID NO: 143985 - DNA, 22 bp, Artificial Sequence
  chemically synthesized
actttaaactacaggcctcact

SEQ ID NO: 143986 - DNA, 22 bp, Artificial Sequence
  chemically synthesized
taaactacaggcctcactggag

SEQ ID NO: 143987 - DNA, 22 bp, Artificial Sequence
  chemically synthesized
aaactacaggcctcactggagc

SEQ ID NO: 143988 - DNA, 22 bp, Artificial Sequence
  chemically synthesized
aactacaggcctcactggagct

SEQ ID NO: 143989 - DNA, 22 bp, Artificial Sequence
  chemically synthesized
caggcctcactggagctacaga

SEQ ID NO: 143990 - DNA, 22 bp, Artificial Sequence
  chemically synthesized
actggagctacagacaagaagg

SEQ ID NO: 143991 - DNA, 22 bp, Artificial Sequence
  chemically synthesized
gagctacagacaagaaggtgaa

SEQ ID NO: 143992 - DNA, 22 bp, Artificial Sequence
  chemically synthesized
cagacaagaaggtgaaaaacgg

SEQ ID NO: 143993 - DNA, 22 bp, Artificial Sequence
  chemically synthesized
acaaaagaagtcctggtatctt

SEQ ID NO: 143994 - DNA, 22 bp, Artificial Sequence
  chemically synthesized
gtatcttctatggtgggagaag

SEQ ID NO: 143995 - DNA, 22 bp, Artificial Sequence
  chemically synthesized
ctatggtgggagaagaaaacta

SEQ ID NO: 143996 - DNA, 22 bp, Artificial Sequence
  chemically synthesized
tatggtgggagaagaaaactag

SEQ ID NO: 143997 - DNA, 22 bp, Artificial Sequence
  chemically synthesized
tggtgggagaagaaaactagct

SEQ ID NO: 143998 - DNA, 22 bp, Artificial Sequence
  chemically synthesized
gctaaagggaagaataaattag

SEQ ID NO: 143999 - DNA, 22 bp, Artificial Sequence
  chemically synthesized
aagggaagaataaattagagaa

SEQ ID NO: 144000 - DNA, 22 bp, Artificial Sequence
  chemically synthesized
gagaaaaattggaatgactgaa

SEQ ID NO: 144001 - DNA, 22 bp, Artificial Sequence
  chemically synthesized
gaatgactgaatcggaacaagg

SEQ ID NO: 144002 - DNA, 22 bp, Artificial Sequence
  chemically synthesized
aatcggaacaaggcaaaggcta

SEQ ID NO: 144003 - DNA, 22 bp, Artificial Sequence
  chemically synthesized
taaaaaaaattaagcagcagta

SEQ ID NO: 144004 - DNA, 22 bp, Artificial Sequence
  chemically synthesized
agcagcagtatcctcttggggg

SEQ ID NO: 144005 - DNA, 22 bp, Artificial Sequence
  chemically synthesized
ttgggggccccttccccacact

SEQ ID NO: 144006 - DNA, 22 bp, Artificial Sequence
  chemically synthesized
gggggccccttccccacactat

SEQ ID NO: 144007 - DNA, 22 bp, Artificial Sequence
  chemically synthesized
ggggccccttccccacactatc

SEQ ID NO: 144008 - DNA, 22 bp, Artificial Sequence
  chemically synthesized
ccccacactatctcaatgcaaa

SEQ ID NO: 144009 - DNA, 22 bp, Artificial Sequence
  chemically synthesized
cccacactatctcaatgcaaat

SEQ ID NO: 144010 - DNA, 22 bp, Artificial Sequence
  chemically synthesized
tctcaatgcaaatatctgtctg

SEQ ID NO: 144011 - DNA, 22 bp, Artificial Sequence
  chemically synthesized
aatgcaaatatctgtctgaaac

SEQ ID NO: 144012 - DNA, 22 bp, Artificial Sequence
  chemically synthesized
tctgaaacggtccctggctaaa

SEQ ID NO: 144013 - DNA, 22 bp, Artificial Sequence
  chemically synthesized
aaacggtccctggctaaactcc

SEQ ID NO: 144014 - DNA, 22 bp, Artificial Sequence
  chemically synthesized
gctaaactccacccatgggttg

SEQ ID NO: 144015 - DNA, 22 bp, Artificial Sequence
  chemically synthesized
aactccacccatgggttggcca

SEQ ID NO: 144016 - DNA, 22 bp, Artificial Sequence
  chemically synthesized
cacccatgggttggccagcctt

SEQ ID NO: 144017 - DNA, 22 bp, Artificial Sequence
  chemically synthesized
gccagccttgccttgaccaata

SEQ ID NO: 144018 - DNA, 22 bp, Artificial Sequence
  chemically synthesized
gccttgaccaatagccttgaca

SEQ ID NO: 144019 - DNA, 22 bp, Artificial Sequence
  chemically synthesized
ccttgaccaatagccttgacaa

SEQ ID NO: 144020 - DNA, 22 bp, Artificial Sequence
  chemically synthesized
gaccaatagccttgacaaggca

SEQ ID NO: 144021 - DNA, 22 bp, Artificial Sequence
  chemically synthesized
accaatagccttgacaaggcaa

SEQ ID NO: 144022 - DNA, 22 bp, Artificial Sequence
  chemically synthesized
gacaaggcaaacttgaccaata

SEQ ID NO: 144023 - DNA, 22 bp, Artificial Sequence
  chemically synthesized
acaaggcaaacttgaccaatag

SEQ ID NO: 144024 - DNA, 22 bp, Artificial Sequence
  chemically synthesized
gaccaatagtcttagagtatcc

SEQ ID NO: 144025 - DNA, 22 bp, Artificial Sequence
  chemically synthesized
accaatagtcttagagtatcca

SEQ ID NO: 144026 - DNA, 22 bp, Artificial Sequence
  chemically synthesized
agagtatccagtgaggccaggg

SEQ ID NO: 144027 - DNA, 22 bp, Artificial Sequence
  chemically synthesized
gagtatccagtgaggccagggg

SEQ ID NO: 144028 - DNA, 22 bp, Artificial Sequence
  chemically synthesized
gctagggatgaagaataaaagg

SEQ ID NO: 144029 - DNA, 22 bp, Artificial Sequence
  chemically synthesized
gggatgaagaataaaaggaagc

SEQ ID NO: 144030 - DNA, 22 bp, Artificial Sequence
  chemically synthesized
cagcagttccacacactcgctt

SEQ ID NO: 144031 - DNA, 22 bp, Artificial Sequence
  chemically synthesized
agcagttccacacactcgcttc

SEQ ID NO: 144032 - DNA, 22 bp, Artificial Sequence
  chemically synthesized
cacacactcgcttctggaacgt

SEQ ID NO: 144033 - DNA, 22 bp, Artificial Sequence
  chemically synthesized
gcttctggaacgtctgaggtta

SEQ ID NO: 144034 - DNA, 22 bp, Artificial Sequence
  chemically synthesized
ctggaacgtctgaggttatcaa

SEQ ID NO: 144035 - DNA, 22 bp, Artificial Sequence
  chemically synthesized
tggaacgtctgaggttatcaat

SEQ ID NO: 144036 - DNA, 22 bp, Artificial Sequence
  chemically synthesized
gaacgtctgaggttatcaataa

SEQ ID NO: 144037 - DNA, 22 bp, Artificial Sequence
  chemically synthesized
aggttatcaataagctcctagt

SEQ ID NO: 144038 - DNA, 22 bp, Artificial Sequence
  chemically synthesized
tcaataagctcctagtccagac

SEQ ID NO: 144039 - DNA, 22 bp, Artificial Sequence
  chemically synthesized
ctagtccagacgccatgggtca

SEQ ID NO: 144040 - DNA, 22 bp, Artificial Sequence
  chemically synthesized
gtccagacgccatgggtcattt

SEQ ID NO: 144041 - DNA, 22 bp, Artificial Sequence
  chemically synthesized
cacagaggaggacaaggctact

SEQ ID NO: 144042 - DNA, 22 bp, Artificial Sequence
  chemically synthesized
acagaggaggacaaggctacta

SEQ ID NO: 144043 - DNA, 22 bp, Artificial Sequence
  chemically synthesized
ctatcacaagcctgtggggcaa

SEQ ID NO: 144044 - DNA, 22 bp, Artificial Sequence
  chemically synthesized
tcacaagcctgtggggcaaggt

SEQ ID NO: 144045 - DNA, 22 bp, Artificial Sequence
  chemically synthesized
tggggcaaggtgaatgtggaag

SEQ ID NO: 144046 - DNA, 22 bp, Artificial Sequence
  chemically synthesized
gaggagaaaccctgggaaggta

SEQ ID NO: 144047 - DNA, 22 bp, Artificial Sequence
  chemically synthesized
ggaaggtaggctctggtgacca

SEQ ID NO: 144048 - DNA, 22 bp, Artificial Sequence
  chemically synthesized
tggtgaccaggacaagggaggg

SEQ ID NO: 144049 - DNA, 22 bp, Artificial Sequence
  chemically synthesized
gtgaccaggacaagggagggaa

SEQ ID NO: 144050 - DNA, 22 bp, Artificial Sequence
  chemically synthesized
tgcctggcaaaagtccaggtcg

SEQ ID NO: 144051 - DNA, 22 bp, Artificial Sequence
  chemically synthesized
gcaaaagtccaggtcgcttctc

SEQ ID NO: 144052 - DNA, 22 bp, Artificial Sequence
  chemically synthesized
ctcaggatttgtggcaccttct

SEQ ID NO: 144053 - DNA, 22 bp, Artificial Sequence
  chemically synthesized
tcaggatttgtggcaccttctg

SEQ ID NO: 144054 - DNA, 22 bp, Artificial Sequence
  chemically synthesized
aggatttgtggcaccttctgac

SEQ ID NO: 144055 - DNA, 22 bp, Artificial Sequence
  chemically synthesized
gtggcaccttctgactgtcaaa

SEQ ID NO: 144056 - DNA, 22 bp, Artificial Sequence
  chemically synthesized
tggcaccttctgactgtcaaac

SEQ ID NO: 144057 - DNA, 22 bp, Artificial Sequence
  chemically synthesized
ctgactgtcaaactgttcttgt

SEQ ID NO: 144058 - DNA, 22 bp, Artificial Sequence
  chemically synthesized
tgactgtcaaactgttcttgtc

SEQ ID NO: 144059 - DNA, 22 bp, Artificial Sequence
  chemically synthesized
actgtcaaactgttcttgtcaa

SEQ ID NO: 144060 - DNA, 22 bp, Artificial Sequence
  chemically synthesized
tcaaactgttcttgtcaatctc

SEQ ID NO: 144061 - DNA, 22 bp, Artificial Sequence
  chemically synthesized
ttcttgtcaatctcacaggctc

SEQ ID NO: 144062 - DNA, 22 bp, Artificial Sequence
  chemically synthesized
ttgtcaatctcacaggctcctg

SEQ ID NO: 144063 - DNA, 22 bp, Artificial Sequence
  chemically synthesized
gtcaatctcacaggctcctggt

SEQ ID NO: 144064 - DNA, 22 bp, Artificial Sequence
  chemically synthesized
tcaatctcacaggctcctggtt

SEQ ID NO: 144065 - DNA, 22 bp, Artificial Sequence
  chemically synthesized
acaggctcctggttgtctaccc

SEQ ID NO: 144066 - DNA, 22 bp, Artificial Sequence
  chemically synthesized
ctggttgtctacccatggaccc

SEQ ID NO: 144067 - DNA, 22 bp, Artificial Sequence
  chemically synthesized
gttgtctacccatggacccaga

SEQ ID NO: 144068 - DNA, 22 bp, Artificial Sequence
  chemically synthesized
tctacccatggacccagaggtt

SEQ ID NO: 144069 - DNA, 22 bp, Artificial Sequence
  chemically synthesized
cccatggacccagaggttcttt

SEQ ID NO: 144070 - DNA, 22 bp, Artificial Sequence
  chemically synthesized
tttgacagctttggcaacctgt

SEQ ID NO: 144071 - DNA, 22 bp, Artificial Sequence
  chemically synthesized
tgacagctttggcaacctgtcc

SEQ ID NO: 144072 - DNA, 22 bp, Artificial Sequence
  chemically synthesized
gacagctttggcaacctgtcct

SEQ ID NO: 144073 - DNA, 22 bp, Artificial Sequence
  chemically synthesized
acagctttggcaacctgtcctc

SEQ ID NO: 144074 - DNA, 22 bp, Artificial Sequence
  chemically synthesized
tggcaacctgtcctctgcctct

SEQ ID NO: 144075 - DNA, 22 bp, Artificial Sequence
  chemically synthesized
ggcaacctgtcctctgcctctg

SEQ ID NO: 144076 - DNA, 22 bp, Artificial Sequence
  chemically synthesized
gcaacctgtcctctgcctctgc

SEQ ID NO: 144077 - DNA, 22 bp, Artificial Sequence
  chemically synthesized
tcctctgcctctgccatcatgg

SEQ ID NO: 144078 - DNA, 22 bp, Artificial Sequence
  chemically synthesized
tgcctctgccatcatgggcaac

SEQ ID NO: 144079 - DNA, 22 bp, Artificial Sequence
  chemically synthesized
cctctgccatcatgggcaaccc

SEQ ID NO: 144080 - DNA, 22 bp, Artificial Sequence
  chemically synthesized
tgccatcatgggcaaccccaaa

SEQ ID NO: 144081 - DNA, 22 bp, Artificial Sequence
  chemically synthesized
ccatcatgggcaaccccaaagt

SEQ ID NO: 144082 - DNA, 22 bp, Artificial Sequence
  chemically synthesized
acttccttgggagatgccataa

SEQ ID NO: 144083 - DNA, 22 bp, Artificial Sequence
  chemically synthesized
ccttgggagatgccataaagca

SEQ ID NO: 144084 - DNA, 22 bp, Artificial Sequence
  chemically synthesized
cttgggagatgccataaagcac

SEQ ID NO: 144085 - DNA, 22 bp, Artificial Sequence
  chemically synthesized
gggagatgccataaagcacctg

SEQ ID NO: 144086 - DNA, 22 bp, Artificial Sequence
  chemically synthesized
ggagatgccataaagcacctgg

SEQ ID NO: 144087 - DNA, 22 bp, Artificial Sequence
  chemically synthesized
gatgatctcaagggcacctttg

SEQ ID NO: 144088 - DNA, 22 bp, Artificial Sequence
  chemically synthesized
aagggcacctttgcccagctga

SEQ ID NO: 144089 - DNA, 22 bp, Artificial Sequence
  chemically synthesized
tgcccagctgagtgaactgcac

SEQ ID NO: 144090 - DNA, 22 bp, Artificial Sequence
  chemically synthesized
gcccagctgagtgaactgcact

SEQ ID NO: 144091 - DNA, 22 bp, Artificial Sequence
  chemically synthesized
cccagctgagtgaactgcactg

SEQ ID NO: 144092 - DNA, 22 bp, Artificial Sequence
  chemically synthesized
agtgaactgcactgtgacaagc

SEQ ID NO: 144093 - DNA, 22 bp, Artificial Sequence
  chemically synthesized
cactgtgacaagctgcatgtgg

SEQ ID NO: 144094 - DNA, 22 bp, Artificial Sequence
  chemically synthesized
tgacaagctgcatgtggatcct

SEQ ID NO: 144095 - DNA, 22 bp, Artificial Sequence
  chemically synthesized
catgtggatcctgagaacttca

SEQ ID NO: 144096 - DNA, 22 bp, Artificial Sequence
  chemically synthesized
agaacttcaaggtgagtccagg

SEQ ID NO: 144097 - DNA, 22 bp, Artificial Sequence
  chemically synthesized
caaggtgagtccaggagatgtt

SEQ ID NO: 144098 - DNA, 22 bp, Artificial Sequence
  chemically synthesized
aaggtgagtccaggagatgttt

SEQ ID NO: 144099 - DNA, 22 bp, Artificial Sequence
  chemically synthesized
cagcactgttgcctttagtctc

SEQ ID NO: 144100 - DNA, 22 bp, Artificial Sequence
  chemically synthesized
agcactgttgcctttagtctcg

SEQ ID NO: 144101 - DNA, 22 bp, Artificial Sequence
  chemically synthesized
ttgcctttagtctcgaggcaac

SEQ ID NO: 144102 - DNA, 22 bp, Artificial Sequence
  chemically synthesized
cctttagtctcgaggcaactta

SEQ ID NO: 144103 - DNA, 22 bp, Artificial Sequence
  chemically synthesized
tagtctcgaggcaacttagaca

SEQ ID NO: 144104 - DNA, 22 bp, Artificial Sequence
  chemically synthesized
agtctcgaggcaacttagacaa

SEQ ID NO: 144105 - DNA, 22 bp, Artificial Sequence
  chemically synthesized
gtctcgaggcaacttagacaac

SEQ ID NO: 144106 - DNA, 22 bp, Artificial Sequence
  chemically synthesized
gaggcaacttagacaactgagt

SEQ ID NO: 144107 - DNA, 22 bp, Artificial Sequence
  chemically synthesized
agacaactgagtattgatctga

SEQ ID NO: 144108 - DNA, 22 bp, Artificial Sequence
  chemically synthesized
gacaactgagtattgatctgag

SEQ ID NO: 144109 - DNA, 22 bp, Artificial Sequence
  chemically synthesized
agtattgatctgagcacagcag

SEQ ID NO: 144110 - DNA, 22 bp, Artificial Sequence
  chemically synthesized
atctgagcacagcagggtgtga

SEQ ID NO: 144111 - DNA, 22 bp, Artificial Sequence
  chemically synthesized
agcacagcagggtgtgagctgt

SEQ ID NO: 144112 - DNA, 22 bp, Artificial Sequence
  chemically synthesized
tttgaagatactggggttggga

SEQ ID NO: 144113 - DNA, 22 bp, Artificial Sequence
  chemically synthesized
gaagatactggggttgggagtg

SEQ ID NO: 144114 - DNA, 22 bp, Artificial Sequence
  chemically synthesized
aagatactggggttgggagtga

SEQ ID NO: 144115 - DNA, 22 bp, Artificial Sequence
  chemically synthesized
gggttgggagtgaagaaactgc

SEQ ID NO: 144116 - DNA, 22 bp, Artificial Sequence
  chemically synthesized
ggagtgaagaaactgcagagga

SEQ ID NO: 144117 - DNA, 22 bp, Artificial Sequence
  chemically synthesized
cagaggactaactgggctgaga

SEQ ID NO: 144118 - DNA, 22 bp, Artificial Sequence
  chemically synthesized
actgggctgagacccagtggca

SEQ ID NO: 144119 - DNA, 22 bp, Artificial Sequence
  chemically synthesized
ggctgagacccagtggcaatgt

SEQ ID NO: 144120 - DNA, 22 bp, Artificial Sequence
  chemically synthesized
agacccagtggcaatgttttag

SEQ ID NO: 144121 - DNA, 22 bp, Artificial Sequence
  chemically synthesized
tagggcctaaggagtgcctctg

SEQ ID NO: 144122 - DNA, 22 bp, Artificial Sequence
  chemically synthesized
agggcctaaggagtgcctctga

SEQ ID NO: 144123 - DNA, 22 bp, Artificial Sequence
  chemically synthesized
gggcctaaggagtgcctctgaa

SEQ ID NO: 144124 - DNA, 22 bp, Artificial Sequence
  chemically synthesized
aggagtgcctctgaaaatctag

SEQ ID NO: 144125 - DNA, 22 bp, Artificial Sequence
  chemically synthesized
tgaaaatctagatggacaactt

SEQ ID NO: 144126 - DNA, 22 bp, Artificial Sequence
  chemically synthesized
aaaatctagatggacaactttg

SEQ ID NO: 144127 - DNA, 22 bp, Artificial Sequence
  chemically synthesized
gatggacaactttgactttgag

SEQ ID NO: 144128 - DNA, 22 bp, Artificial Sequence
  chemically synthesized
tgactttgagaaaagagaggtg

SEQ ID NO: 144129 - DNA, 22 bp, Artificial Sequence
  chemically synthesized
gactttgagaaaagagaggtgg

SEQ ID NO: 144130 - DNA, 22 bp, Artificial Sequence
  chemically synthesized
actttgagaaaagagaggtgga

SEQ ID NO: 144131 - DNA, 22 bp, Artificial Sequence
  chemically synthesized
tgagaaaagagaggtggaaatg

SEQ ID NO: 144132 - DNA, 22 bp, Artificial Sequence
  chemically synthesized
gagaaaagagaggtggaaatga

SEQ ID NO: 144133 - DNA, 22 bp, Artificial Sequence
  chemically synthesized
agaaaagagaggtggaaatgag

SEQ ID NO: 144134 - DNA, 22 bp, Artificial Sequence
  chemically synthesized
ttctttattagatttcggtaga

SEQ ID NO: 144135 - DNA, 22 bp, Artificial Sequence
  chemically synthesized
tctttattagatttcggtagaa

SEQ ID NO: 144136 - DNA, 22 bp, Artificial Sequence
  chemically synthesized
ctttattagatttcggtagaaa

SEQ ID NO: 144137 - DNA, 22 bp, Artificial Sequence
  chemically synthesized
tttattagatttcggtagaaag

SEQ ID NO: 144138 - DNA, 22 bp, Artificial Sequence
  chemically synthesized
tattagatttcggtagaaagaa

SEQ ID NO: 144139 - DNA, 22 bp, Artificial Sequence
  chemically synthesized
attagatttcggtagaaagaac

SEQ ID NO: 144140 - DNA, 22 bp, Artificial Sequence
  chemically synthesized
ttagatttcggtagaaagaact

SEQ ID NO: 144141 - DNA, 22 bp, Artificial Sequence
  chemically synthesized
gatttcggtagaaagaactttc

SEQ ID NO: 144142 - DNA, 22 bp, Artificial Sequence
  chemically synthesized
cggtagaaagaactttcacctt

SEQ ID NO: 144143 - DNA, 22 bp, Artificial Sequence
  chemically synthesized
ggtagaaagaactttcaccttt

SEQ ID NO: 144144 - DNA, 22 bp, Artificial Sequence
  chemically synthesized
tcacctttcccctatttttgtt

SEQ ID NO: 144145 - DNA, 22 bp, Artificial Sequence
  chemically synthesized
cacctttcccctatttttgtta

SEQ ID NO: 144146 - DNA, 22 bp, Artificial Sequence
  chemically synthesized
acctttcccctatttttgttat

SEQ ID NO: 144147 - DNA, 22 bp, Artificial Sequence
  chemically synthesized
tcccctatttttgttattcgtt

SEQ ID NO: 144148 - DNA, 22 bp, Artificial Sequence
  chemically synthesized
cccctatttttgttattcgttt

SEQ ID NO: 144149 - DNA, 22 bp, Artificial Sequence
  chemically synthesized
ccctatttttgttattcgtttt

SEQ ID NO: 144150 - DNA, 22 bp, Artificial Sequence
  chemically synthesized
tttttgttattcgttttaaaac

SEQ ID NO: 144151 - DNA, 22 bp, Artificial Sequence
  chemically synthesized
ttgttattcgttttaaaacatc

SEQ ID NO: 144152 - DNA, 22 bp, Artificial Sequence
  chemically synthesized
tgttattcgttttaaaacatct

SEQ ID NO: 144153 - DNA, 22 bp, Artificial Sequence
  chemically synthesized
gttattcgttttaaaacatcta

SEQ ID NO: 144154 - DNA, 22 bp, Artificial Sequence
  chemically synthesized
ttattcgttttaaaacatctat

SEQ ID NO: 144155 - DNA, 22 bp, Artificial Sequence
  chemically synthesized
ttcgttttaaaacatctatctg

SEQ ID NO: 144156 - DNA, 22 bp, Artificial Sequence
  chemically synthesized
gttttaaaacatctatctggag

SEQ ID NO: 144157 - DNA, 22 bp, Artificial Sequence
  chemically synthesized
taaaacatctatctggaggcag

SEQ ID NO: 144158 - DNA, 22 bp, Artificial Sequence
  chemically synthesized
aaaacatctatctggaggcagg

SEQ ID NO: 144159 - DNA, 22 bp, Artificial Sequence
  chemically synthesized
aaacatctatctggaggcagga

SEQ ID NO: 144160 - DNA, 22 bp, Artificial Sequence
  chemically synthesized
tctggaggcaggacaagtatgg

SEQ ID NO: 144161 - DNA, 22 bp, Artificial Sequence
  chemically synthesized
gaggcaggacaagtatggtcat

SEQ ID NO: 144162 - DNA, 22 bp, Artificial Sequence
  chemically synthesized
aaaagatgcaggcagaaggcat

SEQ ID NO: 144163 - DNA, 22 bp, Artificial Sequence
  chemically synthesized
gctcagtcaaagtggggaactt

SEQ ID NO: 144164 - DNA, 22 bp, Artificial Sequence
  chemically synthesized
agtcaaagtggggaactttggt

SEQ ID NO: 144165 - DNA, 22 bp, Artificial Sequence
  chemically synthesized
tggtggccaaacatacattgct

SEQ ID NO: 144166 - DNA, 22 bp, Artificial Sequence
  chemically synthesized
ggtggccaaacatacattgcta

SEQ ID NO: 144167 - DNA, 22 bp, Artificial Sequence
  chemically synthesized
gtggccaaacatacattgctaa

SEQ ID NO: 144168 - DNA, 22 bp, Artificial Sequence
  chemically synthesized
ctaaggctattcctatatcagc

SEQ ID NO: 144169 - DNA, 22 bp, Artificial Sequence
  chemically synthesized
aggctattcctatatcagctgg

SEQ ID NO: 144170 - DNA, 22 bp, Artificial Sequence
  chemically synthesized
ttcctatatcagctggacacat

SEQ ID NO: 144171 - DNA, 22 bp, Artificial Sequence
  chemically synthesized
ctatatcagctggacacatata

SEQ ID NO: 144172 - DNA, 22 bp, Artificial Sequence
  chemically synthesized
tatcagctggacacatataaaa

SEQ ID NO: 144173 - DNA, 22 bp, Artificial Sequence
  chemically synthesized
gacacatataaaatgctgctaa

SEQ ID NO: 144174 - DNA, 22 bp, Artificial Sequence
  chemically synthesized
ctaatgcttcattacaaactta

SEQ ID NO: 144175 - DNA, 22 bp, Artificial Sequence
  chemically synthesized
atgcttcattacaaacttatat

SEQ ID NO: 144176 - DNA, 22 bp, Artificial Sequence
  chemically synthesized
cattacaaacttatatccttta

SEQ ID NO: 144177 - DNA, 22 bp, Artificial Sequence
  chemically synthesized
attacaaacttatatcctttaa

SEQ ID NO: 144178 - DNA, 22 bp, Artificial Sequence
  chemically synthesized
caaacttatatcctttaattcc

SEQ ID NO: 144179 - DNA, 22 bp, Artificial Sequence
  chemically synthesized
atatcctttaattccagatggg

SEQ ID NO: 144180 - DNA, 22 bp, Artificial Sequence
  chemically synthesized
tatcctttaattccagatgggg

SEQ ID NO: 144181 - DNA, 22 bp, Artificial Sequence
  chemically synthesized
taattccagatgggggcaaagt

SEQ ID NO: 144182 - DNA, 22 bp, Artificial Sequence
  chemically synthesized
aattccagatgggggcaaagta

SEQ ID NO: 144183 - DNA, 22 bp, Artificial Sequence
  chemically synthesized
attccagatgggggcaaagtat

SEQ ID NO: 144184 - DNA, 22 bp, Artificial Sequence
  chemically synthesized
cagatgggggcaaagtatgtcc

SEQ ID NO: 144185 - DNA, 22 bp, Artificial Sequence
  chemically synthesized
aaacatttgggctggagtagat

SEQ ID NO: 144186 - DNA, 22 bp, Artificial Sequence
  chemically synthesized
gggctggagtagattttgaaag

SEQ ID NO: 144187 - DNA, 22 bp, Artificial Sequence
  chemically synthesized
ggctggagtagattttgaaagt

SEQ ID NO: 144188 - DNA, 22 bp, Artificial Sequence
  chemically synthesized
gagtagattttgaaagtcagct

SEQ ID NO: 144189 - DNA, 22 bp, Artificial Sequence
  chemically synthesized
tgaaagtcagctctgtgtgtgt

SEQ ID NO: 144190 - DNA, 22 bp, Artificial Sequence
  chemically synthesized
gaaagtcagctctgtgtgtgtg

SEQ ID NO: 144191 - DNA, 22 bp, Artificial Sequence
  chemically synthesized
aaagtcagctctgtgtgtgtgt

SEQ ID NO: 144192 - DNA, 22 bp, Artificial Sequence
  chemically synthesized
tgtgtgtgtgtgtgtgtgtgtg

SEQ ID NO: 144193 - DNA, 22 bp, Artificial Sequence
  chemically synthesized
tgtgtgtgtgtgtgtgtgtgcg

SEQ ID NO: 144194 - DNA, 22 bp, Artificial Sequence
  chemically synthesized
gtgtgtgtgtgagagcgtgtgt

SEQ ID NO: 144195 - DNA, 22 bp, Artificial Sequence
  chemically synthesized
tgtgtgtgtgagagcgtgtgtt

SEQ ID NO: 144196 - DNA, 22 bp, Artificial Sequence
  chemically synthesized
cttttaacgttttcagcctaca

SEQ ID NO: 144197 - DNA, 22 bp, Artificial Sequence
  chemically synthesized
ttttaacgttttcagcctacag

SEQ ID NO: 144198 - DNA, 22 bp, Artificial Sequence
  chemically synthesized
ttaacgttttcagcctacagca

SEQ ID NO: 144199 - DNA, 22 bp, Artificial Sequence
  chemically synthesized
taacgttttcagcctacagcat

SEQ ID NO: 144200 - DNA, 22 bp, Artificial Sequence
  chemically synthesized
aacgttttcagcctacagcata

SEQ ID NO: 144201 - DNA, 22 bp, Artificial Sequence
  chemically synthesized
acgttttcagcctacagcatac

SEQ ID NO: 144202 - DNA, 22 bp, Artificial Sequence
  chemically synthesized
tcagcctacagcatacagggtt

SEQ ID NO: 144203 - DNA, 22 bp, Artificial Sequence
  chemically synthesized
cagcctacagcatacagggttc

SEQ ID NO: 144204 - DNA, 22 bp, Artificial Sequence
  chemically synthesized
agcctacagcatacagggttca

SEQ ID NO: 144205 - DNA, 22 bp, Artificial Sequence
  chemically synthesized
cagcatacagggttcatggtgg

SEQ ID NO: 144206 - DNA, 22 bp, Artificial Sequence
  chemically synthesized
atggtggcaagaagataacaag

SEQ ID NO: 144207 - DNA, 22 bp, Artificial Sequence
  chemically synthesized
aaattatggccagtgactagtg

SEQ ID NO: 144208 - DNA, 22 bp, Artificial Sequence
  chemically synthesized
aattatggccagtgactagtgc

SEQ ID NO: 144209 - DNA, 22 bp, Artificial Sequence
  chemically synthesized
tggccagtgactagtgctgcaa

SEQ ID NO: 144210 - DNA, 22 bp, Artificial Sequence
  chemically synthesized
gtgctgcaagaagaacaactac

SEQ ID NO: 144211 - DNA, 22 bp, Artificial Sequence
  chemically synthesized
caagaagaacaactacctgcat

SEQ ID NO: 144212 - DNA, 22 bp, Artificial Sequence
  chemically synthesized
cctgcatttaatgggaaagcaa

SEQ ID NO: 144213 - DNA, 22 bp, Artificial Sequence
  chemically synthesized
catttaatgggaaagcaaaatc

SEQ ID NO: 144214 - DNA, 22 bp, Artificial Sequence
  chemically synthesized
aatgggaaagcaaaatctcagg

SEQ ID NO: 144215 - DNA, 22 bp, Artificial Sequence
  chemically synthesized
atgggaaagcaaaatctcaggc

SEQ ID NO: 144216 - DNA, 22 bp, Artificial Sequence
  chemically synthesized
aggctttgagggaagttaacat

SEQ ID NO: 144217 - DNA, 22 bp, Artificial Sequence
  chemically synthesized
tgagggaagttaacataggctt

SEQ ID NO: 144218 - DNA, 22 bp, Artificial Sequence
  chemically synthesized
gagggaagttaacataggcttg

SEQ ID NO: 144219 - DNA, 22 bp, Artificial Sequence
  chemically synthesized
agggaagttaacataggcttga

SEQ ID NO: 144220 - DNA, 22 bp, Artificial Sequence
  chemically synthesized
acataggcttgattctgggtgg

SEQ ID NO: 144221 - DNA, 22 bp, Artificial Sequence
  chemically synthesized
gattctgggtggaagcttggtg

SEQ ID NO: 144222 - DNA, 22 bp, Artificial Sequence
  chemically synthesized
attctgggtggaagcttggtgt

SEQ ID NO: 144223 - DNA, 22 bp, Artificial Sequence
  chemically synthesized
tgggtggaagcttggtgtgtag

SEQ ID NO: 144224 - DNA, 22 bp, Artificial Sequence
  chemically synthesized
ggtggaagcttggtgtgtagtt

SEQ ID NO: 144225 - DNA, 22 bp, Artificial Sequence
  chemically synthesized
ggtgtgtagttatctggaggcc

SEQ ID NO: 144226 - DNA, 22 bp, Artificial Sequence
  chemically synthesized
gtgtgtagttatctggaggcca

SEQ ID NO: 144227 - DNA, 22 bp, Artificial Sequence
  chemically synthesized
tctggaggccaggctggagctc

SEQ ID NO: 144228 - DNA, 22 bp, Artificial Sequence
  chemically synthesized
gaggccaggctggagctctcag

SEQ ID NO: 144229 - DNA, 22 bp, Artificial Sequence
  chemically synthesized
gagctctcagctcactatgggt

SEQ ID NO: 144230 - DNA, 22 bp, Artificial Sequence
  chemically synthesized
tcagctcactatgggttcatct

SEQ ID NO: 144231 - DNA, 22 bp, Artificial Sequence
  chemically synthesized
agctcactatgggttcatcttt

SEQ ID NO: 144232 - DNA, 22 bp, Artificial Sequence
  chemically synthesized
actatgggttcatctttattgt

SEQ ID NO: 144233 - DNA, 22 bp, Artificial Sequence
  chemically synthesized
tgggttcatctttattgtctcc

SEQ ID NO: 144234 - DNA, 22 bp, Artificial Sequence
  chemically synthesized
atctttattgtctcctttcatc

SEQ ID NO: 144235 - DNA, 22 bp, Artificial Sequence
  chemically synthesized
tattgtctcctttcatctcaac

SEQ ID NO: 144236 - DNA, 22 bp, Artificial Sequence
  chemically synthesized
attgtctcctttcatctcaaca

SEQ ID NO: 144237 - DNA, 22 bp, Artificial Sequence
  chemically synthesized
ttgtctcctttcatctcaacag

SEQ ID NO: 144238 - DNA, 22 bp, Artificial Sequence
  chemically synthesized
tctcctttcatctcaacagctc

SEQ ID NO: 144239 - DNA, 22 bp, Artificial Sequence
  chemically synthesized
ctttcatctcaacagctcctgg

SEQ ID NO: 144240 - DNA, 22 bp, Artificial Sequence
  chemically synthesized
tcatctcaacagctcctgggaa

SEQ ID NO: 144241 - DNA, 22 bp, Artificial Sequence
  chemically synthesized
catctcaacagctcctgggaaa

SEQ ID NO: 144242 - DNA, 22 bp, Artificial Sequence
  chemically synthesized
atctcaacagctcctgggaaat

SEQ ID NO: 144243 - DNA, 22 bp, Artificial Sequence
  chemically synthesized
aacagctcctgggaaatgtgct

SEQ ID NO: 144244 - DNA, 22 bp, Artificial Sequence
  chemically synthesized
ctgggaaatgtgctggtgaccg

SEQ ID NO: 144245 - DNA, 22 bp, Artificial Sequence
  chemically synthesized
ggaaatgtgctggtgaccgttt

SEQ ID NO: 144246 - DNA, 22 bp, Artificial Sequence
  chemically synthesized
gtgaccgttttggcaatccatt

SEQ ID NO: 144247 - DNA, 22 bp, Artificial Sequence
  chemically synthesized
tggcaatccatttcggcaaaga

SEQ ID NO: 144248 - DNA, 22 bp, Artificial Sequence
  chemically synthesized
ggcaatccatttcggcaaagaa

SEQ ID NO: 144249 - DNA, 22 bp, Artificial Sequence
  chemically synthesized
gcaatccatttcggcaaagaat

SEQ ID NO: 144250 - DNA, 22 bp, Artificial Sequence
  chemically synthesized
cggcaaagaattcacccctgag

SEQ ID NO: 144251 - DNA, 22 bp, Artificial Sequence
  chemically synthesized
ggcaaagaattcacccctgagg

SEQ ID NO: 144252 - DNA, 22 bp, Artificial Sequence
  chemically synthesized
acccctgaggtgcaggcttcct

SEQ ID NO: 144253 - DNA, 22 bp, Artificial Sequence
  chemically synthesized
aggtgcaggcttcctggcagaa

SEQ ID NO: 144254 - DNA, 22 bp, Artificial Sequence
  chemically synthesized
cctggcagaagatggtgactgg

SEQ ID NO: 144255 - DNA, 22 bp, Artificial Sequence
  chemically synthesized
ctggcagaagatggtgactgga

SEQ ID NO: 144256 - DNA, 22 bp, Artificial Sequence
  chemically synthesized
gcagaagatggtgactggagtg

SEQ ID NO: 144257 - DNA, 22 bp, Artificial Sequence
  chemically synthesized
gagtggccagtgccctgtcctc

SEQ ID NO: 144258 - DNA, 22 bp, Artificial Sequence
  chemically synthesized
tcctccagataccactgagctc

SEQ ID NO: 144259 - DNA, 22 bp, Artificial Sequence
  chemically synthesized
cagataccactgagctcactgc

SEQ ID NO: 144260 - DNA, 22 bp, Artificial Sequence
  chemically synthesized
agctcactgcccatgatgcaga

SEQ ID NO: 144261 - DNA, 22 bp, Artificial Sequence
  chemically synthesized
actgcccatgatgcagagcttt

SEQ ID NO: 144262 - DNA, 22 bp, Artificial Sequence
  chemically synthesized
cccatgatgcagagctttcaag

SEQ ID NO: 144263 - DNA, 22 bp, Artificial Sequence
  chemically synthesized
tcaaggataggctttattctgc

SEQ ID NO: 144264 - DNA, 22 bp, Artificial Sequence
  chemically synthesized
caaggataggctttattctgca

SEQ ID NO: 144265 - DNA, 22 bp, Artificial Sequence
  chemically synthesized
aaggataggctttattctgcaa

SEQ ID NO: 144266 - DNA, 22 bp, Artificial Sequence
  chemically synthesized
tattctgcaagcaatcaaataa

SEQ ID NO: 144267 - DNA, 22 bp, Artificial Sequence
  chemically synthesized
attctgcaagcaatcaaataat

SEQ ID NO: 144268 - DNA, 22 bp, Artificial Sequence
  chemically synthesized
ttctgcaagcaatcaaataata

SEQ ID NO: 144269 - DNA, 22 bp, Artificial Sequence
  chemically synthesized
tgcaagcaatcaaataataaat

SEQ ID NO: 144270 - DNA, 22 bp, Artificial Sequence
  chemically synthesized
caagcaatcaaataataaatct

SEQ ID NO: 144271 - DNA, 22 bp, Artificial Sequence
  chemically synthesized
ttctgctaagagatcacacatg

SEQ ID NO: 144272 - DNA, 22 bp, Artificial Sequence
  chemically synthesized
tgctaagagatcacacatggtt

SEQ ID NO: 144273 - DNA, 22 bp, Artificial Sequence
  chemically synthesized
ctaagagatcacacatggttgt

SEQ ID NO: 144274 - DNA, 22 bp, Artificial Sequence
  chemically synthesized
agagatcacacatggttgtctt

SEQ ID NO: 144275 - DNA, 22 bp, Artificial Sequence
  chemically synthesized
tcttcagttctttttttatgtc

SEQ ID NO: 144276 - DNA, 22 bp, Artificial Sequence
  chemically synthesized
cagttctttttttatgtctttt

SEQ ID NO: 144277 - DNA, 22 bp, Artificial Sequence
  chemically synthesized
agttctttttttatgtcttttt

SEQ ID NO: 144278 - DNA, 22 bp, Artificial Sequence
  chemically synthesized
tttttttatgtctttttaaata

SEQ ID NO: 144279 - DNA, 22 bp, Artificial Sequence
  chemically synthesized
tttttatgtctttttaaatata

SEQ ID NO: 144280 - DNA, 22 bp, Artificial Sequence
  chemically synthesized
ttttatgtctttttaaatatat

SEQ ID NO: 144281 - DNA, 22 bp, Artificial Sequence
  chemically synthesized
tttatgtctttttaaatatatg

SEQ ID NO: 144282 - DNA, 22 bp, Artificial Sequence
  chemically synthesized
ttatgtctttttaaatatatga

SEQ ID NO: 144283 - DNA, 22 bp, Artificial Sequence
  chemically synthesized
tatgtctttttaaatatatgag

SEQ ID NO: 144284 - DNA, 22 bp, Artificial Sequence
  chemically synthesized
atgtctttttaaatatatgagc

SEQ ID NO: 144285 - DNA, 22 bp, Artificial Sequence
  chemically synthesized
tgtctttttaaatatatgagcc

SEQ ID NO: 144286 - DNA, 22 bp, Artificial Sequence
  chemically synthesized
tttaaatatatgagccacaaag

SEQ ID NO: 144287 - DNA, 22 bp, Artificial Sequence
  chemically synthesized
ttaaatatatgagccacaaagg

SEQ ID NO: 144288 - DNA, 22 bp, Artificial Sequence
  chemically synthesized
taaatatatgagccacaaaggg

SEQ ID NO: 144289 - DNA, 22 bp, Artificial Sequence
  chemically synthesized
aaatatatgagccacaaagggt

SEQ ID NO: 144290 - DNA, 22 bp, Artificial Sequence
  chemically synthesized
aatatatgagccacaaagggtt

SEQ ID NO: 144291 - DNA, 22 bp, Artificial Sequence
  chemically synthesized
tatgttgagggatgtgtttatg

SEQ ID NO: 144292 - DNA, 22 bp, Artificial Sequence
  chemically synthesized
atgttgagggatgtgtttatgt

SEQ ID NO: 144293 - DNA, 22 bp, Artificial Sequence
  chemically synthesized
tgttgagggatgtgtttatgtg

SEQ ID NO: 144294 - DNA, 22 bp, Artificial Sequence
  chemically synthesized
agggatgtgtttatgtgtattt

SEQ ID NO: 144295 - DNA, 22 bp, Artificial Sequence
  chemically synthesized
atgtgtatttatacatggctat

SEQ ID NO: 144296 - DNA, 22 bp, Artificial Sequence
  chemically synthesized
tgtgtatttatacatggctatg

SEQ ID NO: 144297 - DNA, 22 bp, Artificial Sequence
  chemically synthesized
atacatggctatgtgtgtttgt

SEQ ID NO: 144298 - DNA, 22 bp, Artificial Sequence
  chemically synthesized
tacatggctatgtgtgtttgtg

SEQ ID NO: 144299 - DNA, 22 bp, Artificial Sequence
  chemically synthesized
tgtgtgtttgtgtcatgtgcac

SEQ ID NO: 144300 - DNA, 22 bp, Artificial Sequence
  chemically synthesized
gtgtcatgtgcacactccacac

SEQ ID NO: 144301 - DNA, 22 bp, Artificial Sequence
  chemically synthesized
tgtcatgtgcacactccacact

SEQ ID NO: 144302 - DNA, 22 bp, Artificial Sequence
  chemically synthesized
cacacttttttgtttacgttag

SEQ ID NO: 144303 - DNA, 22 bp, Artificial Sequence
  chemically synthesized
ttttgtttacgttagatgtggg

SEQ ID NO: 144304 - DNA, 22 bp, Artificial Sequence
  chemically synthesized
tttgtttacgttagatgtgggt

SEQ ID NO: 144305 - DNA, 22 bp, Artificial Sequence
  chemically synthesized
ttgtttacgttagatgtgggtt

SEQ ID NO: 144306 - DNA, 22 bp, Artificial Sequence
  chemically synthesized
tgtttacgttagatgtgggttt

SEQ ID NO: 144307 - DNA, 22 bp, Artificial Sequence
  chemically synthesized
gtttacgttagatgtgggtttt

SEQ ID NO: 144308 - DNA, 22 bp, Artificial Sequence
  chemically synthesized
tttacgttagatgtgggttttg

SEQ ID NO: 144309 - DNA, 22 bp, Artificial Sequence
  chemically synthesized
acgttagatgtgggttttgatg

SEQ ID NO: 144310 - DNA, 22 bp, Artificial Sequence
  chemically synthesized
cgttagatgtgggttttgatga

SEQ ID NO: 144311 - DNA, 22 bp, Artificial Sequence
  chemically synthesized
gatgtgggttttgatgagcaaa

SEQ ID NO: 144312 - DNA, 22 bp, Artificial Sequence
  chemically synthesized
tgatgagcaaataaaagaacta

SEQ ID NO: 144313 - DNA, 22 bp, Artificial Sequence
  chemically synthesized
gatgagcaaataaaagaactag

SEQ ID NO: 144314 - DNA, 22 bp, Artificial Sequence
  chemically synthesized
atgagcaaataaaagaactagg

SEQ ID NO: 144315 - DNA, 22 bp, Artificial Sequence
  chemically synthesized
ggcaataaagaaacttgtacat

SEQ ID NO: 144316 - DNA, 22 bp, Artificial Sequence
  chemically synthesized
gtacatgggagttctgcaagtg

SEQ ID NO: 144317 - DNA, 22 bp, Artificial Sequence
  chemically synthesized
tacatgggagttctgcaagtgg

SEQ ID NO: 144318 - DNA, 22 bp, Artificial Sequence
  chemically synthesized
tgcaagtgggagtaaaaggtgc

SEQ ID NO: 144319 - DNA, 22 bp, Artificial Sequence
  chemically synthesized
caagtgggagtaaaaggtgcag

SEQ ID NO: 144320 - DNA, 22 bp, Artificial Sequence
  chemically synthesized
gttggaagaaagacctctatag

SEQ ID NO: 144321 - DNA, 22 bp, Artificial Sequence
  chemically synthesized
gaagaaagacctctataggaca

SEQ ID NO: 144322 - DNA, 22 bp, Artificial Sequence
  chemically synthesized
tataggacaggactcctcagaa

SEQ ID NO: 144323 - DNA, 22 bp, Artificial Sequence
  chemically synthesized
taggacaggactcctcagaaac

SEQ ID NO: 144324 - DNA, 22 bp, Artificial Sequence
  chemically synthesized
ctcagaaacagatgttttggaa

SEQ ID NO: 144325 - DNA, 22 bp, Artificial Sequence
  chemically synthesized
agaaacagatgttttggaagag

SEQ ID NO: 144326 - DNA, 22 bp, Artificial Sequence
  chemically synthesized
tggaagagatggggaaaggttc

SEQ ID NO: 144327 - DNA, 22 bp, Artificial Sequence
  chemically synthesized
ggaagagatggggaaaggttca

SEQ ID NO: 144328 - DNA, 22 bp, Artificial Sequence
  chemically synthesized
gaagagatggggaaaggttcag

SEQ ID NO: 144329 - DNA, 22 bp, Artificial Sequence
  chemically synthesized
agtgaagggggctgaaccccct

SEQ ID NO: 144330 - DNA, 22 bp, Artificial Sequence
  chemically synthesized
aacccccttccctggattgcag

SEQ ID NO: 144331 - DNA, 22 bp, Artificial Sequence
  chemically synthesized
ccctggattgcagcacagcagc

SEQ ID NO: 144332 - DNA, 22 bp, Artificial Sequence
  chemically synthesized
cctggattgcagcacagcagcg

SEQ ID NO: 144333 - DNA, 22 bp, Artificial Sequence
  chemically synthesized
gattgcagcacagcagcgagga

SEQ ID NO: 144334 - DNA, 22 bp, Artificial Sequence
  chemically synthesized
cagcacagcagcgaggaagggg

SEQ ID NO: 144335 - DNA, 22 bp, Artificial Sequence
  chemically synthesized
aacgaagaaaaagtgttccaag

SEQ ID NO: 144336 - DNA, 22 bp, Artificial Sequence
  chemically synthesized
caagctttaggaagtcaaggtt

SEQ ID NO: 144337 - DNA, 22 bp, Artificial Sequence
  chemically synthesized
taggaagtcaaggtttaggcag

SEQ ID NO: 144338 - DNA, 22 bp, Artificial Sequence
  chemically synthesized
aggaagtcaaggtttaggcagg

SEQ ID NO: 144339 - DNA, 22 bp, Artificial Sequence
  chemically synthesized
ggaagtcaaggtttaggcaggg

SEQ ID NO: 144340 - DNA, 22 bp, Artificial Sequence
  chemically synthesized
aggcagggatagccattctatt

SEQ ID NO: 144341 - DNA, 22 bp, Artificial Sequence
  chemically synthesized
ggcagggatagccattctattt

SEQ ID NO: 144342 - DNA, 22 bp, Artificial Sequence
  chemically synthesized
tattttattaggggcaatacta

SEQ ID NO: 144343 - DNA, 22 bp, Artificial Sequence
  chemically synthesized
ttttattaggggcaatactatt

SEQ ID NO: 144344 - DNA, 22 bp, Artificial Sequence
  chemically synthesized
tattaggggcaatactatttcc

SEQ ID NO: 144345 - DNA, 22 bp, Artificial Sequence
  chemically synthesized
attaggggcaatactatttcca

SEQ ID NO: 144346 - DNA, 22 bp, Artificial Sequence
  chemically synthesized
ttaggggcaatactatttccaa

SEQ ID NO: 144347 - DNA, 22 bp, Artificial Sequence
  chemically synthesized
ggggcaatactatttccaacgg

SEQ ID NO: 144348 - DNA, 22 bp, Artificial Sequence
  chemically synthesized
tttccaacggcatctggctttt

SEQ ID NO: 144349 - DNA, 22 bp, Artificial Sequence
  chemically synthesized
ccaacggcatctggcttttctc

SEQ ID NO: 144350 - DNA, 22 bp, Artificial Sequence
  chemically synthesized
caacggcatctggcttttctca

SEQ ID NO: 144351 - DNA, 22 bp, Artificial Sequence
  chemically synthesized
gcttttctcagcccttgtgagg

SEQ ID NO: 144352 - DNA, 22 bp, Artificial Sequence
  chemically synthesized
ttctcagcccttgtgaggctct

SEQ ID NO: 144353 - DNA, 22 bp, Artificial Sequence
  chemically synthesized
tctcagcccttgtgaggctcta

SEQ ID NO: 144354 - DNA, 22 bp, Artificial Sequence
  chemically synthesized
ctcagcccttgtgaggctctac

SEQ ID NO: 144355 - DNA, 22 bp, Artificial Sequence
  chemically synthesized
tcagcccttgtgaggctctaca

SEQ ID NO: 144356 - DNA, 22 bp, Artificial Sequence
  chemically synthesized
agcccttgtgaggctctacagg

SEQ ID NO: 144357 - DNA, 22 bp, Artificial Sequence
  chemically synthesized
gtgaggctctacagggaggttg

SEQ ID NO: 144358 - DNA, 22 bp, Artificial Sequence
  chemically synthesized
tgaggctctacagggaggttga

SEQ ID NO: 144359 - DNA, 22 bp, Artificial Sequence
  chemically synthesized
tacagggaggttgaggtgttag

SEQ ID NO: 144360 - DNA, 22 bp, Artificial Sequence
  chemically synthesized
cagggaggttgaggtgttagag

SEQ ID NO: 144361 - DNA, 22 bp, Artificial Sequence
  chemically synthesized
aggtgttagagatcagagcagg

SEQ ID NO: 144362 - DNA, 22 bp, Artificial Sequence
  chemically synthesized
gagatcagagcaggaaacaggt

SEQ ID NO: 144363 - DNA, 22 bp, Artificial Sequence
  chemically synthesized
ttctttccacggtaactacaat

SEQ ID NO: 144364 - DNA, 22 bp, Artificial Sequence
  chemically synthesized
tctttccacggtaactacaatg

SEQ ID NO: 144365 - DNA, 22 bp, Artificial Sequence
  chemically synthesized
ctttccacggtaactacaatga

SEQ ID NO: 144366 - DNA, 22 bp, Artificial Sequence
  chemically synthesized
tttccacggtaactacaatgaa

SEQ ID NO: 144367 - DNA, 22 bp, Artificial Sequence
  chemically synthesized
tccacggtaactacaatgaagt

SEQ ID NO: 144368 - DNA, 22 bp, Artificial Sequence
  chemically synthesized
ccacggtaactacaatgaagtg

SEQ ID NO: 144369 - DNA, 22 bp, Artificial Sequence
  chemically synthesized
cacggtaactacaatgaagtga

SEQ ID NO: 144370 - DNA, 22 bp, Artificial Sequence
  chemically synthesized
caatgaagtgatccttacttta

SEQ ID NO: 144371 - DNA, 22 bp, Artificial Sequence
  chemically synthesized
actttactaaggaacttttcat

SEQ ID NO: 144372 - DNA, 22 bp, Artificial Sequence
  chemically synthesized
ctttactaaggaacttttcatt

SEQ ID NO: 144373 - DNA, 22 bp, Artificial Sequence
  chemically synthesized
tactaaggaacttttcatttta

SEQ ID NO: 144374 - DNA, 22 bp, Artificial Sequence
  chemically synthesized
actaaggaacttttcattttaa

SEQ ID NO: 144375 - DNA, 22 bp, Artificial Sequence
  chemically synthesized
ctaaggaacttttcattttaag

SEQ ID NO: 144376 - DNA, 22 bp, Artificial Sequence
  chemically synthesized
aggaacttttcattttaagtgt

SEQ ID NO: 144377 - DNA, 22 bp, Artificial Sequence
  chemically synthesized
ttcattttaagtgttgacgcat

SEQ ID NO: 144378 - DNA, 22 bp, Artificial Sequence
  chemically synthesized
tcattttaagtgttgacgcatg

SEQ ID NO: 144379 - DNA, 22 bp, Artificial Sequence
  chemically synthesized
cattttaagtgttgacgcatgc

SEQ ID NO: 144380 - DNA, 22 bp, Artificial Sequence
  chemically synthesized
attttaagtgttgacgcatgcc

SEQ ID NO: 144381 - DNA, 22 bp, Artificial Sequence
  chemically synthesized
taagtgttgacgcatgcctaaa

SEQ ID NO: 144382 - DNA, 22 bp, Artificial Sequence
  chemically synthesized
aagtgttgacgcatgcctaaag

SEQ ID NO: 144383 - DNA, 22 bp, Artificial Sequence
  chemically synthesized
agtgttgacgcatgcctaaaga

SEQ ID NO: 144384 - DNA, 22 bp, Artificial Sequence
  chemically synthesized
acgcatgcctaaagaggtgaaa

SEQ ID NO: 144385 - DNA, 22 bp, Artificial Sequence
  chemically synthesized
aagaggtgaaattaatcccata

SEQ ID NO: 144386 - DNA, 22 bp, Artificial Sequence
  chemically synthesized
atcccatacccttaagtctaca

SEQ ID NO: 144387 - DNA, 22 bp, Artificial Sequence
  chemically synthesized
aagtctacagactggtcacagc

SEQ ID NO: 144388 - DNA, 22 bp, Artificial Sequence
  chemically synthesized
agtctacagactggtcacagca

SEQ ID NO: 144389 - DNA, 22 bp, Artificial Sequence
  chemically synthesized
cagactggtcacagcatttcaa

SEQ ID NO: 144390 - DNA, 22 bp, Artificial Sequence
  chemically synthesized
gtcacagcatttcaaggaggag

SEQ ID NO: 144391 - DNA, 22 bp, Artificial Sequence
  chemically synthesized
caaggaggagacctcattgtaa

SEQ ID NO: 144392 - DNA, 22 bp, Artificial Sequence
  chemically synthesized
aaggaggagacctcattgtaag

SEQ ID NO: 144393 - DNA, 22 bp, Artificial Sequence
  chemically synthesized
attgtaagcttctagggaggtg

SEQ ID NO: 144394 - DNA, 22 bp, Artificial Sequence
  chemically synthesized
taagcttctagggaggtgggga

SEQ ID NO: 144395 - DNA, 22 bp, Artificial Sequence
  chemically synthesized
ctagggaggtggggacttaggt

SEQ ID NO: 144396 - DNA, 22 bp, Artificial Sequence
  chemically synthesized
tagggaggtggggacttaggtg

SEQ ID NO: 144397 - DNA, 22 bp, Artificial Sequence
  chemically synthesized
gggaggtggggacttaggtgaa

SEQ ID NO: 144398 - DNA, 22 bp, Artificial Sequence
  chemically synthesized
aggtgaaggaaatgagccagca

SEQ ID NO: 144399 - DNA, 22 bp, Artificial Sequence
  chemically synthesized
ggtgaaggaaatgagccagcag

SEQ ID NO: 144400 - DNA, 22 bp, Artificial Sequence
  chemically synthesized
acaagtcagcatcagcgtgtca

SEQ ID NO: 144401 - DNA, 22 bp, Artificial Sequence
  chemically synthesized
agcagcagaacagcacggtcag

SEQ ID NO: 144402 - DNA, 22 bp, Artificial Sequence
  chemically synthesized
gtataacattaattgagaaggc

SEQ ID NO: 144403 - DNA, 22 bp, Artificial Sequence
  chemically synthesized
tataacattaattgagaaggca

SEQ ID NO: 144404 - DNA, 22 bp, Artificial Sequence
  chemically synthesized
attgagaaggcagattcactgg

SEQ ID NO: 144405 - DNA, 22 bp, Artificial Sequence
  chemically synthesized
agaaggcagattcactggagtt

SEQ ID NO: 144406 - DNA, 22 bp, Artificial Sequence
  chemically synthesized
actggagttcttatataattga

SEQ ID NO: 144407 - DNA, 22 bp, Artificial Sequence
  chemically synthesized
gagttcttatataattgaaagt

SEQ ID NO: 144408 - DNA, 22 bp, Artificial Sequence
  chemically synthesized
ttatataattgaaagttaatgc

SEQ ID NO: 144409 - DNA, 22 bp, Artificial Sequence
  chemically synthesized
atataattgaaagttaatgcac

SEQ ID NO: 144410 - DNA, 22 bp, Artificial Sequence
  chemically synthesized
tataattgaaagttaatgcacg

SEQ ID NO: 144411 - DNA, 22 bp, Artificial Sequence
  chemically synthesized
aaagttaatgcacgttaataag

SEQ ID NO: 144412 - DNA, 22 bp, Artificial Sequence
  chemically synthesized
atgcacgttaataagcaagagt

SEQ ID NO: 144413 - DNA, 22 bp, Artificial Sequence
  chemically synthesized
ataagcaagagtttagtttaat

SEQ ID NO: 144414 - DNA, 22 bp, Artificial Sequence
  chemically synthesized
agtttaatgtgatggtgttatg

SEQ ID NO: 144415 - DNA, 22 bp, Artificial Sequence
  chemically synthesized
gtttaatgtgatggtgttatga

SEQ ID NO: 144416 - DNA, 22 bp, Artificial Sequence
  chemically synthesized
aatgtgatggtgttatgaactt

SEQ ID NO: 144417 - DNA, 22 bp, Artificial Sequence
  chemically synthesized
atgtgatggtgttatgaactta

SEQ ID NO: 144418 - DNA, 22 bp, Artificial Sequence
  chemically synthesized
tgaacttaacgcttgtgtctcc

SEQ ID NO: 144419 - DNA, 22 bp, Artificial Sequence
  chemically synthesized
aacgcttgtgtctccagaaaat

SEQ ID NO: 144420 - DNA, 22 bp, Artificial Sequence
  chemically synthesized
acgcttgtgtctccagaaaatt

SEQ ID NO: 144421 - DNA, 22 bp, Artificial Sequence
  chemically synthesized
gtgtctccagaaaattcacatg

SEQ ID NO: 144422 - DNA, 22 bp, Artificial Sequence
  chemically synthesized
tgtctccagaaaattcacatgc

SEQ ID NO: 144423 - DNA, 22 bp, Artificial Sequence
  chemically synthesized
cagaaaattcacatgctgaatc

SEQ ID NO: 144424 - DNA, 22 bp, Artificial Sequence
  chemically synthesized
acatgctgaatccccaactccc

SEQ ID NO: 144425 - DNA, 22 bp, Artificial Sequence
  chemically synthesized
aatccccaactcccaattggct

SEQ ID NO: 144426 - DNA, 22 bp, Artificial Sequence
  chemically synthesized
ccaattggctccatttgtgggg

SEQ ID NO: 144427 - DNA, 22 bp, Artificial Sequence
  chemically synthesized
gctccatttgtgggggaggctt

SEQ ID NO: 144428 - DNA, 22 bp, Artificial Sequence
  chemically synthesized
catttgtgggggaggctttgga

SEQ ID NO: 144429 - DNA, 22 bp, Artificial Sequence
  chemically synthesized
gtgggggaggctttggaaaagt

SEQ ID NO: 144430 - DNA, 22 bp, Artificial Sequence
  chemically synthesized
tgggggaggctttggaaaagta

SEQ ID NO: 144431 - DNA, 22 bp, Artificial Sequence
  chemically synthesized
tggaaaagtaatcaggtttaga

SEQ ID NO: 144432 - DNA, 22 bp, Artificial Sequence
  chemically synthesized
ggaaaagtaatcaggtttagag

SEQ ID NO: 144433 - DNA, 22 bp, Artificial Sequence
  chemically synthesized
gaaaagtaatcaggtttagagg

SEQ ID NO: 144434 - DNA, 22 bp, Artificial Sequence
  chemically synthesized
agaggagctcatgagagcagat

SEQ ID NO: 144435 - DNA, 22 bp, Artificial Sequence
  chemically synthesized
gaggagctcatgagagcagatc

SEQ ID NO: 144436 - DNA, 22 bp, Artificial Sequence
  chemically synthesized
atgagagcagatccccatcata

SEQ ID NO: 144437 - DNA, 22 bp, Artificial Sequence
  chemically synthesized
ttttcctcatcagaagcagaga

SEQ ID NO: 144438 - DNA, 22 bp, Artificial Sequence
  chemically synthesized
tcctcatcagaagcagagagat

SEQ ID NO: 144439 - DNA, 22 bp, Artificial Sequence
  chemically synthesized
cctcatcagaagcagagagatt

SEQ ID NO: 144440 - DNA, 22 bp, Artificial Sequence
  chemically synthesized
ctcatcagaagcagagagatta

SEQ ID NO: 144441 - DNA, 22 bp, Artificial Sequence
  chemically synthesized
atcagaagcagagagattagcc

SEQ ID NO: 144442 - DNA, 22 bp, Artificial Sequence
  chemically synthesized
gccatttctcttccttctggtg

SEQ ID NO: 144443 - DNA, 22 bp, Artificial Sequence
  chemically synthesized
ctcttccttctggtgaggacac

SEQ ID NO: 144444 - DNA, 22 bp, Artificial Sequence
  chemically synthesized
tcttccttctggtgaggacaca

SEQ ID NO: 144445 - DNA, 22 bp, Artificial Sequence
  chemically synthesized
ttccttctggtgaggacacagt

SEQ ID NO: 144446 - DNA, 22 bp, Artificial Sequence
  chemically synthesized
ccttctggtgaggacacagtgg

SEQ ID NO: 144447 - DNA, 22 bp, Artificial Sequence
  chemically synthesized
cttctggtgaggacacagtggg

SEQ ID NO: 144448 - DNA, 22 bp, Artificial Sequence
  chemically synthesized
ctggtgaggacacagtgggaag

SEQ ID NO: 144449 - DNA, 22 bp, Artificial Sequence
  chemically synthesized
tggtgaggacacagtgggaagt

SEQ ID NO: 144450 - DNA, 22 bp, Artificial Sequence
  chemically synthesized
gtgaggacacagtgggaagtca

SEQ ID NO: 144451 - DNA, 22 bp, Artificial Sequence
  chemically synthesized
caacccaggaagagagccctga

SEQ ID NO: 144452 - DNA, 22 bp, Artificial Sequence
  chemically synthesized
accaggaaccagcagaaaagtg

SEQ ID NO: 144453 - DNA, 22 bp, Artificial Sequence
  chemically synthesized
ttgttgaagtcacccagtctat

SEQ ID NO: 144454 - DNA, 22 bp, Artificial Sequence
  chemically synthesized
ttgaagtcacccagtctatgct

SEQ ID NO: 144455 - DNA, 22 bp, Artificial Sequence
  chemically synthesized
aagtcacccagtctatgctatt

SEQ ID NO: 144456 - DNA, 22 bp, Artificial Sequence
  chemically synthesized
tgctattttgttatagcacctt

SEQ ID NO: 144457 - DNA, 22 bp, Artificial Sequence
  chemically synthesized
ttttgttatagcaccttgcact

SEQ ID NO: 144458 - DNA, 22 bp, Artificial Sequence
  chemically synthesized
tgttatagcaccttgcactaag

SEQ ID NO: 144459 - DNA, 22 bp, Artificial Sequence
  chemically synthesized
gttatagcaccttgcactaagt

SEQ ID NO: 144460 - DNA, 22 bp, Artificial Sequence
  chemically synthesized
ttatagcaccttgcactaagta

SEQ ID NO: 144461 - DNA, 22 bp, Artificial Sequence
  chemically synthesized
tagcaccttgcactaagtaagg

SEQ ID NO: 144462 - DNA, 22 bp, Artificial Sequence
  chemically synthesized
gcactaagtaaggcagatgaag

SEQ ID NO: 144463 - DNA, 22 bp, Artificial Sequence
  chemically synthesized
cactaagtaaggcagatgaaga

SEQ ID NO: 144464 - DNA, 22 bp, Artificial Sequence
  chemically synthesized
agtaaggcagatgaagaaagag

SEQ ID NO: 144465 - DNA, 22 bp, Artificial Sequence
  chemically synthesized
cggtgttcagtggattagaaac

SEQ ID NO: 144466 - DNA, 22 bp, Artificial Sequence
  chemically synthesized
ggtgttcagtggattagaaacc

SEQ ID NO: 144467 - DNA, 22 bp, Artificial Sequence
  chemically synthesized
agtggattagaaaccatgttta

SEQ ID NO: 144468 - DNA, 22 bp, Artificial Sequence
  chemically synthesized
gaaaccatgtttatctcaggtt

SEQ ID NO: 144469 - DNA, 22 bp, Artificial Sequence
  chemically synthesized
atctcaggtttacaaatctcca

SEQ ID NO: 144470 - DNA, 22 bp, Artificial Sequence
  chemically synthesized
tctcaggtttacaaatctccac

SEQ ID NO: 144471 - DNA, 22 bp, Artificial Sequence
  chemically synthesized
aggtttacaaatctccacttgt

SEQ ID NO: 144472 - DNA, 22 bp, Artificial Sequence
  chemically synthesized
acaaatctccacttgtcctctg

SEQ ID NO: 144473 - DNA, 22 bp, Artificial Sequence
  chemically synthesized
caaatctccacttgtcctctgt

SEQ ID NO: 144474 - DNA, 22 bp, Artificial Sequence
  chemically synthesized
cacttgtcctctgtgtttcaga

SEQ ID NO: 144475 - DNA, 22 bp, Artificial Sequence
  chemically synthesized
gtcctctgtgtttcagaataaa

SEQ ID NO: 144476 - DNA, 22 bp, Artificial Sequence
  chemically synthesized
tcctctgtgtttcagaataaaa

SEQ ID NO: 144477 - DNA, 22 bp, Artificial Sequence
  chemically synthesized
tgtgtttcagaataaaatacca

SEQ ID NO: 144478 - DNA, 22 bp, Artificial Sequence
  chemically synthesized
tgtttcagaataaaataccaac

SEQ ID NO: 144479 - DNA, 22 bp, Artificial Sequence
  chemically synthesized
cagaataaaataccaactctac

SEQ ID NO: 144480 - DNA, 22 bp, Artificial Sequence
  chemically synthesized
agaataaaataccaactctact

SEQ ID NO: 144481 - DNA, 22 bp, Artificial Sequence
  chemically synthesized
tactactctcatctgtaagatg

SEQ ID NO: 144482 - DNA, 22 bp, Artificial Sequence
  chemically synthesized
ctactctcatctgtaagatgca

SEQ ID NO: 144483 - DNA, 22 bp, Artificial Sequence
  chemically synthesized
ctctcatctgtaagatgcaaat

SEQ ID NO: 144484 - DNA, 22 bp, Artificial Sequence
  chemically synthesized
tcatctgtaagatgcaaatagt

SEQ ID NO: 144485 - DNA, 22 bp, Artificial Sequence
  chemically synthesized
atctgtaagatgcaaatagtaa

SEQ ID NO: 144486 - DNA, 22 bp, Artificial Sequence
  chemically synthesized
taagatgcaaatagtaagcctg

SEQ ID NO: 144487 - DNA, 22 bp, Artificial Sequence
  chemically synthesized
agcccttctgtctaactttgaa

SEQ ID NO: 144488 - DNA, 22 bp, Artificial Sequence
  chemically synthesized
ctgtctaactttgaattctatt

SEQ ID NO: 144489 - DNA, 22 bp, Artificial Sequence
  chemically synthesized
tgtctaactttgaattctattt

SEQ ID NO: 144490 - DNA, 22 bp, Artificial Sequence
  chemically synthesized
tctaactttgaattctattttt

SEQ ID NO: 144491 - DNA, 22 bp, Artificial Sequence
  chemically synthesized
actttgaattctattttttctt

SEQ ID NO: 144492 - DNA, 22 bp, Artificial Sequence
  chemically synthesized
tgaattctattttttcttcaac

SEQ ID NO: 144493 - DNA, 22 bp, Artificial Sequence
  chemically synthesized
gaattctattttttcttcaacg

SEQ ID NO: 144494 - DNA, 22 bp, Artificial Sequence
  chemically synthesized
aattctattttttcttcaacgt

SEQ ID NO: 144495 - DNA, 22 bp, Artificial Sequence
  chemically synthesized
tattttttcttcaacgtacttt

SEQ ID NO: 144496 - DNA, 22 bp, Artificial Sequence
  chemically synthesized
ttttttcttcaacgtactttag

SEQ ID NO: 144497 - DNA, 22 bp, Artificial Sequence
  chemically synthesized
tttcttcaacgtactttaggct

SEQ ID NO: 144498 - DNA, 22 bp, Artificial Sequence
  chemically synthesized
ttcttcaacgtactttaggctt

SEQ ID NO: 144499 - DNA, 22 bp, Artificial Sequence
  chemically synthesized
tcttcaacgtactttaggcttg

SEQ ID NO: 144500 - DNA, 22 bp, Artificial Sequence
  chemically synthesized
cttcaacgtactttaggcttgt

SEQ ID NO: 144501 - DNA, 22 bp, Artificial Sequence
  chemically synthesized
ttcaacgtactttaggcttgta

SEQ ID NO: 144502 - DNA, 22 bp, Artificial Sequence
  chemically synthesized
caacgtactttaggcttgtaat

SEQ ID NO: 144503 - DNA, 22 bp, Artificial Sequence
  chemically synthesized
aacgtactttaggcttgtaatg

SEQ ID NO: 144504 - DNA, 22 bp, Artificial Sequence
  chemically synthesized
taggcttgtaatgtgtttatat

SEQ ID NO: 144505 - DNA, 22 bp, Artificial Sequence
  chemically synthesized
aggcttgtaatgtgtttatata

SEQ ID NO: 144506 - DNA, 22 bp, Artificial Sequence
  chemically synthesized
ggcttgtaatgtgtttatatac

SEQ ID NO: 144507 - DNA, 22 bp, Artificial Sequence
  chemically synthesized
gtaatgtgtttatatacagtga

SEQ ID NO: 144508 - DNA, 22 bp, Artificial Sequence
  chemically synthesized
taatgtgtttatatacagtgaa

SEQ ID NO: 144509 - DNA, 22 bp, Artificial Sequence
  chemically synthesized
atatacagtgaaatgtcaagtt

SEQ ID NO: 144510 - DNA, 22 bp, Artificial Sequence
  chemically synthesized
tatacagtgaaatgtcaagttc

SEQ ID NO: 144511 - DNA, 22 bp, Artificial Sequence
  chemically synthesized
tttctttatatttctttctttc

SEQ ID NO: 144512 - DNA, 22 bp, Artificial Sequence
  chemically synthesized
tctttatatttctttctttctt

SEQ ID NO: 144513 - DNA, 22 bp, Artificial Sequence
  chemically synthesized
ctttatatttctttctttcttt

SEQ ID NO: 144514 - DNA, 22 bp, Artificial Sequence
  chemically synthesized
tttatatttctttctttctttt

SEQ ID NO: 144515 - DNA, 22 bp, Artificial Sequence
  chemically synthesized
tatatttctttctttctttttt

SEQ ID NO: 144516 - DNA, 22 bp, Artificial Sequence
  chemically synthesized
atatttctttctttcttttttt

SEQ ID NO: 144517 - DNA, 22 bp, Artificial Sequence
  chemically synthesized
tatttctttctttctttttttt

SEQ ID NO: 144518 - DNA, 22 bp, Artificial Sequence
  chemically synthesized
ctttctttcttttttttcctca

SEQ ID NO: 144519 - DNA, 22 bp, Artificial Sequence
  chemically synthesized
tttctttcttttttttcctcag

SEQ ID NO: 144520 - DNA, 22 bp, Artificial Sequence
  chemically synthesized
tctttcttttttttcctcagcc

SEQ ID NO: 144521 - DNA, 22 bp, Artificial Sequence
  chemically synthesized
ctttcttttttttcctcagcct

SEQ ID NO: 144522 - DNA, 22 bp, Artificial Sequence
  chemically synthesized
tttcttttttttcctcagcctc

SEQ ID NO: 144523 - DNA, 22 bp, Artificial Sequence
  chemically synthesized
tcttttttttcctcagcctcag

SEQ ID NO: 144524 - DNA, 22 bp, Artificial Sequence
  chemically synthesized
cttttttttcctcagcctcaga

SEQ ID NO: 144525 - DNA, 22 bp, Artificial Sequence
  chemically synthesized
ttttttttcctcagcctcagag

SEQ ID NO: 144526 - DNA, 22 bp, Artificial Sequence
  chemically synthesized
ttttttcctcagcctcagagtt

SEQ ID NO: 144527 - DNA, 22 bp, Artificial Sequence
  chemically synthesized
tttttcctcagcctcagagttt

SEQ ID NO: 144528 - DNA, 22 bp, Artificial Sequence
  chemically synthesized
ttttcctcagcctcagagtttt

SEQ ID NO: 144529 - DNA, 22 bp, Artificial Sequence
  chemically synthesized
tttcctcagcctcagagttttc

SEQ ID NO: 144530 - DNA, 22 bp, Artificial Sequence
  chemically synthesized
ttcctcagcctcagagttttcc

SEQ ID NO: 144531 - DNA, 22 bp, Artificial Sequence
  chemically synthesized
tcctcagcctcagagttttcca

SEQ ID NO: 144532 - DNA, 22 bp, Artificial Sequence
  chemically synthesized
cctcagcctcagagttttccac

SEQ ID NO: 144533 - DNA, 22 bp, Artificial Sequence
  chemically synthesized
ctcagcctcagagttttccaca

SEQ ID NO: 144534 - DNA, 22 bp, Artificial Sequence
  chemically synthesized
agcctcagagttttccacatgc

SEQ ID NO: 144535 - DNA, 22 bp, Artificial Sequence
  chemically synthesized
agagttttccacatgcccttcc

SEQ ID NO: 144536 - DNA, 22 bp, Artificial Sequence
  chemically synthesized
tccacatgcccttcctactttc

SEQ ID NO: 144537 - DNA, 22 bp, Artificial Sequence
  chemically synthesized
ccacatgcccttcctactttca

SEQ ID NO: 144538 - DNA, 22 bp, Artificial Sequence
  chemically synthesized
cacatgcccttcctactttcag

SEQ ID NO: 144539 - DNA, 22 bp, Artificial Sequence
  chemically synthesized
cctactttcaggaacttctttc

SEQ ID NO: 144540 - DNA, 22 bp, Artificial Sequence
  chemically synthesized
ctactttcaggaacttctttct

SEQ ID NO: 144541 - DNA, 22 bp, Artificial Sequence
  chemically synthesized
ctttcaggaacttctttctcca

SEQ ID NO: 144542 - DNA, 22 bp, Artificial Sequence
  chemically synthesized
tcaggaacttctttctccaaac

SEQ ID NO: 144543 - DNA, 22 bp, Artificial Sequence
  chemically synthesized
caggaacttctttctccaaacg

SEQ ID NO: 144544 - DNA, 22 bp, Artificial Sequence
  chemically synthesized
aggaacttctttctccaaacgt

SEQ ID NO: 144545 - DNA, 22 bp, Artificial Sequence
  chemically synthesized
ctttctccaaacgtcttctgcc

SEQ ID NO: 144546 - DNA, 22 bp, Artificial Sequence
  chemically synthesized
tttctccaaacgtcttctgcct

SEQ ID NO: 144547 - DNA, 22 bp, Artificial Sequence
  chemically synthesized
tctccaaacgtcttctgcctgg

SEQ ID NO: 144548 - DNA, 22 bp, Artificial Sequence
  chemically synthesized
ctccaaacgtcttctgcctggc

SEQ ID NO: 144549 - DNA, 22 bp, Artificial Sequence
  chemically synthesized
tccaaacgtcttctgcctggct

SEQ ID NO: 144550 - DNA, 22 bp, Artificial Sequence
  chemically synthesized
caaacgtcttctgcctggctcc

SEQ ID NO: 144551 - DNA, 22 bp, Artificial Sequence
  chemically synthesized
ctgcctggctccatcaaatcat

SEQ ID NO: 144552 - DNA, 22 bp, Artificial Sequence
  chemically synthesized
tgcctggctccatcaaatcata

SEQ ID NO: 144553 - DNA, 22 bp, Artificial Sequence
  chemically synthesized
cctggctccatcaaatcataaa

SEQ ID NO: 144554 - DNA, 22 bp, Artificial Sequence
  chemically synthesized
gctccatcaaatcataaaggac

SEQ ID NO: 144555 - DNA, 22 bp, Artificial Sequence
  chemically synthesized
catcaaatcataaaggacccac

SEQ ID NO: 144556 - DNA, 22 bp, Artificial Sequence
  chemically synthesized
caaatgccatcactcactacca

SEQ ID NO: 144557 - DNA, 22 bp, Artificial Sequence
  chemically synthesized
aaatgccatcactcactaccat

SEQ ID NO: 144558 - DNA, 22 bp, Artificial Sequence
  chemically synthesized
actaccatttcacaattcgcac

SEQ ID NO: 144559 - DNA, 22 bp, Artificial Sequence
  chemically synthesized
ccatttcacaattcgcactttc

SEQ ID NO: 144560 - DNA, 22 bp, Artificial Sequence
  chemically synthesized
cacaattcgcactttctttctt

SEQ ID NO: 144561 - DNA, 22 bp, Artificial Sequence
  chemically synthesized
acaattcgcactttctttcttt

SEQ ID NO: 144562 - DNA, 22 bp, Artificial Sequence
  chemically synthesized
gcactttctttctttgtccttt

SEQ ID NO: 144563 - DNA, 22 bp, Artificial Sequence
  chemically synthesized
tctttctttgtccttttttttt

SEQ ID NO: 144564 - DNA, 22 bp, Artificial Sequence
  chemically synthesized
ctttctttgtcctttttttttt

SEQ ID NO: 144565 - DNA, 22 bp, Artificial Sequence
  chemically synthesized
tttctttgtccttttttttttt

SEQ ID NO: 144566 - DNA, 22 bp, Artificial Sequence
  chemically synthesized
tctttgtcctttttttttttag

SEQ ID NO: 144567 - DNA, 22 bp, Artificial Sequence
  chemically synthesized
ctttgtcctttttttttttagt

SEQ ID NO: 144568 - DNA, 22 bp, Artificial Sequence
  chemically synthesized
tttgtcctttttttttttagta

SEQ ID NO: 144569 - DNA, 22 bp, Artificial Sequence
  chemically synthesized
tgtcctttttttttttagtaaa

SEQ ID NO: 144570 - DNA, 22 bp, Artificial Sequence
  chemically synthesized
gtcctttttttttttagtaaaa

SEQ ID NO: 144571 - DNA, 22 bp, Artificial Sequence
  chemically synthesized
tcctttttttttttagtaaaac

SEQ ID NO: 144572 - DNA, 22 bp, Artificial Sequence
  chemically synthesized
tttttttttagtaaaacaagtt

SEQ ID NO: 144573 - DNA, 22 bp, Artificial Sequence
  chemically synthesized
ttttttttagtaaaacaagttt

SEQ ID NO: 144574 - DNA, 22 bp, Artificial Sequence
  chemically synthesized
tttttttagtaaaacaagttta

SEQ ID NO: 144575 - DNA, 22 bp, Artificial Sequence
  chemically synthesized
ttttttagtaaaacaagtttat

SEQ ID NO: 144576 - DNA, 22 bp, Artificial Sequence
  chemically synthesized
tttttagtaaaacaagtttata

SEQ ID NO: 144577 - DNA, 22 bp, Artificial Sequence
  chemically synthesized
ttttagtaaaacaagtttataa

SEQ ID NO: 144578 - DNA, 22 bp, Artificial Sequence
  chemically synthesized
tttagtaaaacaagtttataaa

SEQ ID NO: 144579 - DNA, 22 bp, Artificial Sequence
  chemically synthesized
ttagtaaaacaagtttataaaa

SEQ ID NO: 144580 - DNA, 22 bp, Artificial Sequence
  chemically synthesized
tagtaaaacaagtttataaaaa

SEQ ID NO: 144581 - DNA, 22 bp, Artificial Sequence
  chemically synthesized
agtaaaacaagtttataaaaaa

SEQ ID NO: 144582 - DNA, 22 bp, Artificial Sequence
  chemically synthesized
gtaaaacaagtttataaaaaat

SEQ ID NO: 144583 - DNA, 22 bp, Artificial Sequence
  chemically synthesized
ataaaaaattgaaggaataaat

SEQ ID NO: 144584 - DNA, 22 bp, Artificial Sequence
  chemically synthesized
taaaaaattgaaggaataaatg

SEQ ID NO: 144585 - DNA, 22 bp, Artificial Sequence
  chemically synthesized
aaggaataaatgaatggctact

SEQ ID NO: 144586 - DNA, 22 bp, Artificial Sequence
  chemically synthesized
cttcataggcagagtagacgca

SEQ ID NO: 144587 - DNA, 22 bp, Artificial Sequence
  chemically synthesized
cataggcagagtagacgcaagg

SEQ ID NO: 144588 - DNA, 22 bp, Artificial Sequence
  chemically synthesized
ataggcagagtagacgcaaggg

SEQ ID NO: 144589 - DNA, 22 bp, Artificial Sequence
  chemically synthesized
ctggttgccgatttttattgtt

SEQ ID NO: 144590 - DNA, 22 bp, Artificial Sequence
  chemically synthesized
gttgccgatttttattgttatt

SEQ ID NO: 144591 - DNA, 22 bp, Artificial Sequence
  chemically synthesized
ccgatttttattgttatttttc

SEQ ID NO: 144592 - DNA, 22 bp, Artificial Sequence
  chemically synthesized
ttattgttatttttcaatagta

SEQ ID NO: 144593 - DNA, 22 bp, Artificial Sequence
  chemically synthesized
tattgttatttttcaatagtat

SEQ ID NO: 144594 - DNA, 22 bp, Artificial Sequence
  chemically synthesized
attgttatttttcaatagtatg

SEQ ID NO: 144595 - DNA, 22 bp, Artificial Sequence
  chemically synthesized
ttgttatttttcaatagtatgc

SEQ ID NO: 144596 - DNA, 22 bp, Artificial Sequence
  chemically synthesized
ttatttttcaatagtatgctaa

SEQ ID NO: 144597 - DNA, 22 bp, Artificial Sequence
  chemically synthesized
tttttcaatagtatgctaaaca

SEQ ID NO: 144598 - DNA, 22 bp, Artificial Sequence
  chemically synthesized
ttcaatagtatgctaaacaagg

SEQ ID NO: 144599 - DNA, 22 bp, Artificial Sequence
  chemically synthesized
tcaatagtatgctaaacaaggg

SEQ ID NO: 144600 - DNA, 22 bp, Artificial Sequence
  chemically synthesized
caatagtatgctaaacaagggg

SEQ ID NO: 144601 - DNA, 22 bp, Artificial Sequence
  chemically synthesized
aatagtatgctaaacaaggggt

SEQ ID NO: 144602 - DNA, 22 bp, Artificial Sequence
  chemically synthesized
aacaaggggtagattatttatg

SEQ ID NO: 144603 - DNA, 22 bp, Artificial Sequence
  chemically synthesized
tttatgctgcccatttttagac

SEQ ID NO: 144604 - DNA, 22 bp, Artificial Sequence
  chemically synthesized
atgctgcccatttttagaccat

SEQ ID NO: 144605 - DNA, 22 bp, Artificial Sequence
  chemically synthesized
tgctgcccatttttagaccata

SEQ ID NO: 144606 - DNA, 22 bp, Artificial Sequence
  chemically synthesized
cccatttttagaccataaaaga

SEQ ID NO: 144607 - DNA, 22 bp, Artificial Sequence
  chemically synthesized
ttagaccataaaagataacttc

SEQ ID NO: 144608 - DNA, 22 bp, Artificial Sequence
  chemically synthesized
tagaccataaaagataacttcc

SEQ ID NO: 144609 - DNA, 22 bp, Artificial Sequence
  chemically synthesized
agaccataaaagataacttcct

SEQ ID NO: 144610 - DNA, 22 bp, Artificial Sequence
  chemically synthesized
gaccataaaagataacttcctg

SEQ ID NO: 144611 - DNA, 22 bp, Artificial Sequence
  chemically synthesized
cctgatgttgccatggcatttt

SEQ ID NO: 144612 - DNA, 22 bp, Artificial Sequence
  chemically synthesized
ctgatgttgccatggcattttt

SEQ ID NO: 144613 - DNA, 22 bp, Artificial Sequence
  chemically synthesized
atgttgccatggcatttttttc

SEQ ID NO: 144614 - DNA, 22 bp, Artificial Sequence
  chemically synthesized
ccatggcatttttttcctttta

SEQ ID NO: 144615 - DNA, 22 bp, Artificial Sequence
  chemically synthesized
ttttccttttaattttatttca

SEQ ID NO: 144616 - DNA, 22 bp, Artificial Sequence
  chemically synthesized
tttccttttaattttatttcat

SEQ ID NO: 144617 - DNA, 22 bp, Artificial Sequence
  chemically synthesized
ttccttttaattttatttcatt

SEQ ID NO: 144618 - DNA, 22 bp, Artificial Sequence
  chemically synthesized
tccttttaattttatttcattt

SEQ ID NO: 144619 - DNA, 22 bp, Artificial Sequence
  chemically synthesized
ccttttaattttatttcatttc

SEQ ID NO: 144620 - DNA, 22 bp, Artificial Sequence
  chemically synthesized
cttttaattttatttcatttca

SEQ ID NO: 144621 - DNA, 22 bp, Artificial Sequence
  chemically synthesized
ttaattttatttcatttcattt

SEQ ID NO: 144622 - DNA, 22 bp, Artificial Sequence
  chemically synthesized
taattttatttcatttcatttt

SEQ ID NO: 144623 - DNA, 22 bp, Artificial Sequence
  chemically synthesized
aattttatttcatttcatttta

SEQ ID NO: 144624 - DNA, 22 bp, Artificial Sequence
  chemically synthesized
attttatttcatttcattttaa

SEQ ID NO: 144625 - DNA, 22 bp, Artificial Sequence
  chemically synthesized
tatttcatttcattttaatttc

SEQ ID NO: 144626 - DNA, 22 bp, Artificial Sequence
  chemically synthesized
atttcatttcattttaatttcg

SEQ ID NO: 144627 - DNA, 22 bp, Artificial Sequence
  chemically synthesized
tttcatttcattttaatttcga

SEQ ID NO: 144628 - DNA, 22 bp, Artificial Sequence
  chemically synthesized
catttcattttaatttcgaagg

SEQ ID NO: 144629 - DNA, 22 bp, Artificial Sequence
  chemically synthesized
atttcattttaatttcgaaggt

SEQ ID NO: 144630 - DNA, 22 bp, Artificial Sequence
  chemically synthesized
cattttaatttcgaaggtacat

SEQ ID NO: 144631 - DNA, 22 bp, Artificial Sequence
  chemically synthesized
attttaatttcgaaggtacatg

SEQ ID NO: 144632 - DNA, 22 bp, Artificial Sequence
  chemically synthesized
taatttcgaaggtacatgtgca

SEQ ID NO: 144633 - DNA, 22 bp, Artificial Sequence
  chemically synthesized
aatttcgaaggtacatgtgcag

SEQ ID NO: 144634 - DNA, 22 bp, Artificial Sequence
  chemically synthesized
atttcgaaggtacatgtgcagg

SEQ ID NO: 144635 - DNA, 22 bp, Artificial Sequence
  chemically synthesized
cgaaggtacatgtgcaggatgt

SEQ ID NO: 144636 - DNA, 22 bp, Artificial Sequence
  chemically synthesized
gaaggtacatgtgcaggatgtg

SEQ ID NO: 144637 - DNA, 22 bp, Artificial Sequence
  chemically synthesized
gttacatgggtaaatgtgtgtc

SEQ ID NO: 144638 - DNA, 22 bp, Artificial Sequence
  chemically synthesized
ttacatgggtaaatgtgtgtct

SEQ ID NO: 144639 - DNA, 22 bp, Artificial Sequence
  chemically synthesized
catgggtaaatgtgtgtctttc

SEQ ID NO: 144640 - DNA, 22 bp, Artificial Sequence
  chemically synthesized
tctggccttttagccatctgta

SEQ ID NO: 144641 - DNA, 22 bp, Artificial Sequence
  chemically synthesized
ctggccttttagccatctgtat

SEQ ID NO: 144642 - DNA, 22 bp, Artificial Sequence
  chemically synthesized
tggccttttagccatctgtatc

SEQ ID NO: 144643 - DNA, 22 bp, Artificial Sequence
  chemically synthesized
gccttttagccatctgtatcaa

SEQ ID NO: 144644 - DNA, 22 bp, Artificial Sequence
  chemically synthesized
ttagccatctgtatcaatgagc

SEQ ID NO: 144645 - DNA, 22 bp, Artificial Sequence
  chemically synthesized
tagccatctgtatcaatgagca

SEQ ID NO: 144646 - DNA, 22 bp, Artificial Sequence
  chemically synthesized
agccatctgtatcaatgagcag

SEQ ID NO: 144647 - DNA, 22 bp, Artificial Sequence
  chemically synthesized
gccatctgtatcaatgagcaga

SEQ ID NO: 144648 - DNA, 22 bp, Artificial Sequence
  chemically synthesized
tatcaatgagcagatataagct

SEQ ID NO: 144649 - DNA, 22 bp, Artificial Sequence
  chemically synthesized
tacacaggatcatgaaggatga

SEQ ID NO: 144650 - DNA, 22 bp, Artificial Sequence
  chemically synthesized
acacaggatcatgaaggatgaa

SEQ ID NO: 144651 - DNA, 22 bp, Artificial Sequence
  chemically synthesized
cacaggatcatgaaggatgaaa

SEQ ID NO: 144652 - DNA, 22 bp, Artificial Sequence
  chemically synthesized
caccaatattataataatttca

SEQ ID NO: 144653 - DNA, 22 bp, Artificial Sequence
  chemically synthesized
accaatattataataatttcaa

SEQ ID NO: 144654 - DNA, 22 bp, Artificial Sequence
  chemically synthesized
taataatttcaatcaacctgat

SEQ ID NO: 144655 - DNA, 22 bp, Artificial Sequence
  chemically synthesized
caatcaacctgatagcttaggg

SEQ ID NO: 144656 - DNA, 22 bp, Artificial Sequence
  chemically synthesized
aatcaacctgatagcttagggg

SEQ ID NO: 144657 - DNA, 22 bp, Artificial Sequence
  chemically synthesized
atagcttaggggataaactaat

SEQ ID NO: 144658 - DNA, 22 bp, Artificial Sequence
  chemically synthesized
aggggataaactaatttgaaga

SEQ ID NO: 144659 - DNA, 22 bp, Artificial Sequence
  chemically synthesized
ggggataaactaatttgaagat

SEQ ID NO: 144660 - DNA, 22 bp, Artificial Sequence
  chemically synthesized
atttgaagatacagcttgcctc

SEQ ID NO: 144661 - DNA, 22 bp, Artificial Sequence
  chemically synthesized
gaagatacagcttgcctccgat

SEQ ID NO: 144662 - DNA, 22 bp, Artificial Sequence
  chemically synthesized
aagatacagcttgcctccgata

SEQ ID NO: 144663 - DNA, 22 bp, Artificial Sequence
  chemically synthesized
gcctccgataagccagaattcc

SEQ ID NO: 144664 - DNA, 22 bp, Artificial Sequence
  chemically synthesized
cctccgataagccagaattcca

SEQ ID NO: 144665 - DNA, 22 bp, Artificial Sequence
  chemically synthesized
cgataagccagaattccagagc

SEQ ID NO: 144666 - DNA, 22 bp, Artificial Sequence
  chemically synthesized
cagagcttctggcattataatc

SEQ ID NO: 144667 - DNA, 22 bp, Artificial Sequence
  chemically synthesized
ctggcattataatctagcaagg

SEQ ID NO: 144668 - DNA, 22 bp, Artificial Sequence
  chemically synthesized
tggcattataatctagcaaggt

SEQ ID NO: 144669 - DNA, 22 bp, Artificial Sequence
  chemically synthesized
gcattataatctagcaaggtta

SEQ ID NO: 144670 - DNA, 22 bp, Artificial Sequence
  chemically synthesized
taatctagcaaggttagagatc

SEQ ID NO: 144671 - DNA, 22 bp, Artificial Sequence
  chemically synthesized
gcaaggttagagatcatggatc

SEQ ID NO: 144672 - DNA, 22 bp, Artificial Sequence
  chemically synthesized
gagatcatggatcactttcaga

SEQ ID NO: 144673 - DNA, 22 bp, Artificial Sequence
  chemically synthesized
tcagagaaaaacaaaaacaaac

SEQ ID NO: 144674 - DNA, 22 bp, Artificial Sequence
  chemically synthesized
cagagaaaaacaaaaacaaact

SEQ ID NO: 144675 - DNA, 22 bp, Artificial Sequence
  chemically synthesized
agagaaaaacaaaaacaaacta

SEQ ID NO: 144676 - DNA, 22 bp, Artificial Sequence
  chemically synthesized
accaaaagcaaaacagaaccaa

SEQ ID NO: 144677 - DNA, 22 bp, Artificial Sequence
  chemically synthesized
cctaccctgttaatggtccaat

SEQ ID NO: 144678 - DNA, 22 bp, Artificial Sequence
  chemically synthesized
ctaccctgttaatggtccaata

SEQ ID NO: 144679 - DNA, 22 bp, Artificial Sequence
  chemically synthesized
ccctgttaatggtccaatatgt

SEQ ID NO: 144680 - DNA, 22 bp, Artificial Sequence
  chemically synthesized
ttaatggtccaatatgtcagaa

SEQ ID NO: 144681 - DNA, 22 bp, Artificial Sequence
  chemically synthesized
atggtccaatatgtcagaaaca

SEQ ID NO: 144682 - DNA, 22 bp, Artificial Sequence
  chemically synthesized
tgttagaaataaagctgtctaa

SEQ ID NO: 144683 - DNA, 22 bp, Artificial Sequence
  chemically synthesized
gaaataaagctgtctaaagtac

SEQ ID NO: 144684 - DNA, 22 bp, Artificial Sequence
  chemically synthesized
tctaaagtacactaatattcga

SEQ ID NO: 144685 - DNA, 22 bp, Artificial Sequence
  chemically synthesized
aagtacactaatattcgagtta

SEQ ID NO: 144686 - DNA, 22 bp, Artificial Sequence
  chemically synthesized
atattcgagttataatagtgtg

SEQ ID NO: 144687 - DNA, 22 bp, Artificial Sequence
  chemically synthesized
gagttataatagtgtgtggact

SEQ ID NO: 144688 - DNA, 22 bp, Artificial Sequence
  chemically synthesized
taatagtgtgtggactattagt

SEQ ID NO: 144689 - DNA, 22 bp, Artificial Sequence
  chemically synthesized
ttagtcaataaaaacaaccctt

SEQ ID NO: 144690 - DNA, 22 bp, Artificial Sequence
  chemically synthesized
gtcaataaaaacaacccttgcc

SEQ ID NO: 144691 - DNA, 22 bp, Artificial Sequence
  chemically synthesized
gcctctttagagttgttttcca

SEQ ID NO: 144692 - DNA, 22 bp, Artificial Sequence
  chemically synthesized
cctctttagagttgttttccat

SEQ ID NO: 144693 - DNA, 22 bp, Artificial Sequence
  chemically synthesized
tttagagttgttttccatgtac

SEQ ID NO: 144694 - DNA, 22 bp, Artificial Sequence
  chemically synthesized
tagagttgttttccatgtacac

SEQ ID NO: 144695 - DNA, 22 bp, Artificial Sequence
  chemically synthesized
agagttgttttccatgtacacg

SEQ ID NO: 144696 - DNA, 22 bp, Artificial Sequence
  chemically synthesized
gagttgttttccatgtacacgc

SEQ ID NO: 144697 - DNA, 22 bp, Artificial Sequence
  chemically synthesized
ttttccatgtacacgcacatct

SEQ ID NO: 144698 - DNA, 22 bp, Artificial Sequence
  chemically synthesized
tccatgtacacgcacatcttat

SEQ ID NO: 144699 - DNA, 22 bp, Artificial Sequence
  chemically synthesized
ccatgtacacgcacatcttatg

SEQ ID NO: 144700 - DNA, 22 bp, Artificial Sequence
  chemically synthesized
catgtacacgcacatcttatgt

SEQ ID NO: 144701 - DNA, 22 bp, Artificial Sequence
  chemically synthesized
atgtcttagagtaagattccct

SEQ ID NO: 144702 - DNA, 22 bp, Artificial Sequence
  chemically synthesized
tgtcttagagtaagattccctg

SEQ ID NO: 144703 - DNA, 22 bp, Artificial Sequence
  chemically synthesized
agagtaagattccctgagaagt

SEQ ID NO: 144704 - DNA, 22 bp, Artificial Sequence
  chemically synthesized
gagtaagattccctgagaagtg

SEQ ID NO: 144705 - DNA, 22 bp, Artificial Sequence
  chemically synthesized
cctgagaagtgaacctagcatt

SEQ ID NO: 144706 - DNA, 22 bp, Artificial Sequence
  chemically synthesized
agaagtgaacctagcatttata

SEQ ID NO: 144707 - DNA, 22 bp, Artificial Sequence
  chemically synthesized
gcatttatacaagataattaat

SEQ ID NO: 144708 - DNA, 22 bp, Artificial Sequence
  chemically synthesized
atacaagataattaattctaat

SEQ ID NO: 144709 - DNA, 22 bp, Artificial Sequence
  chemically synthesized
tacaagataattaattctaatc

SEQ ID NO: 144710 - DNA, 22 bp, Artificial Sequence
  chemically synthesized
attctaatccacagtacctgcc

SEQ ID NO: 144711 - DNA, 22 bp, Artificial Sequence
  chemically synthesized
taatccacagtacctgccaaag

SEQ ID NO: 144712 - DNA, 22 bp, Artificial Sequence
  chemically synthesized
atccacagtacctgccaaagaa

SEQ ID NO: 144713 - DNA, 22 bp, Artificial Sequence
  chemically synthesized
ccaaagaacattctaccatcat

SEQ ID NO: 144714 - DNA, 22 bp, Artificial Sequence
  chemically synthesized
taccatcatctttactgagcat

SEQ ID NO: 144715 - DNA, 22 bp, Artificial Sequence
  chemically synthesized
ccatcatctttactgagcatag

SEQ ID NO: 144716 - DNA, 22 bp, Artificial Sequence
  chemically synthesized
tactgagcatagaagagctacg

SEQ ID NO: 144717 - DNA, 22 bp, Artificial Sequence
  chemically synthesized
actgagcatagaagagctacgc

SEQ ID NO: 144718 - DNA, 22 bp, Artificial Sequence
  chemically synthesized
ctgagcatagaagagctacgcc

SEQ ID NO: 144719 - DNA, 22 bp, Artificial Sequence
  chemically synthesized
agcatagaagagctacgccaaa

SEQ ID NO: 144720 - DNA, 22 bp, Artificial Sequence
  chemically synthesized
cgccaaaaccctgggtcatcag

SEQ ID NO: 144721 - DNA, 22 bp, Artificial Sequence
  chemically synthesized
ggtcatcagccagcacacacac

SEQ ID NO: 144722 - DNA, 22 bp, Artificial Sequence
  chemically synthesized
atccagtggtaaatacacatca

SEQ ID NO: 144723 - DNA, 22 bp, Artificial Sequence
  chemically synthesized
tccagtggtaaatacacatcat

SEQ ID NO: 144724 - DNA, 22 bp, Artificial Sequence
  chemically synthesized
gtgtatacatacatacctgaat

SEQ ID NO: 144725 - DNA, 22 bp, Artificial Sequence
  chemically synthesized
aatatggaatcaaatatttttc

SEQ ID NO: 144726 - DNA, 22 bp, Artificial Sequence
  chemically synthesized
ttctaagatgaaacagtcatga

SEQ ID NO: 144727 - DNA, 22 bp, Artificial Sequence
  chemically synthesized
tctaagatgaaacagtcatgat

SEQ ID NO: 144728 - DNA, 22 bp, Artificial Sequence
  chemically synthesized
ctaagatgaaacagtcatgatt

SEQ ID NO: 144729 - DNA, 22 bp, Artificial Sequence
  chemically synthesized
taagatgaaacagtcatgattt

SEQ ID NO: 144730 - DNA, 22 bp, Artificial Sequence
  chemically synthesized
agatgaaacagtcatgatttat

SEQ ID NO: 144731 - DNA, 22 bp, Artificial Sequence
  chemically synthesized
atttcaaataggtacggataag

SEQ ID NO: 144732 - DNA, 22 bp, Artificial Sequence
  chemically synthesized
tttcaaataggtacggataagt

SEQ ID NO: 144733 - DNA, 22 bp, Artificial Sequence
  chemically synthesized
caaataggtacggataagtaga

SEQ ID NO: 144734 - DNA, 22 bp, Artificial Sequence
  chemically synthesized
aaataggtacggataagtagat

SEQ ID NO: 144735 - DNA, 22 bp, Artificial Sequence
  chemically synthesized
aggtaagcattaggtcttatat

SEQ ID NO: 144736 - DNA, 22 bp, Artificial Sequence
  chemically synthesized
ggtcttatattatgtaacacta

SEQ ID NO: 144737 - DNA, 22 bp, Artificial Sequence
  chemically synthesized
atattatgtaacactaatctat

SEQ ID NO: 144738 - DNA, 22 bp, Artificial Sequence
  chemically synthesized
tattatgtaacactaatctatt

SEQ ID NO: 144739 - DNA, 22 bp, Artificial Sequence
  chemically synthesized
tgtaacactaatctattactgc

SEQ ID NO: 144740 - DNA, 22 bp, Artificial Sequence
  chemically synthesized
atctattactgcgctgaaactg

SEQ ID NO: 144741 - DNA, 22 bp, Artificial Sequence
  chemically synthesized
ttactgcgctgaaactgtggct

SEQ ID NO: 144742 - DNA, 22 bp, Artificial Sequence
  chemically synthesized
ctgcgctgaaactgtggcttta

SEQ ID NO: 144743 - DNA, 22 bp, Artificial Sequence
  chemically synthesized
cgctgaaactgtggctttatag

SEQ ID NO: 144744 - DNA, 22 bp, Artificial Sequence
  chemically synthesized
aaactgtggctttatagaaatt

SEQ ID NO: 144745 - DNA, 22 bp, Artificial Sequence
  chemically synthesized
tggctttatagaaattgttttc

SEQ ID NO: 144746 - DNA, 22 bp, Artificial Sequence
  chemically synthesized
tatagaaattgttttcactgca

SEQ ID NO: 144747 - DNA, 22 bp, Artificial Sequence
  chemically synthesized
atagaaattgttttcactgcac

SEQ ID NO: 144748 - DNA, 22 bp, Artificial Sequence
  chemically synthesized
tagaaattgttttcactgcact

SEQ ID NO: 144749 - DNA, 22 bp, Artificial Sequence
  chemically synthesized
ttttcactgcactattgagaaa

SEQ ID NO: 144750 - DNA, 22 bp, Artificial Sequence
  chemically synthesized
tcactgcactattgagaaatta

SEQ ID NO: 144751 - DNA, 22 bp, Artificial Sequence
  chemically synthesized
cactgcactattgagaaattaa

SEQ ID NO: 144752 - DNA, 22 bp, Artificial Sequence
  chemically synthesized
actgcactattgagaaattaag

SEQ ID NO: 144753 - DNA, 22 bp, Artificial Sequence
  chemically synthesized
cactattgagaaattaagagat

SEQ ID NO: 144754 - DNA, 22 bp, Artificial Sequence
  chemically synthesized
ttgagaaattaagagataatgg

SEQ ID NO: 144755 - DNA, 22 bp, Artificial Sequence
  chemically synthesized
agaaattaagagataatggcaa

SEQ ID NO: 144756 - DNA, 22 bp, Artificial Sequence
  chemically synthesized
agagataatggcaaaagtcaca

SEQ ID NO: 144757 - DNA, 22 bp, Artificial Sequence
  chemically synthesized
aaaaagaagtatagcacttttt

SEQ ID NO: 144758 - DNA, 22 bp, Artificial Sequence
  chemically synthesized
tttccttagaaaccactgctaa

SEQ ID NO: 144759 - DNA, 22 bp, Artificial Sequence
  chemically synthesized
ttccttagaaaccactgctaac

SEQ ID NO: 144760 - DNA, 22 bp, Artificial Sequence
  chemically synthesized
tccttagaaaccactgctaact

SEQ ID NO: 144761 - DNA, 22 bp, Artificial Sequence
  chemically synthesized
ccttagaaaccactgctaactg

SEQ ID NO: 144762 - DNA, 22 bp, Artificial Sequence
  chemically synthesized
cttagaaaccactgctaactga

SEQ ID NO: 144763 - DNA, 22 bp, Artificial Sequence
  chemically synthesized
agaaaccactgctaactgaaag

SEQ ID NO: 144764 - DNA, 22 bp, Artificial Sequence
  chemically synthesized
gaaaccactgctaactgaaaga

SEQ ID NO: 144765 - DNA, 22 bp, Artificial Sequence
  chemically synthesized
ctaactgaaagagactaagatt

SEQ ID NO: 144766 - DNA, 22 bp, Artificial Sequence
  chemically synthesized
actgaaagagactaagatttgt

SEQ ID NO: 144767 - DNA, 22 bp, Artificial Sequence
  chemically synthesized
aaagagactaagatttgtcccg

SEQ ID NO: 144768 - DNA, 22 bp, Artificial Sequence
  chemically synthesized
agatttgtcccgtcaaaaatcc

SEQ ID NO: 144769 - DNA, 22 bp, Artificial Sequence
  chemically synthesized
gtcccgtcaaaaatcctggacc

SEQ ID NO: 144770 - DNA, 22 bp, Artificial Sequence
  chemically synthesized
tcccgtcaaaaatcctggacct

SEQ ID NO: 144771 - DNA, 22 bp, Artificial Sequence
  chemically synthesized
gacctatgcctaaaacacattt

SEQ ID NO: 144772 - DNA, 22 bp, Artificial Sequence
  chemically synthesized
tgcctaaaacacatttcacaat

SEQ ID NO: 144773 - DNA, 22 bp, Artificial Sequence
  chemically synthesized
aaacacatttcacaatccctga

SEQ ID NO: 144774 - DNA, 22 bp, Artificial Sequence
  chemically synthesized
cacaatccctgaacttttcaaa

SEQ ID NO: 144775 - DNA, 22 bp, Artificial Sequence
  chemically synthesized
acaatccctgaacttttcaaaa

SEQ ID NO: 144776 - DNA, 22 bp, Artificial Sequence
  chemically synthesized
aacttttcaaaaattggtacat

SEQ ID NO: 144777 - DNA, 22 bp, Artificial Sequence
  chemically synthesized
ttcaaaaattggtacatgcttt

SEQ ID NO: 144778 - DNA, 22 bp, Artificial Sequence
  chemically synthesized
tcaaaaattggtacatgcttta

SEQ ID NO: 144779 - DNA, 22 bp, Artificial Sequence
  chemically synthesized
caaaaattggtacatgctttag

SEQ ID NO: 144780 - DNA, 22 bp, Artificial Sequence
  chemically synthesized
aaaaattggtacatgctttagc

SEQ ID NO: 144781 - DNA, 22 bp, Artificial Sequence
  chemically synthesized
gtacatgctttagctttaaact

SEQ ID NO: 144782 - DNA, 22 bp, Artificial Sequence
  chemically synthesized
tagctttaaactacaggcctca

SEQ ID NO: 144783 - DNA, 22 bp, Artificial Sequence
  chemically synthesized
agctttaaactacaggcctcac

SEQ ID NO: 144784 - DNA, 22 bp, Artificial Sequence
  chemically synthesized
gctttaaactacaggcctcact

SEQ ID NO: 144785 - DNA, 22 bp, Artificial Sequence
  chemically synthesized
taaactacaggcctcactggag

SEQ ID NO: 144786 - DNA, 22 bp, Artificial Sequence
  chemically synthesized
aaactacaggcctcactggagc

SEQ ID NO: 144787 - DNA, 22 bp, Artificial Sequence
  chemically synthesized
aactacaggcctcactggagct

SEQ ID NO: 144788 - DNA, 22 bp, Artificial Sequence
  chemically synthesized
caggcctcactggagctagaga

SEQ ID NO: 144789 - DNA, 22 bp, Artificial Sequence
  chemically synthesized
actggagctagagacaagaagg

SEQ ID NO: 144790 - DNA, 22 bp, Artificial Sequence
  chemically synthesized
gagctagagacaagaaggtaaa

SEQ ID NO: 144791 - DNA, 22 bp, Artificial Sequence
  chemically synthesized
gagacaagaaggtaaaaaacgg

SEQ ID NO: 144792 - DNA, 22 bp, Artificial Sequence
  chemically synthesized
acaaaagaagtcctggtatcct

SEQ ID NO: 144793 - DNA, 22 bp, Artificial Sequence
  chemically synthesized
gtatcctctatgatgggagaag

SEQ ID NO: 144794 - DNA, 22 bp, Artificial Sequence
  chemically synthesized
tatgatgggagaaggaaactag

SEQ ID NO: 144795 - DNA, 22 bp, Artificial Sequence
  chemically synthesized
tgatgggagaaggaaactagct

SEQ ID NO: 144796 - DNA, 22 bp, Artificial Sequence
  chemically synthesized
gctaaagggaagaataaattag

SEQ ID NO: 144797 - DNA, 22 bp, Artificial Sequence
  chemically synthesized
aagggaagaataaattagagaa

SEQ ID NO: 144798 - DNA, 22 bp, Artificial Sequence
  chemically synthesized
gagaaaaactggaatgactgaa

SEQ ID NO: 144799 - DNA, 22 bp, Artificial Sequence
  chemically synthesized
gaatgactgaatcggaacaagg

SEQ ID NO: 144800 - DNA, 22 bp, Artificial Sequence
  chemically synthesized
aatcggaacaaggcaaaggcta

SEQ ID NO: 144801 - DNA, 22 bp, Artificial Sequence
  chemically synthesized
taaaaaaaattagcagtatcct

SEQ ID NO: 144802 - DNA, 22 bp, Artificial Sequence
  chemically synthesized
gcagtatcctcttgggggcccc

SEQ ID NO: 144803 - DNA, 22 bp, Artificial Sequence
  chemically synthesized
ttgggggccccttccccacact

SEQ ID NO: 144804 - DNA, 22 bp, Artificial Sequence
  chemically synthesized
gggggccccttccccacactat

SEQ ID NO: 144805 - DNA, 22 bp, Artificial Sequence
  chemically synthesized
ggggccccttccccacactatc

SEQ ID NO: 144806 - DNA, 22 bp, Artificial Sequence
  chemically synthesized
ccccacactatctcaatgcaaa

SEQ ID NO: 144807 - DNA, 22 bp, Artificial Sequence
  chemically synthesized
cccacactatctcaatgcaaat

SEQ ID NO: 144808 - DNA, 22 bp, Artificial Sequence
  chemically synthesized
tctcaatgcaaatatctgtctg

SEQ ID NO: 144809 - DNA, 22 bp, Artificial Sequence
  chemically synthesized
aatgcaaatatctgtctgaaac

SEQ ID NO: 144810 - DNA, 22 bp, Artificial Sequence
  chemically synthesized
tctgaaacggtccctggctaaa

SEQ ID NO: 144811 - DNA, 22 bp, Artificial Sequence
  chemically synthesized
aaacggtccctggctaaactcc

SEQ ID NO: 144812 - DNA, 22 bp, Artificial Sequence
  chemically synthesized
gctaaactccacccatgggttg

SEQ ID NO: 144813 - DNA, 22 bp, Artificial Sequence
  chemically synthesized
aactccacccatgggttggcca

SEQ ID NO: 144814 - DNA, 22 bp, Artificial Sequence
  chemically synthesized
cacccatgggttggccagcctt

SEQ ID NO: 144815 - DNA, 22 bp, Artificial Sequence
  chemically synthesized
gccagccttgccttgaccaata

SEQ ID NO: 144816 - DNA, 22 bp, Artificial Sequence
  chemically synthesized
gccttgaccaatagccttgaca

SEQ ID NO: 144817 - DNA, 22 bp, Artificial Sequence
  chemically synthesized
ccttgaccaatagccttgacaa

SEQ ID NO: 144818 - DNA, 22 bp, Artificial Sequence
  chemically synthesized
gaccaatagccttgacaaggca

SEQ ID NO: 144819 - DNA, 22 bp, Artificial Sequence
  chemically synthesized
accaatagccttgacaaggcaa

SEQ ID NO: 144820 - DNA, 22 bp, Artificial Sequence
  chemically synthesized
gacaaggcaaacttgaccaata

SEQ ID NO: 144821 - DNA, 22 bp, Artificial Sequence
  chemically synthesized
acaaggcaaacttgaccaatag

SEQ ID NO: 144822 - DNA, 22 bp, Artificial Sequence
  chemically synthesized
gaccaatagtcttagagtatcc

SEQ ID NO: 144823 - DNA, 22 bp, Artificial Sequence
  chemically synthesized
accaatagtcttagagtatcca

SEQ ID NO: 144824 - DNA, 22 bp, Artificial Sequence
  chemically synthesized
agagtatccagtgaggccaggg

SEQ ID NO: 144825 - DNA, 22 bp, Artificial Sequence
  chemically synthesized
gagtatccagtgaggccagggg

SEQ ID NO: 144826 - DNA, 22 bp, Artificial Sequence
  chemically synthesized
gctagggatgaagaataaaagg

SEQ ID NO: 144827 - DNA, 22 bp, Artificial Sequence
  chemically synthesized
gggatgaagaataaaaggaagc

SEQ ID NO: 144828 - DNA, 22 bp, Artificial Sequence
  chemically synthesized
cagcagttccacacactcgctt

SEQ ID NO: 144829 - DNA, 22 bp, Artificial Sequence
  chemically synthesized
agcagttccacacactcgcttc

SEQ ID NO: 144830 - DNA, 22 bp, Artificial Sequence
  chemically synthesized
cacacactcgcttctggaacgt

SEQ ID NO: 144831 - DNA, 22 bp, Artificial Sequence
  chemically synthesized
gcttctggaacgtctgaggtta

SEQ ID NO: 144832 - DNA, 22 bp, Artificial Sequence
  chemically synthesized
ctggaacgtctgaggttatcaa

SEQ ID NO: 144833 - DNA, 22 bp, Artificial Sequence
  chemically synthesized
tggaacgtctgaggttatcaat

SEQ ID NO: 144834 - DNA, 22 bp, Artificial Sequence
  chemically synthesized
gaacgtctgaggttatcaataa

SEQ ID NO: 144835 - DNA, 22 bp, Artificial Sequence
  chemically synthesized
aggttatcaataagctcctagt

SEQ ID NO: 144836 - DNA, 22 bp, Artificial Sequence
  chemically synthesized
tcaataagctcctagtccagac

SEQ ID NO: 144837 - DNA, 22 bp, Artificial Sequence
  chemically synthesized
ctagtccagacgccatgggtca

SEQ ID NO: 144838 - DNA, 22 bp, Artificial Sequence
  chemically synthesized
gtccagacgccatgggtcattt

SEQ ID NO: 144839 - DNA, 22 bp, Artificial Sequence
  chemically synthesized
cacagaggaggacaaggctact

SEQ ID NO: 144840 - DNA, 22 bp, Artificial Sequence
  chemically synthesized
acagaggaggacaaggctacta

SEQ ID NO: 144841 - DNA, 22 bp, Artificial Sequence
  chemically synthesized
ctatcacaagcctgtggggcaa

SEQ ID NO: 144842 - DNA, 22 bp, Artificial Sequence
  chemically synthesized
tcacaagcctgtggggcaaggt

SEQ ID NO: 144843 - DNA, 22 bp, Artificial Sequence
  chemically synthesized
tggggcaaggtgaatgtggaag

SEQ ID NO: 144844 - DNA, 22 bp, Artificial Sequence
  chemically synthesized
gaggagaaaccctgggaaggta

SEQ ID NO: 144845 - DNA, 22 bp, Artificial Sequence
  chemically synthesized
ggaaggtaggctctggtgacca

SEQ ID NO: 144846 - DNA, 22 bp, Artificial Sequence
  chemically synthesized
tggtgaccaggacaagggaggg

SEQ ID NO: 144847 - DNA, 22 bp, Artificial Sequence
  chemically synthesized
gtgaccaggacaagggagggaa

SEQ ID NO: 144848 - DNA, 22 bp, Artificial Sequence
  chemically synthesized
tgcctggcaaaagtccaggtcg

SEQ ID NO: 144849 - DNA, 22 bp, Artificial Sequence
  chemically synthesized
gcaaaagtccaggtcgcttctc

SEQ ID NO: 144850 - DNA, 22 bp, Artificial Sequence
  chemically synthesized
ctcaggatttgtggcaccttct

SEQ ID NO: 144851 - DNA, 22 bp, Artificial Sequence
  chemically synthesized
tcaggatttgtggcaccttctg

SEQ ID NO: 144852 - DNA, 22 bp, Artificial Sequence
  chemically synthesized
aggatttgtggcaccttctgac

SEQ ID NO: 144853 - DNA, 22 bp, Artificial Sequence
  chemically synthesized
gtggcaccttctgactgtcaaa

SEQ ID NO: 144854 - DNA, 22 bp, Artificial Sequence
  chemically synthesized
tggcaccttctgactgtcaaac

SEQ ID NO: 144855 - DNA, 22 bp, Artificial Sequence
  chemically synthesized
ctgactgtcaaactgttcttgt

SEQ ID NO: 144856 - DNA, 22 bp, Artificial Sequence
  chemically synthesized
tgactgtcaaactgttcttgtc

SEQ ID NO: 144857 - DNA, 22 bp, Artificial Sequence
  chemically synthesized
actgtcaaactgttcttgtcaa

SEQ ID NO: 144858 - DNA, 22 bp, Artificial Sequence
  chemically synthesized
tcaaactgttcttgtcaatctc

SEQ ID NO: 144859 - DNA, 22 bp, Artificial Sequence
  chemically synthesized
ttcttgtcaatctcacaggctc

SEQ ID NO: 144860 - DNA, 22 bp, Artificial Sequence
  chemically synthesized
ttgtcaatctcacaggctcctg

SEQ ID NO: 144861 - DNA, 22 bp, Artificial Sequence
  chemically synthesized
gtcaatctcacaggctcctggt

SEQ ID NO: 144862 - DNA, 22 bp, Artificial Sequence
  chemically synthesized
tcaatctcacaggctcctggtt

SEQ ID NO: 144863 - DNA, 22 bp, Artificial Sequence
  chemically synthesized
acaggctcctggttgtctaccc

SEQ ID NO: 144864 - DNA, 22 bp, Artificial Sequence
  chemically synthesized
ctggttgtctacccatggaccc

SEQ ID NO: 144865 - DNA, 22 bp, Artificial Sequence
  chemically synthesized
gttgtctacccatggacccaga

SEQ ID NO: 144866 - DNA, 22 bp, Artificial Sequence
  chemically synthesized
tctacccatggacccagaggtt

SEQ ID NO: 144867 - DNA, 22 bp, Artificial Sequence
  chemically synthesized
cccatggacccagaggttcttt

SEQ ID NO: 144868 - DNA, 22 bp, Artificial Sequence
  chemically synthesized
tttgacagctttggcaacctgt

SEQ ID NO: 144869 - DNA, 22 bp, Artificial Sequence
  chemically synthesized
tgacagctttggcaacctgtcc

SEQ ID NO: 144870 - DNA, 22 bp, Artificial Sequence
  chemically synthesized
gacagctttggcaacctgtcct

SEQ ID NO: 144871 - DNA, 22 bp, Artificial Sequence
  chemically synthesized
acagctttggcaacctgtcctc

SEQ ID NO: 144872 - DNA, 22 bp, Artificial Sequence
  chemically synthesized
tggcaacctgtcctctgcctct

SEQ ID NO: 144873 - DNA, 22 bp, Artificial Sequence
  chemically synthesized
ggcaacctgtcctctgcctctg

SEQ ID NO: 144874 - DNA, 22 bp, Artificial Sequence
  chemically synthesized
gcaacctgtcctctgcctctgc

SEQ ID NO: 144875 - DNA, 22 bp, Artificial Sequence
  chemically synthesized
tcctctgcctctgccatcatgg

SEQ ID NO: 144876 - DNA, 22 bp, Artificial Sequence
  chemically synthesized
tgcctctgccatcatgggcaac

SEQ ID NO: 144877 - DNA, 22 bp, Artificial Sequence
  chemically synthesized
cctctgccatcatgggcaaccc

SEQ ID NO: 144878 - DNA, 22 bp, Artificial Sequence
  chemically synthesized
tgccatcatgggcaaccccaaa

SEQ ID NO: 144879 - DNA, 22 bp, Artificial Sequence
  chemically synthesized
ccatcatgggcaaccccaaagt

SEQ ID NO: 144880 - DNA, 22 bp, Artificial Sequence
  chemically synthesized
acttccttgggagatgccacaa

SEQ ID NO: 144881 - DNA, 22 bp, Artificial Sequence
  chemically synthesized
ccttgggagatgccacaaagca

SEQ ID NO: 144882 - DNA, 22 bp, Artificial Sequence
  chemically synthesized
cttgggagatgccacaaagcac

SEQ ID NO: 144883 - DNA, 22 bp, Artificial Sequence
  chemically synthesized
gggagatgccacaaagcacctg

SEQ ID NO: 144884 - DNA, 22 bp, Artificial Sequence
  chemically synthesized
ggagatgccacaaagcacctgg

SEQ ID NO: 144885 - DNA, 22 bp, Artificial Sequence
  chemically synthesized
gatgatctcaagggcacctttg

SEQ ID NO: 144886 - DNA, 22 bp, Artificial Sequence
  chemically synthesized
aagggcacctttgcccagctga

SEQ ID NO: 144887 - DNA, 22 bp, Artificial Sequence
  chemically synthesized
tgcccagctgagtgaactgcac

SEQ ID NO: 144888 - DNA, 22 bp, Artificial Sequence
  chemically synthesized
gcccagctgagtgaactgcact

SEQ ID NO: 144889 - DNA, 22 bp, Artificial Sequence
  chemically synthesized
cccagctgagtgaactgcactg

SEQ ID NO: 144890 - DNA, 22 bp, Artificial Sequence
  chemically synthesized
agtgaactgcactgtgacaagc

SEQ ID NO: 144891 - DNA, 22 bp, Artificial Sequence
  chemically synthesized
cactgtgacaagctgcatgtgg

SEQ ID NO: 144892 - DNA, 22 bp, Artificial Sequence
  chemically synthesized
tgacaagctgcatgtggatcct

SEQ ID NO: 144893 - DNA, 22 bp, Artificial Sequence
  chemically synthesized
catgtggatcctgagaacttca

SEQ ID NO: 144894 - DNA, 22 bp, Artificial Sequence
  chemically synthesized
agaacttcaaggtgagtccagg

SEQ ID NO: 144895 - DNA, 22 bp, Artificial Sequence
  chemically synthesized
caaggtgagtccaggagatgtt

SEQ ID NO: 144896 - DNA, 22 bp, Artificial Sequence
  chemically synthesized
aaggtgagtccaggagatgttt

SEQ ID NO: 144897 - DNA, 22 bp, Artificial Sequence
  chemically synthesized
cagccctgttgcctttagtctc

SEQ ID NO: 144898 - DNA, 22 bp, Artificial Sequence
  chemically synthesized
agccctgttgcctttagtctcg

SEQ ID NO: 144899 - DNA, 22 bp, Artificial Sequence
  chemically synthesized
ttgcctttagtctcgaggcaac

SEQ ID NO: 144900 - DNA, 22 bp, Artificial Sequence
  chemically synthesized
cctttagtctcgaggcaactta

SEQ ID NO: 144901 - DNA, 22 bp, Artificial Sequence
  chemically synthesized
tagtctcgaggcaacttagaca

SEQ ID NO: 144902 - DNA, 22 bp, Artificial Sequence
  chemically synthesized
agtctcgaggcaacttagacaa

SEQ ID NO: 144903 - DNA, 22 bp, Artificial Sequence
  chemically synthesized
gtctcgaggcaacttagacaac

SEQ ID NO: 144904 - DNA, 22 bp, Artificial Sequence
  chemically synthesized
gaggcaacttagacaacggagt

SEQ ID NO: 144905 - DNA, 22 bp, Artificial Sequence
  chemically synthesized
agacaacggagtattgatctga

SEQ ID NO: 144906 - DNA, 22 bp, Artificial Sequence
  chemically synthesized
gacaacggagtattgatctgag

SEQ ID NO: 144907 - DNA, 22 bp, Artificial Sequence
  chemically synthesized
atctgagcacagcagggtgtga

SEQ ID NO: 144908 - DNA, 22 bp, Artificial Sequence
  chemically synthesized
agcacagcagggtgtgagctgt

SEQ ID NO: 144909 - DNA, 22 bp, Artificial Sequence
  chemically synthesized
tttgaagatactggggttgggg

SEQ ID NO: 144910 - DNA, 22 bp, Artificial Sequence
  chemically synthesized
gaagatactggggttgggggtg

SEQ ID NO: 144911 - DNA, 22 bp, Artificial Sequence
  chemically synthesized
aagatactggggttgggggtga

SEQ ID NO: 144912 - DNA, 22 bp, Artificial Sequence
  chemically synthesized
gggttgggggtgaagaaactgc

SEQ ID NO: 144913 - DNA, 22 bp, Artificial Sequence
  chemically synthesized
ggggtgaagaaactgcagagga

SEQ ID NO: 144914 - DNA, 22 bp, Artificial Sequence
  chemically synthesized
cagaggactaactgggctgaga

SEQ ID NO: 144915 - DNA, 22 bp, Artificial Sequence
  chemically synthesized
actgggctgagacccagtggta

SEQ ID NO: 144916 - DNA, 22 bp, Artificial Sequence
  chemically synthesized
ggctgagacccagtggtaatgt

SEQ ID NO: 144917 - DNA, 22 bp, Artificial Sequence
  chemically synthesized
agacccagtggtaatgttttag

SEQ ID NO: 144918 - DNA, 22 bp, Artificial Sequence
  chemically synthesized
tagggcctaaggagtgcctcta

SEQ ID NO: 144919 - DNA, 22 bp, Artificial Sequence
  chemically synthesized
agggcctaaggagtgcctctaa

SEQ ID NO: 144920 - DNA, 22 bp, Artificial Sequence
  chemically synthesized
gggcctaaggagtgcctctaaa

SEQ ID NO: 144921 - DNA, 22 bp, Artificial Sequence
  chemically synthesized
aggagtgcctctaaaaatctag

SEQ ID NO: 144922 - DNA, 22 bp, Artificial Sequence
  chemically synthesized
taaaaatctagatggacaattt

SEQ ID NO: 144923 - DNA, 22 bp, Artificial Sequence
  chemically synthesized
aaaatctagatggacaattttg

SEQ ID NO: 144924 - DNA, 22 bp, Artificial Sequence
  chemically synthesized
gatggacaattttgactttgag

SEQ ID NO: 144925 - DNA, 22 bp, Artificial Sequence
  chemically synthesized
tgactttgagaaaagagaggtg

SEQ ID NO: 144926 - DNA, 22 bp, Artificial Sequence
  chemically synthesized
gactttgagaaaagagaggtgg

SEQ ID NO: 144927 - DNA, 22 bp, Artificial Sequence
  chemically synthesized
actttgagaaaagagaggtgga

SEQ ID NO: 144928 - DNA, 22 bp, Artificial Sequence
  chemically synthesized
tgagaaaagagaggtggaaatg

SEQ ID NO: 144929 - DNA, 22 bp, Artificial Sequence
  chemically synthesized
gagaaaagagaggtggaaatga

SEQ ID NO: 144930 - DNA, 22 bp, Artificial Sequence
  chemically synthesized
agaaaagagaggtggaaatgag

SEQ ID NO: 144931 - DNA, 22 bp, Artificial Sequence
  chemically synthesized
ttctttattagattccagtaga

SEQ ID NO: 144932 - DNA, 22 bp, Artificial Sequence
  chemically synthesized
tctttattagattccagtagaa

SEQ ID NO: 144933 - DNA, 22 bp, Artificial Sequence
  chemically synthesized
ctttattagattccagtagaaa

SEQ ID NO: 144934 - DNA, 22 bp, Artificial Sequence
  chemically synthesized
tttattagattccagtagaaag

SEQ ID NO: 144935 - DNA, 22 bp, Artificial Sequence
  chemically synthesized
tattagattccagtagaaagaa

SEQ ID NO: 144936 - DNA, 22 bp, Artificial Sequence
  chemically synthesized
attagattccagtagaaagaac

SEQ ID NO: 144937 - DNA, 22 bp, Artificial Sequence
  chemically synthesized
ttagattccagtagaaagaact

SEQ ID NO: 144938 - DNA, 22 bp, Artificial Sequence
  chemically synthesized
gattccagtagaaagaactttc

SEQ ID NO: 144939 - DNA, 22 bp, Artificial Sequence
  chemically synthesized
cagtagaaagaactttcatctt

SEQ ID NO: 144940 - DNA, 22 bp, Artificial Sequence
  chemically synthesized
tcatctttccctcatttttgtt

SEQ ID NO: 144941 - DNA, 22 bp, Artificial Sequence
  chemically synthesized
catctttccctcatttttgttg

SEQ ID NO: 144942 - DNA, 22 bp, Artificial Sequence
  chemically synthesized
atctttccctcatttttgttgt

SEQ ID NO: 144943 - DNA, 22 bp, Artificial Sequence
  chemically synthesized
tccctcatttttgttgttttaa

SEQ ID NO: 144944 - DNA, 22 bp, Artificial Sequence
  chemically synthesized
ccctcatttttgttgttttaaa

SEQ ID NO: 144945 - DNA, 22 bp, Artificial Sequence
  chemically synthesized
cctcatttttgttgttttaaaa

SEQ ID NO: 144946 - DNA, 22 bp, Artificial Sequence
  chemically synthesized
atttttgttgttttaaaacatc

SEQ ID NO: 144947 - DNA, 22 bp, Artificial Sequence
  chemically synthesized
ttgttgttttaaaacatctatc

SEQ ID NO: 144948 - DNA, 22 bp, Artificial Sequence
  chemically synthesized
tgttgttttaaaacatctatct

SEQ ID NO: 144949 - DNA, 22 bp, Artificial Sequence
  chemically synthesized
gttgttttaaaacatctatctg

SEQ ID NO: 144950 - DNA, 22 bp, Artificial Sequence
  chemically synthesized
ttgttttaaaacatctatctgg

SEQ ID NO: 144951 - DNA, 22 bp, Artificial Sequence
  chemically synthesized
ttttaaaacatctatctggagg

SEQ ID NO: 144952 - DNA, 22 bp, Artificial Sequence
  chemically synthesized
taaaacatctatctggaggcag

SEQ ID NO: 144953 - DNA, 22 bp, Artificial Sequence
  chemically synthesized
aaaacatctatctggaggcagg

SEQ ID NO: 144954 - DNA, 22 bp, Artificial Sequence
  chemically synthesized
aaacatctatctggaggcagga

SEQ ID NO: 144955 - DNA, 22 bp, Artificial Sequence
  chemically synthesized
tctggaggcaggacaagtatgg

SEQ ID NO: 144956 - DNA, 22 bp, Artificial Sequence
  chemically synthesized
gaggcaggacaagtatggtcgt

SEQ ID NO: 144957 - DNA, 22 bp, Artificial Sequence
  chemically synthesized
aaaagatgcaggcagaaggcat

SEQ ID NO: 144958 - DNA, 22 bp, Artificial Sequence
  chemically synthesized
gctcagtcaaagtggggaactt

SEQ ID NO: 144959 - DNA, 22 bp, Artificial Sequence
  chemically synthesized
agtcaaagtggggaactttggt

SEQ ID NO: 144960 - DNA, 22 bp, Artificial Sequence
  chemically synthesized
tggtggccaaacatacattgct

SEQ ID NO: 144961 - DNA, 22 bp, Artificial Sequence
  chemically synthesized
ggtggccaaacatacattgcta

SEQ ID NO: 144962 - DNA, 22 bp, Artificial Sequence
  chemically synthesized
gtggccaaacatacattgctaa

SEQ ID NO: 144963 - DNA, 22 bp, Artificial Sequence
  chemically synthesized
ctaaggctattcctatatcagc

SEQ ID NO: 144964 - DNA, 22 bp, Artificial Sequence
  chemically synthesized
aggctattcctatatcagctgg

SEQ ID NO: 144965 - DNA, 22 bp, Artificial Sequence
  chemically synthesized
ttcctatatcagctggacacat

SEQ ID NO: 144966 - DNA, 22 bp, Artificial Sequence
  chemically synthesized
ctatatcagctggacacatata

SEQ ID NO: 144967 - DNA, 22 bp, Artificial Sequence
  chemically synthesized
tatcagctggacacatataaaa

SEQ ID NO: 144968 - DNA, 22 bp, Artificial Sequence
  chemically synthesized
gacacatataaaatgctgctaa

SEQ ID NO: 144969 - DNA, 22 bp, Artificial Sequence
  chemically synthesized
ctaatgcttcattacaaactta

SEQ ID NO: 144970 - DNA, 22 bp, Artificial Sequence
  chemically synthesized
atgcttcattacaaacttatat

SEQ ID NO: 144971 - DNA, 22 bp, Artificial Sequence
  chemically synthesized
cattacaaacttatatccttta

SEQ ID NO: 144972 - DNA, 22 bp, Artificial Sequence
  chemically synthesized
attacaaacttatatcctttaa

SEQ ID NO: 144973 - DNA, 22 bp, Artificial Sequence
  chemically synthesized
caaacttatatcctttaattcc

SEQ ID NO: 144974 - DNA, 22 bp, Artificial Sequence
  chemically synthesized
atatcctttaattccagatggg

SEQ ID NO: 144975 - DNA, 22 bp, Artificial Sequence
  chemically synthesized
tatcctttaattccagatgggg

SEQ ID NO: 144976 - DNA, 22 bp, Artificial Sequence
  chemically synthesized
taattccagatgggggcaaagt

SEQ ID NO: 144977 - DNA, 22 bp, Artificial Sequence
  chemically synthesized
aattccagatgggggcaaagta

SEQ ID NO: 144978 - DNA, 22 bp, Artificial Sequence
  chemically synthesized
attccagatgggggcaaagtat

SEQ ID NO: 144979 - DNA, 22 bp, Artificial Sequence
  chemically synthesized
cagatgggggcaaagtatgtcc

SEQ ID NO: 144980 - DNA, 22 bp, Artificial Sequence
  chemically synthesized
aaacatttgggctggagtagat

SEQ ID NO: 144981 - DNA, 22 bp, Artificial Sequence
  chemically synthesized
gggctggagtagattttgaaag

SEQ ID NO: 144982 - DNA, 22 bp, Artificial Sequence
  chemically synthesized
ggctggagtagattttgaaagt

SEQ ID NO: 144983 - DNA, 22 bp, Artificial Sequence
  chemically synthesized
gagtagattttgaaagtcagct

SEQ ID NO: 144984 - DNA, 22 bp, Artificial Sequence
  chemically synthesized
tgaaagtcagctctgtgtgtgt

SEQ ID NO: 144985 - DNA, 22 bp, Artificial Sequence
  chemically synthesized
gaaagtcagctctgtgtgtgtg

SEQ ID NO: 144986 - DNA, 22 bp, Artificial Sequence
  chemically synthesized
aaagtcagctctgtgtgtgtgt

SEQ ID NO: 144987 - DNA, 22 bp, Artificial Sequence
  chemically synthesized
tgtgtgtgtgtgtgtgtgtgcg

SEQ ID NO: 144988 - DNA, 22 bp, Artificial Sequence
  chemically synthesized
tgtgtgtgtgtgtgtgtgcgcg

SEQ ID NO: 144989 - DNA, 22 bp, Artificial Sequence
  chemically synthesized
cttttaacgtcttcagcctaca

SEQ ID NO: 144990 - DNA, 22 bp, Artificial Sequence
  chemically synthesized
ttttaacgtcttcagcctacaa

SEQ ID NO: 144991 - DNA, 22 bp, Artificial Sequence
  chemically synthesized
ttaacgtcttcagcctacaaca

SEQ ID NO: 144992 - DNA, 22 bp, Artificial Sequence
  chemically synthesized
taacgtcttcagcctacaacat

SEQ ID NO: 144993 - DNA, 22 bp, Artificial Sequence
  chemically synthesized
aacgtcttcagcctacaacata

SEQ ID NO: 144994 - DNA, 22 bp, Artificial Sequence
  chemically synthesized
acgtcttcagcctacaacatac

SEQ ID NO: 144995 - DNA, 22 bp, Artificial Sequence
  chemically synthesized
cagcctacaacatacagggttc

SEQ ID NO: 144996 - DNA, 22 bp, Artificial Sequence
  chemically synthesized
agcctacaacatacagggttca

SEQ ID NO: 144997 - DNA, 22 bp, Artificial Sequence
  chemically synthesized
caacatacagggttcatggtgg

SEQ ID NO: 144998 - DNA, 22 bp, Artificial Sequence
  chemically synthesized
atggtggcaagaagatagcaag

SEQ ID NO: 144999 - DNA, 22 bp, Artificial Sequence
  chemically synthesized
aaattatggccagtgactagtg

SEQ ID NO: 145000 - DNA, 22 bp, Artificial Sequence
  chemically synthesized
aattatggccagtgactagtgc

SEQ ID NO: 145001 - DNA, 22 bp, Artificial Sequence
  chemically synthesized
tggccagtgactagtgcttgaa

SEQ ID NO: 145002 - DNA, 22 bp, Artificial Sequence
  chemically synthesized
gtgcttgaaggggaacaactac

SEQ ID NO: 145003 - DNA, 22 bp, Artificial Sequence
  chemically synthesized
gaaggggaacaactacctgcat

SEQ ID NO: 145004 - DNA, 22 bp, Artificial Sequence
  chemically synthesized
aaggggaacaactacctgcatt

SEQ ID NO: 145005 - DNA, 22 bp, Artificial Sequence
  chemically synthesized
cctgcatttaatgggaaggcaa

SEQ ID NO: 145006 - DNA, 22 bp, Artificial Sequence
  chemically synthesized
catttaatgggaaggcaaaatc

SEQ ID NO: 145007 - DNA, 22 bp, Artificial Sequence
  chemically synthesized
aatgggaaggcaaaatctcagg

SEQ ID NO: 145008 - DNA, 22 bp, Artificial Sequence
  chemically synthesized
atgggaaggcaaaatctcaggc

SEQ ID NO: 145009 - DNA, 22 bp, Artificial Sequence
  chemically synthesized
aggctttgagggaagttaacat

SEQ ID NO: 145010 - DNA, 22 bp, Artificial Sequence
  chemically synthesized
tgagggaagttaacataggctt

SEQ ID NO: 145011 - DNA, 22 bp, Artificial Sequence
  chemically synthesized
gagggaagttaacataggcttg

SEQ ID NO: 145012 - DNA, 22 bp, Artificial Sequence
  chemically synthesized
agggaagttaacataggcttga

SEQ ID NO: 145013 - DNA, 22 bp, Artificial Sequence
  chemically synthesized
acataggcttgattctgggtgg

SEQ ID NO: 145014 - DNA, 22 bp, Artificial Sequence
  chemically synthesized
gattctgggtggaagcttggtg

SEQ ID NO: 145015 - DNA, 22 bp, Artificial Sequence
  chemically synthesized
attctgggtggaagcttggtgt

SEQ ID NO: 145016 - DNA, 22 bp, Artificial Sequence
  chemically synthesized
tgggtggaagcttggtgtgtag

SEQ ID NO: 145017 - DNA, 22 bp, Artificial Sequence
  chemically synthesized
ggtggaagcttggtgtgtagtt

SEQ ID NO: 145018 - DNA, 22 bp, Artificial Sequence
  chemically synthesized
ggtgtgtagttatctggaggcc

SEQ ID NO: 145019 - DNA, 22 bp, Artificial Sequence
  chemically synthesized
gtgtgtagttatctggaggcca

SEQ ID NO: 145020 - DNA, 22 bp, Artificial Sequence
  chemically synthesized
tctggaggccaggctggagctc

SEQ ID NO: 145021 - DNA, 22 bp, Artificial Sequence
  chemically synthesized
gaggccaggctggagctctcag

SEQ ID NO: 145022 - DNA, 22 bp, Artificial Sequence
  chemically synthesized
gagctctcagctcactatgggt

SEQ ID NO: 145023 - DNA, 22 bp, Artificial Sequence
  chemically synthesized
tcagctcactatgggttcatct

SEQ ID NO: 145024 - DNA, 22 bp, Artificial Sequence
  chemically synthesized
agctcactatgggttcatcttt

SEQ ID NO: 145025 - DNA, 22 bp, Artificial Sequence
  chemically synthesized
actatgggttcatctttattgt

SEQ ID NO: 145026 - DNA, 22 bp, Artificial Sequence
  chemically synthesized
tgggttcatctttattgtctcc

SEQ ID NO: 145027 - DNA, 22 bp, Artificial Sequence
  chemically synthesized
atctttattgtctcctttcatc

SEQ ID NO: 145028 - DNA, 22 bp, Artificial Sequence
  chemically synthesized
tattgtctcctttcatctcaac

SEQ ID NO: 145029 - DNA, 22 bp, Artificial Sequence
  chemically synthesized
attgtctcctttcatctcaaca

SEQ ID NO: 145030 - DNA, 22 bp, Artificial Sequence
  chemically synthesized
ttgtctcctttcatctcaacag

SEQ ID NO: 145031 - DNA, 22 bp, Artificial Sequence
  chemically synthesized
tctcctttcatctcaacagctc

SEQ ID NO: 145032 - DNA, 22 bp, Artificial Sequence
  chemically synthesized
ctttcatctcaacagctcctgg

SEQ ID NO: 145033 - DNA, 22 bp, Artificial Sequence
  chemically synthesized
tcatctcaacagctcctgggaa

SEQ ID NO: 145034 - DNA, 22 bp, Artificial Sequence
  chemically synthesized
catctcaacagctcctgggaaa

SEQ ID NO: 145035 - DNA, 22 bp, Artificial Sequence
  chemically synthesized
atctcaacagctcctgggaaat

SEQ ID NO: 145036 - DNA, 22 bp, Artificial Sequence
  chemically synthesized
aacagctcctgggaaatgtgct

SEQ ID NO: 145037 - DNA, 22 bp, Artificial Sequence
  chemically synthesized
ctgggaaatgtgctggtgaccg

SEQ ID NO: 145038 - DNA, 22 bp, Artificial Sequence
  chemically synthesized
ggaaatgtgctggtgaccgttt

SEQ ID NO: 145039 - DNA, 22 bp, Artificial Sequence
  chemically synthesized
gtgaccgttttggcaatccatt

SEQ ID NO: 145040 - DNA, 22 bp, Artificial Sequence
  chemically synthesized
tggcaatccatttcggcaaaga

SEQ ID NO: 145041 - DNA, 22 bp, Artificial Sequence
  chemically synthesized
ggcaatccatttcggcaaagaa

SEQ ID NO: 145042 - DNA, 22 bp, Artificial Sequence
  chemically synthesized
gcaatccatttcggcaaagaat

SEQ ID NO: 145043 - DNA, 22 bp, Artificial Sequence
  chemically synthesized
cggcaaagaattcacccctgag

SEQ ID NO: 145044 - DNA, 22 bp, Artificial Sequence
  chemically synthesized
ggcaaagaattcacccctgagg

SEQ ID NO: 145045 - DNA, 22 bp, Artificial Sequence
  chemically synthesized
acccctgaggtgcaggcttcct

SEQ ID NO: 145046 - DNA, 22 bp, Artificial Sequence
  chemically synthesized
aggtgcaggcttcctggcagaa

SEQ ID NO: 145047 - DNA, 22 bp, Artificial Sequence
  chemically synthesized
cctggcagaagatggtgactgc

SEQ ID NO: 145048 - DNA, 22 bp, Artificial Sequence
  chemically synthesized
ctggcagaagatggtgactgca

SEQ ID NO: 145049 - DNA, 22 bp, Artificial Sequence
  chemically synthesized
gcagaagatggtgactgcagtg

SEQ ID NO: 145050 - DNA, 22 bp, Artificial Sequence
  chemically synthesized
cagtggccagtgccctgtcctc

SEQ ID NO: 145051 - DNA, 22 bp, Artificial Sequence
  chemically synthesized
tcctccagataccactgagctc

SEQ ID NO: 145052 - DNA, 22 bp, Artificial Sequence
  chemically synthesized
cagataccactgagctcactgc

SEQ ID NO: 145053 - DNA, 22 bp, Artificial Sequence
  chemically synthesized
agctcactgcccatgattcaga

SEQ ID NO: 145054 - DNA, 22 bp, Artificial Sequence
  chemically synthesized
actgcccatgattcagagcttt

SEQ ID NO: 145055 - DNA, 22 bp, Artificial Sequence
  chemically synthesized
cccatgattcagagctttcaag

SEQ ID NO: 145056 - DNA, 22 bp, Artificial Sequence
  chemically synthesized
agagctttcaaggataggcttt

SEQ ID NO: 145057 - DNA, 22 bp, Artificial Sequence
  chemically synthesized
tcaaggataggctttattctgc

SEQ ID NO: 145058 - DNA, 22 bp, Artificial Sequence
  chemically synthesized
caaggataggctttattctgca

SEQ ID NO: 145059 - DNA, 22 bp, Artificial Sequence
  chemically synthesized
aaggataggctttattctgcaa

SEQ ID NO: 145060 - DNA, 22 bp, Artificial Sequence
  chemically synthesized
tattctgcaagcaatacaaata

SEQ ID NO: 145061 - DNA, 22 bp, Artificial Sequence
  chemically synthesized
attctgcaagcaatacaaataa

SEQ ID NO: 145062 - DNA, 22 bp, Artificial Sequence
  chemically synthesized
ttctgcaagcaatacaaataat

SEQ ID NO: 145063 - DNA, 22 bp, Artificial Sequence
  chemically synthesized
tgcaagcaatacaaataataaa

SEQ ID NO: 145064 - DNA, 22 bp, Artificial Sequence
  chemically synthesized
caagcaatacaaataataaatc

SEQ ID NO: 145065 - DNA, 22 bp, Artificial Sequence
  chemically synthesized
ttctgctgagagatcacacatg

SEQ ID NO: 145066 - DNA, 22 bp, Artificial Sequence
  chemically synthesized
tgctgagagatcacacatgatt

SEQ ID NO: 145067 - DNA, 22 bp, Artificial Sequence
  chemically synthesized
ctgagagatcacacatgatttt

SEQ ID NO: 145068 - DNA, 22 bp, Artificial Sequence
  chemically synthesized
agagatcacacatgattttctt

SEQ ID NO: 145069 - DNA, 22 bp, Artificial Sequence
  chemically synthesized
tcttcagctcttttttttacat

SEQ ID NO: 145070 - DNA, 22 bp, Artificial Sequence
  chemically synthesized
cttcagctcttttttttacatc

SEQ ID NO: 145071 - DNA, 22 bp, Artificial Sequence
  chemically synthesized
ttcagctcttttttttacatct

SEQ ID NO: 145072 - DNA, 22 bp, Artificial Sequence
  chemically synthesized
cagctcttttttttacatcttt

SEQ ID NO: 145073 - DNA, 22 bp, Artificial Sequence
  chemically synthesized
agctcttttttttacatctttt

SEQ ID NO: 145074 - DNA, 22 bp, Artificial Sequence
  chemically synthesized
ttttttttacatctttttaaat

SEQ ID NO: 145075 - DNA, 22 bp, Artificial Sequence
  chemically synthesized
ttttttacatctttttaaatat

SEQ ID NO: 145076 - DNA, 22 bp, Artificial Sequence
  chemically synthesized
tttttacatctttttaaatata

SEQ ID NO: 145077 - DNA, 22 bp, Artificial Sequence
  chemically synthesized
ttttacatctttttaaatatat

SEQ ID NO: 145078 - DNA, 22 bp, Artificial Sequence
  chemically synthesized
tttacatctttttaaatatatg

SEQ ID NO: 145079 - DNA, 22 bp, Artificial Sequence
  chemically synthesized
ttacatctttttaaatatatga

SEQ ID NO: 145080 - DNA, 22 bp, Artificial Sequence
  chemically synthesized
tacatctttttaaatatatgag

SEQ ID NO: 145081 - DNA, 22 bp, Artificial Sequence
  chemically synthesized
acatctttttaaatatatgagc

SEQ ID NO: 145082 - DNA, 22 bp, Artificial Sequence
  chemically synthesized
catctttttaaatatatgagcc

SEQ ID NO: 145083 - DNA, 22 bp, Artificial Sequence
  chemically synthesized
tttaaatatatgagccacaaag

SEQ ID NO: 145084 - DNA, 22 bp, Artificial Sequence
  chemically synthesized
ttaaatatatgagccacaaagg

SEQ ID NO: 145085 - DNA, 22 bp, Artificial Sequence
  chemically synthesized
taaatatatgagccacaaaggg

SEQ ID NO: 145086 - DNA, 22 bp, Artificial Sequence
  chemically synthesized
aaatatatgagccacaaagggt

SEQ ID NO: 145087 - DNA, 22 bp, Artificial Sequence
  chemically synthesized
aatatatgagccacaaagggtt

SEQ ID NO: 145088 - DNA, 22 bp, Artificial Sequence
  chemically synthesized
atattgagggaagtgtgtatgt

SEQ ID NO: 145089 - DNA, 22 bp, Artificial Sequence
  chemically synthesized
tattgagggaagtgtgtatgtg

SEQ ID NO: 145090 - DNA, 22 bp, Artificial Sequence
  chemically synthesized
agggaagtgtgtatgtgtattt

SEQ ID NO: 145091 - DNA, 22 bp, Artificial Sequence
  chemically synthesized
ctgcatgcctgtttgtgtttgt

SEQ ID NO: 145092 - DNA, 22 bp, Artificial Sequence
  chemically synthesized
tgcatgcctgtttgtgtttgtg

SEQ ID NO: 145093 - DNA, 22 bp, Artificial Sequence
  chemically synthesized
catgcctgtttgtgtttgtggt

SEQ ID NO: 145094 - DNA, 22 bp, Artificial Sequence
  chemically synthesized
tttgtgtttgtggtgtgtgcat

SEQ ID NO: 145095 - DNA, 22 bp, Artificial Sequence
  chemically synthesized
gtgtttgtggtgtgtgcatgct

SEQ ID NO: 145096 - DNA, 22 bp, Artificial Sequence
  chemically synthesized
tgtttgtggtgtgtgcatgctc

SEQ ID NO: 145097 - DNA, 22 bp, Artificial Sequence
  chemically synthesized
gtggtgtgtgcatgctcctcat

SEQ ID NO: 145098 - DNA, 22 bp, Artificial Sequence
  chemically synthesized
tggtgtgtgcatgctcctcatt

SEQ ID NO: 145099 - DNA, 22 bp, Artificial Sequence
  chemically synthesized
ctcatttatttttatatgagat

SEQ ID NO: 145100 - DNA, 22 bp, Artificial Sequence
  chemically synthesized
atttatttttatatgagatgtg

SEQ ID NO: 145101 - DNA, 22 bp, Artificial Sequence
  chemically synthesized
atttttatatgagatgtgcatt

SEQ ID NO: 145102 - DNA, 22 bp, Artificial Sequence
  chemically synthesized
tttttatatgagatgtgcattt

SEQ ID NO: 145103 - DNA, 22 bp, Artificial Sequence
  chemically synthesized
ttatatgagatgtgcattttga

SEQ ID NO: 145104 - DNA, 22 bp, Artificial Sequence
  chemically synthesized
tatatgagatgtgcattttgat

SEQ ID NO: 145105 - DNA, 22 bp, Artificial Sequence
  chemically synthesized
atatgagatgtgcattttgatg

SEQ ID NO: 145106 - DNA, 22 bp, Artificial Sequence
  chemically synthesized
tatgagatgtgcattttgatga

SEQ ID NO: 145107 - DNA, 22 bp, Artificial Sequence
  chemically synthesized
tgatgagcaaataaaagcagta

SEQ ID NO: 145108 - DNA, 22 bp, Artificial Sequence
  chemically synthesized
gatgagcaaataaaagcagtaa

SEQ ID NO: 145109 - DNA, 22 bp, Artificial Sequence
  chemically synthesized
atgagcaaataaaagcagtaaa

SEQ ID NO: 145110 - DNA, 22 bp, Artificial Sequence
  chemically synthesized
gtacacgggagttctgcaagtg

SEQ ID NO: 145111 - DNA, 22 bp, Artificial Sequence
  chemically synthesized
tacacgggagttctgcaagtgg

SEQ ID NO: 145112 - DNA, 22 bp, Artificial Sequence
  chemically synthesized
tgcaagtgggagtaaatggtgt

SEQ ID NO: 145113 - DNA, 22 bp, Artificial Sequence
  chemically synthesized
caagtgggagtaaatggtgtag

SEQ ID NO: 145114 - DNA, 22 bp, Artificial Sequence
  chemically synthesized
tataggacaggacttctcagaa

SEQ ID NO: 145115 - DNA, 22 bp, Artificial Sequence
  chemically synthesized
taggacaggacttctcagaaac

SEQ ID NO: 145116 - DNA, 22 bp, Artificial Sequence
  chemically synthesized
ctcagaaacagatgttttggaa

SEQ ID NO: 145117 - DNA, 22 bp, Artificial Sequence
  chemically synthesized
tcagaaacagatgttttggaag

SEQ ID NO: 145118 - DNA, 22 bp, Artificial Sequence
  chemically synthesized
agaaacagatgttttggaagag

SEQ ID NO: 145119 - DNA, 22 bp, Artificial Sequence
  chemically synthesized
tggaagagatgggaaaaggttc

SEQ ID NO: 145120 - DNA, 22 bp, Artificial Sequence
  chemically synthesized
ggaagagatgggaaaaggttca

SEQ ID NO: 145121 - DNA, 22 bp, Artificial Sequence
  chemically synthesized
gaagagatgggaaaaggttcag

SEQ ID NO: 145122 - DNA, 22 bp, Artificial Sequence
  chemically synthesized
agtgaagacctgggggctggat

SEQ ID NO: 145123 - DNA, 22 bp, Artificial Sequence
  chemically synthesized
ggggctggattgattgcagctg

SEQ ID NO: 145124 - DNA, 22 bp, Artificial Sequence
  chemically synthesized
gattgattgcagctgagtagca

SEQ ID NO: 145125 - DNA, 22 bp, Artificial Sequence
  chemically synthesized
attgcagctgagtagcaaggat

SEQ ID NO: 145126 - DNA, 22 bp, Artificial Sequence
  chemically synthesized
cagctgagtagcaaggatggtt

SEQ ID NO: 145127 - DNA, 22 bp, Artificial Sequence
  chemically synthesized
agtagcaaggatggttcttaag

SEQ ID NO: 145128 - DNA, 22 bp, Artificial Sequence
  chemically synthesized
ttaaggaagggaaagtgttcca

SEQ ID NO: 145129 - DNA, 22 bp, Artificial Sequence
  chemically synthesized
aaggaagggaaagtgttccaag

SEQ ID NO: 145130 - DNA, 22 bp, Artificial Sequence
  chemically synthesized
aggaagggaaagtgttccaagc

SEQ ID NO: 145131 - DNA, 22 bp, Artificial Sequence
  chemically synthesized
caagctttaggaattcaaggtt

SEQ ID NO: 145132 - DNA, 22 bp, Artificial Sequence
  chemically synthesized
taggaattcaaggtttagtcag

SEQ ID NO: 145133 - DNA, 22 bp, Artificial Sequence
  chemically synthesized
aggaattcaaggtttagtcagg

SEQ ID NO: 145134 - DNA, 22 bp, Artificial Sequence
  chemically synthesized
ggaattcaaggtttagtcaggt

SEQ ID NO: 145135 - DNA, 22 bp, Artificial Sequence
  chemically synthesized
aaggtttagtcaggtgtagcaa

SEQ ID NO: 145136 - DNA, 22 bp, Artificial Sequence
  chemically synthesized
agtcaggtgtagcaattctatt

SEQ ID NO: 145137 - DNA, 22 bp, Artificial Sequence
  chemically synthesized
gtcaggtgtagcaattctattt

SEQ ID NO: 145138 - DNA, 22 bp, Artificial Sequence
  chemically synthesized
tattttattaggaggaatacta

SEQ ID NO: 145139 - DNA, 22 bp, Artificial Sequence
  chemically synthesized
ttttattaggaggaatactatt

SEQ ID NO: 145140 - DNA, 22 bp, Artificial Sequence
  chemically synthesized
tattaggaggaatactatttct

SEQ ID NO: 145141 - DNA, 22 bp, Artificial Sequence
  chemically synthesized
attaggaggaatactatttcta

SEQ ID NO: 145142 - DNA, 22 bp, Artificial Sequence
  chemically synthesized
ttaggaggaatactatttctaa

SEQ ID NO: 145143 - DNA, 22 bp, Artificial Sequence
  chemically synthesized
ggaggaatactatttctaatgg

SEQ ID NO: 145144 - DNA, 22 bp, Artificial Sequence
  chemically synthesized
tttctaatggcacttagctttt

SEQ ID NO: 145145 - DNA, 22 bp, Artificial Sequence
  chemically synthesized
ctaatggcacttagcttttcac

SEQ ID NO: 145146 - DNA, 22 bp, Artificial Sequence
  chemically synthesized
taatggcacttagcttttcaca

SEQ ID NO: 145147 - DNA, 22 bp, Artificial Sequence
  chemically synthesized
atggcacttagcttttcacagc

SEQ ID NO: 145148 - DNA, 22 bp, Artificial Sequence
  chemically synthesized
agcttttcacagcccttgtgga

SEQ ID NO: 145149 - DNA, 22 bp, Artificial Sequence
  chemically synthesized
gcttttcacagcccttgtggat

SEQ ID NO: 145150 - DNA, 22 bp, Artificial Sequence
  chemically synthesized
ttcacagcccttgtggatgcct

SEQ ID NO: 145151 - DNA, 22 bp, Artificial Sequence
  chemically synthesized
tcacagcccttgtggatgccta

SEQ ID NO: 145152 - DNA, 22 bp, Artificial Sequence
  chemically synthesized
cacagcccttgtggatgcctaa

SEQ ID NO: 145153 - DNA, 22 bp, Artificial Sequence
  chemically synthesized
acagcccttgtggatgcctaag

SEQ ID NO: 145154 - DNA, 22 bp, Artificial Sequence
  chemically synthesized
gtggatgcctaagaaagtgaaa

SEQ ID NO: 145155 - DNA, 22 bp, Artificial Sequence
  chemically synthesized
tggatgcctaagaaagtgaaat

SEQ ID NO: 145156 - DNA, 22 bp, Artificial Sequence
  chemically synthesized
agaaagtgaaattaatcccatg

SEQ ID NO: 145157 - DNA, 22 bp, Artificial Sequence
  chemically synthesized
atcccatgccctcaagtgtgca

SEQ ID NO: 145158 - DNA, 22 bp, Artificial Sequence
  chemically synthesized
aagtgtgcagattggtcacagc

SEQ ID NO: 145159 - DNA, 22 bp, Artificial Sequence
  chemically synthesized
gtcacagcatttcaagggagag

SEQ ID NO: 145160 - DNA, 22 bp, Artificial Sequence
  chemically synthesized
caagggagagacctcattgtaa

SEQ ID NO: 145161 - DNA, 22 bp, Artificial Sequence
  chemically synthesized
aagggagagacctcattgtaag

SEQ ID NO: 145162 - DNA, 22 bp, Artificial Sequence
  chemically synthesized
attgtaagactctgggggaggt

SEQ ID NO: 145163 - DNA, 22 bp, Artificial Sequence
  chemically synthesized
taagactctgggggaggtgggg

SEQ ID NO: 145164 - DNA, 22 bp, Artificial Sequence
  chemically synthesized
tgggggaggtggggacttaggt

SEQ ID NO: 145165 - DNA, 22 bp, Artificial Sequence
  chemically synthesized
ggggaggtggggacttaggtgt

SEQ ID NO: 145166 - DNA, 22 bp, Artificial Sequence
  chemically synthesized
aggtgtaagaaatgaatcagca

SEQ ID NO: 145167 - DNA, 22 bp, Artificial Sequence
  chemically synthesized
ggtgtaagaaatgaatcagcag

SEQ ID NO: 145168 - DNA, 22 bp, Artificial Sequence
  chemically synthesized
acaagtcagcatgagcatgtta

SEQ ID NO: 145169 - DNA, 22 bp, Artificial Sequence
  chemically synthesized
tgtctgagaaacagaccagcac

SEQ ID NO: 145170 - DNA, 22 bp, Artificial Sequence
  chemically synthesized
agaaacagaccagcactgtgag

SEQ ID NO: 145171 - DNA, 22 bp, Artificial Sequence
  chemically synthesized
tgagatcaaaatgtagtgggaa

SEQ ID NO: 145172 - DNA, 22 bp, Artificial Sequence
  chemically synthesized
gtacaacattaattggaaggct

SEQ ID NO: 145173 - DNA, 22 bp, Artificial Sequence
  chemically synthesized
tacaacattaattggaaggctt

SEQ ID NO: 145174 - DNA, 22 bp, Artificial Sequence
  chemically synthesized
attggaaggcttacttaatgga

SEQ ID NO: 145175 - DNA, 22 bp, Artificial Sequence
  chemically synthesized
gaaggcttacttaatggaattt

SEQ ID NO: 145176 - DNA, 22 bp, Artificial Sequence
  chemically synthesized
acttaatggaatttttgtatag

SEQ ID NO: 145177 - DNA, 22 bp, Artificial Sequence
  chemically synthesized
cttaatggaatttttgtatagt

SEQ ID NO: 145178 - DNA, 22 bp, Artificial Sequence
  chemically synthesized
aatggaatttttgtatagttgg

SEQ ID NO: 145179 - DNA, 22 bp, Artificial Sequence
  chemically synthesized
atggaatttttgtatagttgga

SEQ ID NO: 145180 - DNA, 22 bp, Artificial Sequence
  chemically synthesized
ttgtatagttggatgttagtgc

SEQ ID NO: 145181 - DNA, 22 bp, Artificial Sequence
  chemically synthesized
tgtatagttggatgttagtgca

SEQ ID NO: 145182 - DNA, 22 bp, Artificial Sequence
  chemically synthesized
gtatagttggatgttagtgcat

SEQ ID NO: 145183 - DNA, 22 bp, Artificial Sequence
  chemically synthesized
tatagttggatgttagtgcatc

SEQ ID NO: 145184 - DNA, 22 bp, Artificial Sequence
  chemically synthesized
gatgttagtgcatctctataag

SEQ ID NO: 145185 - DNA, 22 bp, Artificial Sequence
  chemically synthesized
gtgcatctctataagtaagagt

SEQ ID NO: 145186 - DNA, 22 bp, Artificial Sequence
  chemically synthesized
tataagtaagagtttaatatga

SEQ ID NO: 145187 - DNA, 22 bp, Artificial Sequence
  chemically synthesized
taagtaagagtttaatatgatg

SEQ ID NO: 145188 - DNA, 22 bp, Artificial Sequence
  chemically synthesized
aatatgatggtgttacggacct

SEQ ID NO: 145189 - DNA, 22 bp, Artificial Sequence
  chemically synthesized
atatgatggtgttacggaccta

SEQ ID NO: 145190 - DNA, 22 bp, Artificial Sequence
  chemically synthesized
cggacctaatgtttgtgtctcc

SEQ ID NO: 145191 - DNA, 22 bp, Artificial Sequence
  chemically synthesized
atgtttgtgtctcctcaaaatt

SEQ ID NO: 145192 - DNA, 22 bp, Artificial Sequence
  chemically synthesized
gtgtctcctcaaaattcacatg

SEQ ID NO: 145193 - DNA, 22 bp, Artificial Sequence
  chemically synthesized
tgtctcctcaaaattcacatgc

SEQ ID NO: 145194 - DNA, 22 bp, Artificial Sequence
  chemically synthesized
ctcaaaattcacatgctgaatc

SEQ ID NO: 145195 - DNA, 22 bp, Artificial Sequence
  chemically synthesized
aaaattcacatgctgaatcccc

SEQ ID NO: 145196 - DNA, 22 bp, Artificial Sequence
  chemically synthesized
acatgctgaatccccaactccc

SEQ ID NO: 145197 - DNA, 22 bp, Artificial Sequence
  chemically synthesized
aatccccaactcccaactgacc

SEQ ID NO: 145198 - DNA, 22 bp, Artificial Sequence
  chemically synthesized
ccaactgaccttatctgtgggg

SEQ ID NO: 145199 - DNA, 22 bp, Artificial Sequence
  chemically synthesized
accttatctgtgggggaggctt

SEQ ID NO: 145200 - DNA, 22 bp, Artificial Sequence
  chemically synthesized
atctgtgggggaggcttttgaa

SEQ ID NO: 145201 - DNA, 22 bp, Artificial Sequence
  chemically synthesized
tctgtgggggaggcttttgaaa

SEQ ID NO: 145202 - DNA, 22 bp, Artificial Sequence
  chemically synthesized
tgggggaggcttttgaaaagta

SEQ ID NO: 145203 - DNA, 22 bp, Artificial Sequence
  chemically synthesized
ttgaaaagtaattaggtttaga

SEQ ID NO: 145204 - DNA, 22 bp, Artificial Sequence
  chemically synthesized
tgaaaagtaattaggtttagat

SEQ ID NO: 145205 - DNA, 22 bp, Artificial Sequence
  chemically synthesized
gaaaagtaattaggtttagatg

SEQ ID NO: 145206 - DNA, 22 bp, Artificial Sequence
  chemically synthesized
aaaagtaattaggtttagatga

SEQ ID NO: 145207 - DNA, 22 bp, Artificial Sequence
  chemically synthesized
ggtttagatgagctcataagag

SEQ ID NO: 145208 - DNA, 22 bp, Artificial Sequence
  chemically synthesized
agatgagctcataagagcagat

SEQ ID NO: 145209 - DNA, 22 bp, Artificial Sequence
  chemically synthesized
gatgagctcataagagcagatc

SEQ ID NO: 145210 - DNA, 22 bp, Artificial Sequence
  chemically synthesized
ataagagcagatccccatcata

SEQ ID NO: 145211 - DNA, 22 bp, Artificial Sequence
  chemically synthesized
ttttccttatcagaagcagaga

SEQ ID NO: 145212 - DNA, 22 bp, Artificial Sequence
  chemically synthesized
tccttatcagaagcagagagac

SEQ ID NO: 145213 - DNA, 22 bp, Artificial Sequence
  chemically synthesized
ccttatcagaagcagagagaca

SEQ ID NO: 145214 - DNA, 22 bp, Artificial Sequence
  chemically synthesized
cttatcagaagcagagagacaa

SEQ ID NO: 145215 - DNA, 22 bp, Artificial Sequence
  chemically synthesized
atcagaagcagagagacaagcc

SEQ ID NO: 145216 - DNA, 22 bp, Artificial Sequence
  chemically synthesized
tcagaagcagagagacaagcca

SEQ ID NO: 145217 - DNA, 22 bp, Artificial Sequence
  chemically synthesized
ctctttcctcccggtgaggaca

SEQ ID NO: 145218 - DNA, 22 bp, Artificial Sequence
  chemically synthesized
tctttcctcccggtgaggacac

SEQ ID NO: 145219 - DNA, 22 bp, Artificial Sequence
  chemically synthesized
tttcctcccggtgaggacacag

SEQ ID NO: 145220 - DNA, 22 bp, Artificial Sequence
  chemically synthesized
tcctcccggtgaggacacagtg

SEQ ID NO: 145221 - DNA, 22 bp, Artificial Sequence
  chemically synthesized
cctcccggtgaggacacagtga

SEQ ID NO: 145222 - DNA, 22 bp, Artificial Sequence
  chemically synthesized
ctcccggtgaggacacagtgag

SEQ ID NO: 145223 - DNA, 22 bp, Artificial Sequence
  chemically synthesized
ccggtgaggacacagtgagaag

SEQ ID NO: 145224 - DNA, 22 bp, Artificial Sequence
  chemically synthesized
caatccaggaagagaaccctga

SEQ ID NO: 145225 - DNA, 22 bp, Artificial Sequence
  chemically synthesized
accacgagtcagccttcagaaa

SEQ ID NO: 145226 - DNA, 22 bp, Artificial Sequence
  chemically synthesized
cagaaatgtgagaaaaaactct

SEQ ID NO: 145227 - DNA, 22 bp, Artificial Sequence
  chemically synthesized
agaaatgtgagaaaaaactctg

SEQ ID NO: 145228 - DNA, 22 bp, Artificial Sequence
  chemically synthesized
tgttgttgaagccacccagtct

SEQ ID NO: 145229 - DNA, 22 bp, Artificial Sequence
  chemically synthesized
ttgttgaagccacccagtcttt

SEQ ID NO: 145230 - DNA, 22 bp, Artificial Sequence
  chemically synthesized
ttgaagccacccagtcttttgt

SEQ ID NO: 145231 - DNA, 22 bp, Artificial Sequence
  chemically synthesized
aagccacccagtcttttgtatt

SEQ ID NO: 145232 - DNA, 22 bp, Artificial Sequence
  chemically synthesized
ttgtattttgttatagcacctt

SEQ ID NO: 145233 - DNA, 22 bp, Artificial Sequence
  chemically synthesized
tgtattttgttatagcaccttg

SEQ ID NO: 145234 - DNA, 22 bp, Artificial Sequence
  chemically synthesized
gtattttgttatagcaccttgc

SEQ ID NO: 145235 - DNA, 22 bp, Artificial Sequence
  chemically synthesized
tattttgttatagcaccttgca

SEQ ID NO: 145236 - DNA, 22 bp, Artificial Sequence
  chemically synthesized
tgttatagcaccttgcactgag

SEQ ID NO: 145237 - DNA, 22 bp, Artificial Sequence
  chemically synthesized
gttatagcaccttgcactgagt

SEQ ID NO: 145238 - DNA, 22 bp, Artificial Sequence
  chemically synthesized
ttatagcaccttgcactgagta

SEQ ID NO: 145239 - DNA, 22 bp, Artificial Sequence
  chemically synthesized
tagcaccttgcactgagtaagg

SEQ ID NO: 145240 - DNA, 22 bp, Artificial Sequence
  chemically synthesized
gcactgagtaaggcagatgaag

SEQ ID NO: 145241 - DNA, 22 bp, Artificial Sequence
  chemically synthesized
cactgagtaaggcagatgaaga

SEQ ID NO: 145242 - DNA, 22 bp, Artificial Sequence
  chemically synthesized
agtaaggcagatgaagaaggag

SEQ ID NO: 145243 - DNA, 22 bp, Artificial Sequence
  chemically synthesized
gggttttgagtggactacagac

SEQ ID NO: 145244 - DNA, 22 bp, Artificial Sequence
  chemically synthesized
ggttttgagtggactacagacc

SEQ ID NO: 145245 - DNA, 22 bp, Artificial Sequence
  chemically synthesized
tgagtggactacagaccatgtt

SEQ ID NO: 145246 - DNA, 22 bp, Artificial Sequence
  chemically synthesized
gagtggactacagaccatgttt

SEQ ID NO: 145247 - DNA, 22 bp, Artificial Sequence
  chemically synthesized
agtggactacagaccatgttta

SEQ ID NO: 145248 - DNA, 22 bp, Artificial Sequence
  chemically synthesized
cagaccatgtttatctcaggtt

SEQ ID NO: 145249 - DNA, 22 bp, Artificial Sequence
  chemically synthesized
atctcaggtttgcaaagctccc

SEQ ID NO: 145250 - DNA, 22 bp, Artificial Sequence
  chemically synthesized
tctcaggtttgcaaagctcccc

SEQ ID NO: 145251 - DNA, 22 bp, Artificial Sequence
  chemically synthesized
aggtttgcaaagctcccctcgt

SEQ ID NO: 145252 - DNA, 22 bp, Artificial Sequence
  chemically synthesized
gcaaagctcccctcgtccccta

SEQ ID NO: 145253 - DNA, 22 bp, Artificial Sequence
  chemically synthesized
caaagctcccctcgtcccctat

SEQ ID NO: 145254 - DNA, 22 bp, Artificial Sequence
  chemically synthesized
ccctcgtcccctatgtttcagt

SEQ ID NO: 145255 - DNA, 22 bp, Artificial Sequence
  chemically synthesized
gtcccctatgtttcagtataaa

SEQ ID NO: 145256 - DNA, 22 bp, Artificial Sequence
  chemically synthesized
tgtttcagtataaaatacctac

SEQ ID NO: 145257 - DNA, 22 bp, Artificial Sequence
  chemically synthesized
cagtataaaatacctactctac

SEQ ID NO: 145258 - DNA, 22 bp, Artificial Sequence
  chemically synthesized
agtataaaatacctactctact

SEQ ID NO: 145259 - DNA, 22 bp, Artificial Sequence
  chemically synthesized
ctctactactctcatctataag

SEQ ID NO: 145260 - DNA, 22 bp, Artificial Sequence
  chemically synthesized
tactactctcatctataagacc

SEQ ID NO: 145261 - DNA, 22 bp, Artificial Sequence
  chemically synthesized
ctactctcatctataagaccca

SEQ ID NO: 145262 - DNA, 22 bp, Artificial Sequence
  chemically synthesized
ctctcatctataagacccaaat

SEQ ID NO: 145263 - DNA, 22 bp, Artificial Sequence
  chemically synthesized
tcatctataagacccaaataat

SEQ ID NO: 145264 - DNA, 22 bp, Artificial Sequence
  chemically synthesized
atctataagacccaaataataa

SEQ ID NO: 145265 - DNA, 22 bp, Artificial Sequence
  chemically synthesized
taagacccaaataataagcctg

SEQ ID NO: 145266 - DNA, 22 bp, Artificial Sequence
  chemically synthesized
cgcccttctctctaactttgat

SEQ ID NO: 145267 - DNA, 22 bp, Artificial Sequence
  chemically synthesized
ctctctaactttgatttctcct

SEQ ID NO: 145268 - DNA, 22 bp, Artificial Sequence
  chemically synthesized
tctctaactttgatttctccta

SEQ ID NO: 145269 - DNA, 22 bp, Artificial Sequence
  chemically synthesized
tctaactttgatttctcctatt

SEQ ID NO: 145270 - DNA, 22 bp, Artificial Sequence
  chemically synthesized
taactttgatttctcctatttt

SEQ ID NO: 145271 - DNA, 22 bp, Artificial Sequence
  chemically synthesized
actttgatttctcctattttta

SEQ ID NO: 145272 - DNA, 22 bp, Artificial Sequence
  chemically synthesized
tgatttctcctatttttacttc

SEQ ID NO: 145273 - DNA, 22 bp, Artificial Sequence
  chemically synthesized
gatttctcctatttttacttca

SEQ ID NO: 145274 - DNA, 22 bp, Artificial Sequence
  chemically synthesized
atttctcctatttttacttcaa

SEQ ID NO: 145275 - DNA, 22 bp, Artificial Sequence
  chemically synthesized
ctcctatttttacttcaacatg

SEQ ID NO: 145276 - DNA, 22 bp, Artificial Sequence
  chemically synthesized
tcctatttttacttcaacatgc

SEQ ID NO: 145277 - DNA, 22 bp, Artificial Sequence
  chemically synthesized
ctatttttacttcaacatgctt

SEQ ID NO: 145278 - DNA, 22 bp, Artificial Sequence
  chemically synthesized
tttttacttcaacatgctttac

SEQ ID NO: 145279 - DNA, 22 bp, Artificial Sequence
  chemically synthesized
ttacttcaacatgctttactct

SEQ ID NO: 145280 - DNA, 22 bp, Artificial Sequence
  chemically synthesized
tacttcaacatgctttactcta

SEQ ID NO: 145281 - DNA, 22 bp, Artificial Sequence
  chemically synthesized
acttcaacatgctttactctag

SEQ ID NO: 145282 - DNA, 22 bp, Artificial Sequence
  chemically synthesized
cttcaacatgctttactctagc

SEQ ID NO: 145283 - DNA, 22 bp, Artificial Sequence
  chemically synthesized
caacatgctttactctagcctt

SEQ ID NO: 145284 - DNA, 22 bp, Artificial Sequence
  chemically synthesized
aacatgctttactctagccttg

SEQ ID NO: 145285 - DNA, 22 bp, Artificial Sequence
  chemically synthesized
tactctagccttgtaatgtctt

SEQ ID NO: 145286 - DNA, 22 bp, Artificial Sequence
  chemically synthesized
actctagccttgtaatgtcttt

SEQ ID NO: 145287 - DNA, 22 bp, Artificial Sequence
  chemically synthesized
ctctagccttgtaatgtcttta

SEQ ID NO: 145288 - DNA, 22 bp, Artificial Sequence
  chemically synthesized
tagccttgtaatgtctttacat

SEQ ID NO: 145289 - DNA, 22 bp, Artificial Sequence
  chemically synthesized
gccttgtaatgtctttacatac

SEQ ID NO: 145290 - DNA, 22 bp, Artificial Sequence
  chemically synthesized
gtaatgtctttacatacagtga

SEQ ID NO: 145291 - DNA, 22 bp, Artificial Sequence
  chemically synthesized
taatgtctttacatacagtgaa

SEQ ID NO: 145292 - DNA, 22 bp, Artificial Sequence
  chemically synthesized
tacatacagtgaaatgtaaagt

SEQ ID NO: 145293 - DNA, 22 bp, Artificial Sequence
  chemically synthesized
acatacagtgaaatgtaaagtt

SEQ ID NO: 145294 - DNA, 22 bp, Artificial Sequence
  chemically synthesized
catacagtgaaatgtaaagttc

SEQ ID NO: 145295 - DNA, 22 bp, Artificial Sequence
  chemically synthesized
tttattctttttttctttcttt

SEQ ID NO: 145296 - DNA, 22 bp, Artificial Sequence
  chemically synthesized
tattctttttttctttctttct

SEQ ID NO: 145297 - DNA, 22 bp, Artificial Sequence
  chemically synthesized
attctttttttctttctttctt

SEQ ID NO: 145298 - DNA, 22 bp, Artificial Sequence
  chemically synthesized
ttctttttttctttctttcttt

SEQ ID NO: 145299 - DNA, 22 bp, Artificial Sequence
  chemically synthesized
tttttttctttctttctttttt

SEQ ID NO: 145300 - DNA, 22 bp, Artificial Sequence
  chemically synthesized
tttttctttctttcttttttct

SEQ ID NO: 145301 - DNA, 22 bp, Artificial Sequence
  chemically synthesized
ttttctttctttcttttttctc

SEQ ID NO: 145302 - DNA, 22 bp, Artificial Sequence
  chemically synthesized
tttctttctttcttttttctcc

SEQ ID NO: 145303 - DNA, 22 bp, Artificial Sequence
  chemically synthesized
ttctttctttcttttttctcct

SEQ ID NO: 145304 - DNA, 22 bp, Artificial Sequence
  chemically synthesized
tctttctttcttttttctcctc

SEQ ID NO: 145305 - DNA, 22 bp, Artificial Sequence
  chemically synthesized
ctttctttcttttttctcctca

SEQ ID NO: 145306 - DNA, 22 bp, Artificial Sequence
  chemically synthesized
tttctttcttttttctcctcag

SEQ ID NO: 145307 - DNA, 22 bp, Artificial Sequence
  chemically synthesized
tctttcttttttctcctcagcc

SEQ ID NO: 145308 - DNA, 22 bp, Artificial Sequence
  chemically synthesized
ctttcttttttctcctcagcct

SEQ ID NO: 145309 - DNA, 22 bp, Artificial Sequence
  chemically synthesized
tttcttttttctcctcagcctc

SEQ ID NO: 145310 - DNA, 22 bp, Artificial Sequence
  chemically synthesized
tcttttttctcctcagcctcag

SEQ ID NO: 145311 - DNA, 22 bp, Artificial Sequence
  chemically synthesized
cttttttctcctcagcctcaga

SEQ ID NO: 145312 - DNA, 22 bp, Artificial Sequence
  chemically synthesized
ttttttctcctcagcctcagaa

SEQ ID NO: 145313 - DNA, 22 bp, Artificial Sequence
  chemically synthesized
ttttctcctcagcctcagaatt

SEQ ID NO: 145314 - DNA, 22 bp, Artificial Sequence
  chemically synthesized
tttctcctcagcctcagaattt

SEQ ID NO: 145315 - DNA, 22 bp, Artificial Sequence
  chemically synthesized
ttctcctcagcctcagaatttg

SEQ ID NO: 145316 - DNA, 22 bp, Artificial Sequence
  chemically synthesized
tctcctcagcctcagaatttgg

SEQ ID NO: 145317 - DNA, 22 bp, Artificial Sequence
  chemically synthesized
ctcctcagcctcagaatttggc

SEQ ID NO: 145318 - DNA, 22 bp, Artificial Sequence
  chemically synthesized
tcctcagcctcagaatttggca

SEQ ID NO: 145319 - DNA, 22 bp, Artificial Sequence
  chemically synthesized
ctcagcctcagaatttggcaca

SEQ ID NO: 145320 - DNA, 22 bp, Artificial Sequence
  chemically synthesized
agcctcagaatttggcacatgc

SEQ ID NO: 145321 - DNA, 22 bp, Artificial Sequence
  chemically synthesized
agaatttggcacatgcccttcc

SEQ ID NO: 145322 - DNA, 22 bp, Artificial Sequence
  chemically synthesized
ggcacatgcccttccttctttc

SEQ ID NO: 145323 - DNA, 22 bp, Artificial Sequence
  chemically synthesized
gcacatgcccttccttctttca

SEQ ID NO: 145324 - DNA, 22 bp, Artificial Sequence
  chemically synthesized
ccttctttcaggaacttctcca

SEQ ID NO: 145325 - DNA, 22 bp, Artificial Sequence
  chemically synthesized
cttctttcaggaacttctccaa

SEQ ID NO: 145326 - DNA, 22 bp, Artificial Sequence
  chemically synthesized
ctttcaggaacttctccaacat

SEQ ID NO: 145327 - DNA, 22 bp, Artificial Sequence
  chemically synthesized
tttcaggaacttctccaacatc

SEQ ID NO: 145328 - DNA, 22 bp, Artificial Sequence
  chemically synthesized
tcaggaacttctccaacatctc

SEQ ID NO: 145329 - DNA, 22 bp, Artificial Sequence
  chemically synthesized
caggaacttctccaacatctct

SEQ ID NO: 145330 - DNA, 22 bp, Artificial Sequence
  chemically synthesized
aggaacttctccaacatctctg

SEQ ID NO: 145331 - DNA, 22 bp, Artificial Sequence
  chemically synthesized
ctccaacatctctgcctggctc

SEQ ID NO: 145332 - DNA, 22 bp, Artificial Sequence
  chemically synthesized
tccaacatctctgcctggctcc

SEQ ID NO: 145333 - DNA, 22 bp, Artificial Sequence
  chemically synthesized
caacatctctgcctggctccat

SEQ ID NO: 145334 - DNA, 22 bp, Artificial Sequence
  chemically synthesized
tgcctggctccatcatatcata

SEQ ID NO: 145335 - DNA, 22 bp, Artificial Sequence
  chemically synthesized
cctggctccatcatatcataaa

SEQ ID NO: 145336 - DNA, 22 bp, Artificial Sequence
  chemically synthesized
gctccatcatatcataaaggtc

SEQ ID NO: 145337 - DNA, 22 bp, Artificial Sequence
  chemically synthesized
catcatatcataaaggtcccac

SEQ ID NO: 145338 - DNA, 22 bp, Artificial Sequence
  chemically synthesized
caaatgcagtcactaccgtttc

SEQ ID NO: 145339 - DNA, 22 bp, Artificial Sequence
  chemically synthesized
aaatgcagtcactaccgtttca

SEQ ID NO: 145340 - DNA, 22 bp, Artificial Sequence
  chemically synthesized
ccgtttcagaatatgcactttc

SEQ ID NO: 145341 - DNA, 22 bp, Artificial Sequence
  chemically synthesized
cagaatatgcactttctttctt

SEQ ID NO: 145342 - DNA, 22 bp, Artificial Sequence
  chemically synthesized
agaatatgcactttctttcttt

SEQ ID NO: 145343 - DNA, 22 bp, Artificial Sequence
  chemically synthesized
tctttcttttttgttttttgtt

SEQ ID NO: 145344 - DNA, 22 bp, Artificial Sequence
  chemically synthesized
ctttcttttttgttttttgttt

SEQ ID NO: 145345 - DNA, 22 bp, Artificial Sequence
  chemically synthesized
tttcttttttgttttttgtttt

SEQ ID NO: 145346 - DNA, 22 bp, Artificial Sequence
  chemically synthesized
tcttttttgttttttgtttttt

SEQ ID NO: 145347 - DNA, 22 bp, Artificial Sequence
  chemically synthesized
cttttttgttttttgttttttt

SEQ ID NO: 145348 - DNA, 22 bp, Artificial Sequence
  chemically synthesized
ttttttgttttttgtttttttt

SEQ ID NO: 145349 - DNA, 22 bp, Artificial Sequence
  chemically synthesized
ttttgttttttgttttttttaa

SEQ ID NO: 145350 - DNA, 22 bp, Artificial Sequence
  chemically synthesized
tttgttttttgttttttttaag

SEQ ID NO: 145351 - DNA, 22 bp, Artificial Sequence
  chemically synthesized
ttgttttttgttttttttaagt

SEQ ID NO: 145352 - DNA, 22 bp, Artificial Sequence
  chemically synthesized
tgttttttgttttttttaagtc

SEQ ID NO: 145353 - DNA, 22 bp, Artificial Sequence
  chemically synthesized
gttttttgttttttttaagtca

SEQ ID NO: 145354 - DNA, 22 bp, Artificial Sequence
  chemically synthesized
ttttttgttttttttaagtcaa

SEQ ID NO: 145355 - DNA, 22 bp, Artificial Sequence
  chemically synthesized
tttgttttttttaagtcaaagc

SEQ ID NO: 145356 - DNA, 22 bp, Artificial Sequence
  chemically synthesized
ttgttttttttaagtcaaagca

SEQ ID NO: 145357 - DNA, 22 bp, Artificial Sequence
  chemically synthesized
tgttttttttaagtcaaagcaa

SEQ ID NO: 145358 - DNA, 22 bp, Artificial Sequence
  chemically synthesized
gttttttttaagtcaaagcaaa

SEQ ID NO: 145359 - DNA, 22 bp, Artificial Sequence
  chemically synthesized
ttttttttaagtcaaagcaaat

SEQ ID NO: 145360 - DNA, 22 bp, Artificial Sequence
  chemically synthesized
tttttaagtcaaagcaaatttc

SEQ ID NO: 145361 - DNA, 22 bp, Artificial Sequence
  chemically synthesized
ttttaagtcaaagcaaatttct

SEQ ID NO: 145362 - DNA, 22 bp, Artificial Sequence
  chemically synthesized
tttaagtcaaagcaaatttctt

SEQ ID NO: 145363 - DNA, 22 bp, Artificial Sequence
  chemically synthesized
ttaagtcaaagcaaatttcttg

SEQ ID NO: 145364 - DNA, 22 bp, Artificial Sequence
  chemically synthesized
taagtcaaagcaaatttcttga

SEQ ID NO: 145365 - DNA, 22 bp, Artificial Sequence
  chemically synthesized
aagtcaaagcaaatttcttgag

SEQ ID NO: 145366 - DNA, 22 bp, Artificial Sequence
  chemically synthesized
agtcaaagcaaatttcttgaga

SEQ ID NO: 145367 - DNA, 22 bp, Artificial Sequence
  chemically synthesized
cttgagagagtaaagaaataaa

SEQ ID NO: 145368 - DNA, 22 bp, Artificial Sequence
  chemically synthesized
ttgagagagtaaagaaataaac

SEQ ID NO: 145369 - DNA, 22 bp, Artificial Sequence
  chemically synthesized
gagagagtaaagaaataaacga

SEQ ID NO: 145370 - DNA, 22 bp, Artificial Sequence
  chemically synthesized
agagagtaaagaaataaacgaa

SEQ ID NO: 145371 - DNA, 22 bp, Artificial Sequence
  chemically synthesized
ctgcataggcagagcagccccg

SEQ ID NO: 145372 - DNA, 22 bp, Artificial Sequence
  chemically synthesized
cataggcagagcagccccgagg

SEQ ID NO: 145373 - DNA, 22 bp, Artificial Sequence
  chemically synthesized
gttgttccttttatggttattt

SEQ ID NO: 145374 - DNA, 22 bp, Artificial Sequence
  chemically synthesized
ttccttttatggttatttcttg

SEQ ID NO: 145375 - DNA, 22 bp, Artificial Sequence
  chemically synthesized
cttttatggttatttcttgatg

SEQ ID NO: 145376 - DNA, 22 bp, Artificial Sequence
  chemically synthesized
ttatggttatttcttgatgata

SEQ ID NO: 145377 - DNA, 22 bp, Artificial Sequence
  chemically synthesized
tatggttatttcttgatgatat

SEQ ID NO: 145378 - DNA, 22 bp, Artificial Sequence
  chemically synthesized
atggttatttcttgatgatatg

SEQ ID NO: 145379 - DNA, 22 bp, Artificial Sequence
  chemically synthesized
tggttatttcttgatgatatgt

SEQ ID NO: 145380 - DNA, 22 bp, Artificial Sequence
  chemically synthesized
tttcttgatgatatgttaaaca

SEQ ID NO: 145381 - DNA, 22 bp, Artificial Sequence
  chemically synthesized
cttgatgatatgttaaacaagt

SEQ ID NO: 145382 - DNA, 22 bp, Artificial Sequence
  chemically synthesized
ttgatgatatgttaaacaagtt

SEQ ID NO: 145383 - DNA, 22 bp, Artificial Sequence
  chemically synthesized
gatgatatgttaaacaagtttt

SEQ ID NO: 145384 - DNA, 22 bp, Artificial Sequence
  chemically synthesized
atgatatgttaaacaagttttg

SEQ ID NO: 145385 - DNA, 22 bp, Artificial Sequence
  chemically synthesized
aacaagttttggattatttatg

SEQ ID NO: 145386 - DNA, 22 bp, Artificial Sequence
  chemically synthesized
tggattatttatgccttctctt

SEQ ID NO: 145387 - DNA, 22 bp, Artificial Sequence
  chemically synthesized
ggattatttatgccttctcttt

SEQ ID NO: 145388 - DNA, 22 bp, Artificial Sequence
  chemically synthesized
gattatttatgccttctctttt

SEQ ID NO: 145389 - DNA, 22 bp, Artificial Sequence
  chemically synthesized
tttatgccttctctttttaggc

SEQ ID NO: 145390 - DNA, 22 bp, Artificial Sequence
  chemically synthesized
atgccttctctttttaggccat

SEQ ID NO: 145391 - DNA, 22 bp, Artificial Sequence
  chemically synthesized
tgccttctctttttaggccata

SEQ ID NO: 145392 - DNA, 22 bp, Artificial Sequence
  chemically synthesized
ctctttttaggccatatagggt

SEQ ID NO: 145393 - DNA, 22 bp, Artificial Sequence
  chemically synthesized
tctttttaggccatatagggta

SEQ ID NO: 145394 - DNA, 22 bp, Artificial Sequence
  chemically synthesized
tttttaggccatatagggtaac

SEQ ID NO: 145395 - DNA, 22 bp, Artificial Sequence
  chemically synthesized
tttaggccatatagggtaactt

SEQ ID NO: 145396 - DNA, 22 bp, Artificial Sequence
  chemically synthesized
ttaggccatatagggtaacttt

SEQ ID NO: 145397 - DNA, 22 bp, Artificial Sequence
  chemically synthesized
taggccatatagggtaactttc

SEQ ID NO: 145398 - DNA, 22 bp, Artificial Sequence
  chemically synthesized
aggccatatagggtaactttct

SEQ ID NO: 145399 - DNA, 22 bp, Artificial Sequence
  chemically synthesized
ggccatatagggtaactttctg

SEQ ID NO: 145400 - DNA, 22 bp, Artificial Sequence
  chemically synthesized
tctgacattgccatggcatttt

SEQ ID NO: 145401 - DNA, 22 bp, Artificial Sequence
  chemically synthesized
ctgacattgccatggcattttt

SEQ ID NO: 145402 - DNA, 22 bp, Artificial Sequence
  chemically synthesized
tgacattgccatggcatttttc

SEQ ID NO: 145403 - DNA, 22 bp, Artificial Sequence
  chemically synthesized
acattgccatggcatttttctt

SEQ ID NO: 145404 - DNA, 22 bp, Artificial Sequence
  chemically synthesized
ccatggcatttttcttttaatt

SEQ ID NO: 145405 - DNA, 22 bp, Artificial Sequence
  chemically synthesized
ttcttttaatttaatttactgt

SEQ ID NO: 145406 - DNA, 22 bp, Artificial Sequence
  chemically synthesized
tcttttaatttaatttactgtt

SEQ ID NO: 145407 - DNA, 22 bp, Artificial Sequence
  chemically synthesized
cttttaatttaatttactgtta

SEQ ID NO: 145408 - DNA, 22 bp, Artificial Sequence
  chemically synthesized
ttttaatttaatttactgttac

SEQ ID NO: 145409 - DNA, 22 bp, Artificial Sequence
  chemically synthesized
ttaatttaatttactgttacct

SEQ ID NO: 145410 - DNA, 22 bp, Artificial Sequence
  chemically synthesized
taatttaatttactgttacctt

SEQ ID NO: 145411 - DNA, 22 bp, Artificial Sequence
  chemically synthesized
aatttaatttactgttacctta

SEQ ID NO: 145412 - DNA, 22 bp, Artificial Sequence
  chemically synthesized
atttaatttactgttaccttaa

SEQ ID NO: 145413 - DNA, 22 bp, Artificial Sequence
  chemically synthesized
aatttactgttaccttaaattc

SEQ ID NO: 145414 - DNA, 22 bp, Artificial Sequence
  chemically synthesized
atttactgttaccttaaattca

SEQ ID NO: 145415 - DNA, 22 bp, Artificial Sequence
  chemically synthesized
actgttaccttaaattcagggg

SEQ ID NO: 145416 - DNA, 22 bp, Artificial Sequence
  chemically synthesized
ctgttaccttaaattcaggggt

SEQ ID NO: 145417 - DNA, 22 bp, Artificial Sequence
  chemically synthesized
ttaccttaaattcaggggtaca

SEQ ID NO: 145418 - DNA, 22 bp, Artificial Sequence
  chemically synthesized
ccttaaattcaggggtacacgt

SEQ ID NO: 145419 - DNA, 22 bp, Artificial Sequence
  chemically synthesized
aaattcaggggtacacgtacag

SEQ ID NO: 145420 - DNA, 22 bp, Artificial Sequence
  chemically synthesized
aattcaggggtacacgtacagg

SEQ ID NO: 145421 - DNA, 22 bp, Artificial Sequence
  chemically synthesized
aggggtacacgtacaggatatg

SEQ ID NO: 145422 - DNA, 22 bp, Artificial Sequence
  chemically synthesized
gttttataggtaaaagtgtgcc

SEQ ID NO: 145423 - DNA, 22 bp, Artificial Sequence
  chemically synthesized
ttttataggtaaaagtgtgcca

SEQ ID NO: 145424 - DNA, 22 bp, Artificial Sequence
  chemically synthesized
tataggtaaaagtgtgccatgg

SEQ ID NO: 145425 - DNA, 22 bp, Artificial Sequence
  chemically synthesized
ataggtaaaagtgtgccatggt

SEQ ID NO: 145426 - DNA, 22 bp, Artificial Sequence
  chemically synthesized
taggtaaaagtgtgccatggtt

SEQ ID NO: 145427 - DNA, 22 bp, Artificial Sequence
  chemically synthesized
taatgggttttttttttcttgt

SEQ ID NO: 145428 - DNA, 22 bp, Artificial Sequence
  chemically synthesized
aatgggttttttttttcttgta

SEQ ID NO: 145429 - DNA, 22 bp, Artificial Sequence
  chemically synthesized
atgggttttttttttcttgtaa

SEQ ID NO: 145430 - DNA, 22 bp, Artificial Sequence
  chemically synthesized
tttttttcttgtaaagttgttt

SEQ ID NO: 145431 - DNA, 22 bp, Artificial Sequence
  chemically synthesized
ttttttcttgtaaagttgttta

SEQ ID NO: 145432 - DNA, 22 bp, Artificial Sequence
  chemically synthesized
tttttcttgtaaagttgtttaa

SEQ ID NO: 145433 - DNA, 22 bp, Artificial Sequence
  chemically synthesized
ttttcttgtaaagttgtttaag

SEQ ID NO: 145434 - DNA, 22 bp, Artificial Sequence
  chemically synthesized
tttcttgtaaagttgtttaagt

SEQ ID NO: 145435 - DNA, 22 bp, Artificial Sequence
  chemically synthesized
ttcttgtaaagttgtttaagtt

SEQ ID NO: 145436 - DNA, 22 bp, Artificial Sequence
  chemically synthesized
tcttgtaaagttgtttaagttt

SEQ ID NO: 145437 - DNA, 22 bp, Artificial Sequence
  chemically synthesized
cttgtaaagttgtttaagtttc

SEQ ID NO: 145438 - DNA, 22 bp, Artificial Sequence
  chemically synthesized
ttgtaaagttgtttaagtttct

SEQ ID NO: 145439 - DNA, 22 bp, Artificial Sequence
  chemically synthesized
gtaaagttgtttaagtttcttg

SEQ ID NO: 145440 - DNA, 22 bp, Artificial Sequence
  chemically synthesized
taaagttgtttaagtttcttgt

SEQ ID NO: 145441 - DNA, 22 bp, Artificial Sequence
  chemically synthesized
tttaagtttcttgtttactctg

SEQ ID NO: 145442 - DNA, 22 bp, Artificial Sequence
  chemically synthesized
aagtttcttgtttactctggat

SEQ ID NO: 145443 - DNA, 22 bp, Artificial Sequence
  chemically synthesized
agtttcttgtttactctggata

SEQ ID NO: 145444 - DNA, 22 bp, Artificial Sequence
  chemically synthesized
cttgtttactctggatattagg

SEQ ID NO: 145445 - DNA, 22 bp, Artificial Sequence
  chemically synthesized
ttgtttactctggatattaggc

SEQ ID NO: 145446 - DNA, 22 bp, Artificial Sequence
  chemically synthesized
gtttactctggatattaggcct

SEQ ID NO: 145447 - DNA, 22 bp, Artificial Sequence
  chemically synthesized
tttactctggatattaggcctt

SEQ ID NO: 145448 - DNA, 22 bp, Artificial Sequence
  chemically synthesized
actctggatattaggcctttgt

SEQ ID NO: 145449 - DNA, 22 bp, Artificial Sequence
  chemically synthesized
ctctggatattaggcctttgtc

SEQ ID NO: 145450 - DNA, 22 bp, Artificial Sequence
  chemically synthesized
tggatattaggcctttgtcaga

SEQ ID NO: 145451 - DNA, 22 bp, Artificial Sequence
  chemically synthesized
gatattaggcctttgtcagaag

SEQ ID NO: 145452 - DNA, 22 bp, Artificial Sequence
  chemically synthesized
ggcctttgtcagaagaatagat

SEQ ID NO: 145453 - DNA, 22 bp, Artificial Sequence
  chemically synthesized
tgtcagaagaatagattggaaa

SEQ ID NO: 145454 - DNA, 22 bp, Artificial Sequence
  chemically synthesized
gtcagaagaatagattggaaaa

SEQ ID NO: 145455 - DNA, 22 bp, Artificial Sequence
  chemically synthesized
tcagaagaatagattggaaaat

SEQ ID NO: 145456 - DNA, 22 bp, Artificial Sequence
  chemically synthesized
gaaaatctttttcccattctgt

SEQ ID NO: 145457 - DNA, 22 bp, Artificial Sequence
  chemically synthesized
tttcccattctgtagattgtct

SEQ ID NO: 145458 - DNA, 22 bp, Artificial Sequence
  chemically synthesized
ttcccattctgtagattgtctt

SEQ ID NO: 145459 - DNA, 22 bp, Artificial Sequence
  chemically synthesized
tcccattctgtagattgtcttt

SEQ ID NO: 145460 - DNA, 22 bp, Artificial Sequence
  chemically synthesized
cccattctgtagattgtctttc

SEQ ID NO: 145461 - DNA, 22 bp, Artificial Sequence
  chemically synthesized
ccattctgtagattgtctttcg

SEQ ID NO: 145462 - DNA, 22 bp, Artificial Sequence
  chemically synthesized
tgtagattgtctttcgctctga

SEQ ID NO: 145463 - DNA, 22 bp, Artificial Sequence
  chemically synthesized
tagattgtctttcgctctgatg

SEQ ID NO: 145464 - DNA, 22 bp, Artificial Sequence
  chemically synthesized
tctttcgctctgatggtagttt

SEQ ID NO: 145465 - DNA, 22 bp, Artificial Sequence
  chemically synthesized
tcgctctgatggtagtttcttt

SEQ ID NO: 145466 - DNA, 22 bp, Artificial Sequence
  chemically synthesized
cgctctgatggtagtttctttt

SEQ ID NO: 145467 - DNA, 22 bp, Artificial Sequence
  chemically synthesized
gctctgatggtagtttcttttg

SEQ ID NO: 145468 - DNA, 22 bp, Artificial Sequence
  chemically synthesized
tgatggtagtttcttttgctga

SEQ ID NO: 145469 - DNA, 22 bp, Artificial Sequence
  chemically synthesized
atggtagtttcttttgctgagc

SEQ ID NO: 145470 - DNA, 22 bp, Artificial Sequence
  chemically synthesized
cttttgctgagcaggagctctt

SEQ ID NO: 145471 - DNA, 22 bp, Artificial Sequence
  chemically synthesized
ttttgctgagcaggagctcttt

SEQ ID NO: 145472 - DNA, 22 bp, Artificial Sequence
  chemically synthesized
ttgctgagcaggagctctttag

SEQ ID NO: 145473 - DNA, 22 bp, Artificial Sequence
  chemically synthesized
tgctgagcaggagctctttagt

SEQ ID NO: 145474 - DNA, 22 bp, Artificial Sequence
  chemically synthesized
gctgagcaggagctctttagtt

SEQ ID NO: 145475 - DNA, 22 bp, Artificial Sequence
  chemically synthesized
ctgagcaggagctctttagttt

SEQ ID NO: 145476 - DNA, 22 bp, Artificial Sequence
  chemically synthesized
agcaggagctctttagtttaat

SEQ ID NO: 145477 - DNA, 22 bp, Artificial Sequence
  chemically synthesized
tttagtttaattagattccatt

SEQ ID NO: 145478 - DNA, 22 bp, Artificial Sequence
  chemically synthesized
tagtttaattagattccattgg

SEQ ID NO: 145479 - DNA, 22 bp, Artificial Sequence
  chemically synthesized
agtttaattagattccattggt

SEQ ID NO: 145480 - DNA, 22 bp, Artificial Sequence
  chemically synthesized
gtttaattagattccattggtc

SEQ ID NO: 145481 - DNA, 22 bp, Artificial Sequence
  chemically synthesized
aattagattccattggtcaatt

SEQ ID NO: 145482 - DNA, 22 bp, Artificial Sequence
  chemically synthesized
attagattccattggtcaattt

SEQ ID NO: 145483 - DNA, 22 bp, Artificial Sequence
  chemically synthesized
gattccattggtcaatttttgc

SEQ ID NO: 145484 - DNA, 22 bp, Artificial Sequence
  chemically synthesized
cattggtcaatttttgcttttg

SEQ ID NO: 145485 - DNA, 22 bp, Artificial Sequence
  chemically synthesized
gtcaatttttgcttttgctgca

SEQ ID NO: 145486 - DNA, 22 bp, Artificial Sequence
  chemically synthesized
ttgcttttgctgcaattgcttt

SEQ ID NO: 145487 - DNA, 22 bp, Artificial Sequence
  chemically synthesized
tgcttttgctgcaattgctttt

SEQ ID NO: 145488 - DNA, 22 bp, Artificial Sequence
  chemically synthesized
gcttttgctgcaattgcttttc

SEQ ID NO: 145489 - DNA, 22 bp, Artificial Sequence
  chemically synthesized
cttttgctgcaattgcttttca

SEQ ID NO: 145490 - DNA, 22 bp, Artificial Sequence
  chemically synthesized
ttgctgcaattgcttttcacgc

SEQ ID NO: 145491 - DNA, 22 bp, Artificial Sequence
  chemically synthesized
tgctgcaattgcttttcacgct

SEQ ID NO: 145492 - DNA, 22 bp, Artificial Sequence
  chemically synthesized
gctgcaattgcttttcacgctt

SEQ ID NO: 145493 - DNA, 22 bp, Artificial Sequence
  chemically synthesized
ctgcaattgcttttcacgcttt

SEQ ID NO: 145494 - DNA, 22 bp, Artificial Sequence
  chemically synthesized
caattgcttttcacgctttcat

SEQ ID NO: 145495 - DNA, 22 bp, Artificial Sequence
  chemically synthesized
cttttcacgctttcatcatgaa

SEQ ID NO: 145496 - DNA, 22 bp, Artificial Sequence
  chemically synthesized
ttcacgctttcatcatgaaatc

SEQ ID NO: 145497 - DNA, 22 bp, Artificial Sequence
  chemically synthesized
tcacgctttcatcatgaaatct

SEQ ID NO: 145498 - DNA, 22 bp, Artificial Sequence
  chemically synthesized
cacgctttcatcatgaaatctg

SEQ ID NO: 145499 - DNA, 22 bp, Artificial Sequence
  chemically synthesized
acgctttcatcatgaaatctgt

SEQ ID NO: 145500 - DNA, 22 bp, Artificial Sequence
  chemically synthesized
tcatcatgaaatctgtgcccgt

SEQ ID NO: 145501 - DNA, 22 bp, Artificial Sequence
  chemically synthesized
catcatgaaatctgtgcccgtg

SEQ ID NO: 145502 - DNA, 22 bp, Artificial Sequence
  chemically synthesized
atcatgaaatctgtgcccgtgt

SEQ ID NO: 145503 - DNA, 22 bp, Artificial Sequence
  chemically synthesized
tgcccgtgtttatatcatgaat

SEQ ID NO: 145504 - DNA, 22 bp, Artificial Sequence
  chemically synthesized
atatcatgaatagtattgcctt

SEQ ID NO: 145505 - DNA, 22 bp, Artificial Sequence
  chemically synthesized
tatcatgaatagtattgccttg

SEQ ID NO: 145506 - DNA, 22 bp, Artificial Sequence
  chemically synthesized
ccttgatttttttctaggcttt

SEQ ID NO: 145507 - DNA, 22 bp, Artificial Sequence
  chemically synthesized
gatttttttctaggctttttat

SEQ ID NO: 145508 - DNA, 22 bp, Artificial Sequence
  chemically synthesized
atttttttctaggctttttata

SEQ ID NO: 145509 - DNA, 22 bp, Artificial Sequence
  chemically synthesized
ttttctaggctttttatagttt

SEQ ID NO: 145510 - DNA, 22 bp, Artificial Sequence
  chemically synthesized
tttctaggctttttatagtttg

SEQ ID NO: 145511 - DNA, 22 bp, Artificial Sequence
  chemically synthesized
ttctaggctttttatagtttgg

SEQ ID NO: 145512 - DNA, 22 bp, Artificial Sequence
  chemically synthesized
tctaggctttttatagtttggg

SEQ ID NO: 145513 - DNA, 22 bp, Artificial Sequence
  chemically synthesized
ctaggctttttatagtttgggg

SEQ ID NO: 145514 - DNA, 22 bp, Artificial Sequence
  chemically synthesized
taggctttttatagtttggggt

SEQ ID NO: 145515 - DNA, 22 bp, Artificial Sequence
  chemically synthesized
ggctttttatagtttggggttt

SEQ ID NO: 145516 - DNA, 22 bp, Artificial Sequence
  chemically synthesized
tttatagtttggggtttttcat

SEQ ID NO: 145517 - DNA, 22 bp, Artificial Sequence
  chemically synthesized
ttatagtttggggtttttcatt

SEQ ID NO: 145518 - DNA, 22 bp, Artificial Sequence
  chemically synthesized
tatagtttggggtttttcattt

SEQ ID NO: 145519 - DNA, 22 bp, Artificial Sequence
  chemically synthesized
atagtttggggtttttcattta

SEQ ID NO: 145520 - DNA, 22 bp, Artificial Sequence
  chemically synthesized
tagtttggggtttttcatttaa

SEQ ID NO: 145521 - DNA, 22 bp, Artificial Sequence
  chemically synthesized
ggggtttttcatttaagtctct

SEQ ID NO: 145522 - DNA, 22 bp, Artificial Sequence
  chemically synthesized
gggtttttcatttaagtctcta

SEQ ID NO: 145523 - DNA, 22 bp, Artificial Sequence
  chemically synthesized
ttcatttaagtctctaatccat

SEQ ID NO: 145524 - DNA, 22 bp, Artificial Sequence
  chemically synthesized
tcatttaagtctctaatccatc

SEQ ID NO: 145525 - DNA, 22 bp, Artificial Sequence
  chemically synthesized
catttaagtctctaatccatct

SEQ ID NO: 145526 - DNA, 22 bp, Artificial Sequence
  chemically synthesized
atttaagtctctaatccatctg

SEQ ID NO: 145527 - DNA, 22 bp, Artificial Sequence
  chemically synthesized
aagtctctaatccatctggagt

SEQ ID NO: 145528 - DNA, 22 bp, Artificial Sequence
  chemically synthesized
agtctctaatccatctggagtt

SEQ ID NO: 145529 - DNA, 22 bp, Artificial Sequence
  chemically synthesized
taatccatctggagttaatttt

SEQ ID NO: 145530 - DNA, 22 bp, Artificial Sequence
  chemically synthesized
atccatctggagttaattttgg

SEQ ID NO: 145531 - DNA, 22 bp, Artificial Sequence
  chemically synthesized
gagttaattttggataaggtat

SEQ ID NO: 145532 - DNA, 22 bp, Artificial Sequence
  chemically synthesized
attttggataaggtataaggaa

SEQ ID NO: 145533 - DNA, 22 bp, Artificial Sequence
  chemically synthesized
tggataaggtataaggaaggag

SEQ ID NO: 145534 - DNA, 22 bp, Artificial Sequence
  chemically synthesized
ggataaggtataaggaaggagt

SEQ ID NO: 145535 - DNA, 22 bp, Artificial Sequence
  chemically synthesized
gataaggtataaggaaggagtc

SEQ ID NO: 145536 - DNA, 22 bp, Artificial Sequence
  chemically synthesized
catttttcagcatatggctagc

SEQ ID NO: 145537 - DNA, 22 bp, Artificial Sequence
  chemically synthesized
atttttcagcatatggctagcc

SEQ ID NO: 145538 - DNA, 22 bp, Artificial Sequence
  chemically synthesized
ttcagcatatggctagccagtt

SEQ ID NO: 145539 - DNA, 22 bp, Artificial Sequence
  chemically synthesized
tcagcatatggctagccagttc

SEQ ID NO: 145540 - DNA, 22 bp, Artificial Sequence
  chemically synthesized
cagcatatggctagccagttct

SEQ ID NO: 145541 - DNA, 22 bp, Artificial Sequence
  chemically synthesized
agcatatggctagccagttctc

SEQ ID NO: 145542 - DNA, 22 bp, Artificial Sequence
  chemically synthesized
gccagttctcccccatcattta

SEQ ID NO: 145543 - DNA, 22 bp, Artificial Sequence
  chemically synthesized
tcccccatcatttattaaattg

SEQ ID NO: 145544 - DNA, 22 bp, Artificial Sequence
  chemically synthesized
ccccatcatttattaaattgaa

SEQ ID NO: 145545 - DNA, 22 bp, Artificial Sequence
  chemically synthesized
attaaattgaaaatcctttccc

SEQ ID NO: 145546 - DNA, 22 bp, Artificial Sequence
  chemically synthesized
ttaaattgaaaatcctttcccc

SEQ ID NO: 145547 - DNA, 22 bp, Artificial Sequence
  chemically synthesized
aattgaaaatcctttccccatt

SEQ ID NO: 145548 - DNA, 22 bp, Artificial Sequence
  chemically synthesized
aaaatcctttccccattgcttg

SEQ ID NO: 145549 - DNA, 22 bp, Artificial Sequence
  chemically synthesized
tccccattgcttgcttttgtca

SEQ ID NO: 145550 - DNA, 22 bp, Artificial Sequence
  chemically synthesized
ccccattgcttgcttttgtcag

SEQ ID NO: 145551 - DNA, 22 bp, Artificial Sequence
  chemically synthesized
cccattgcttgcttttgtcagg

SEQ ID NO: 145552 - DNA, 22 bp, Artificial Sequence
  chemically synthesized
cttgcttttgtcaggtttctaa

SEQ ID NO: 145553 - DNA, 22 bp, Artificial Sequence
  chemically synthesized
gcttttgtcaggtttctaaaag

SEQ ID NO: 145554 - DNA, 22 bp, Artificial Sequence
  chemically synthesized
cttttgtcaggtttctaaaaga

SEQ ID NO: 145555 - DNA, 22 bp, Artificial Sequence
  chemically synthesized
ttgtcaggtttctaaaagacca

SEQ ID NO: 145556 - DNA, 22 bp, Artificial Sequence
  chemically synthesized
tgtcaggtttctaaaagaccag

SEQ ID NO: 145557 - DNA, 22 bp, Artificial Sequence
  chemically synthesized
gtcaggtttctaaaagaccaga

SEQ ID NO: 145558 - DNA, 22 bp, Artificial Sequence
  chemically synthesized
tcaggtttctaaaagaccagat

SEQ ID NO: 145559 - DNA, 22 bp, Artificial Sequence
  chemically synthesized
ctaaaagaccagatggttgtag

SEQ ID NO: 145560 - DNA, 22 bp, Artificial Sequence
  chemically synthesized
taaaagaccagatggttgtagg

SEQ ID NO: 145561 - DNA, 22 bp, Artificial Sequence
  chemically synthesized
aaagaccagatggttgtaggta

SEQ ID NO: 145562 - DNA, 22 bp, Artificial Sequence
  chemically synthesized
taggtacaatatgcagtttctt

SEQ ID NO: 145563 - DNA, 22 bp, Artificial Sequence
  chemically synthesized
cttcaagtcatataataccatc

SEQ ID NO: 145564 - DNA, 22 bp, Artificial Sequence
  chemically synthesized
ttcaagtcatataataccatct

SEQ ID NO: 145565 - DNA, 22 bp, Artificial Sequence
  chemically synthesized
caagtcatataataccatctga

SEQ ID NO: 145566 - DNA, 22 bp, Artificial Sequence
  chemically synthesized
aagtcatataataccatctgaa

SEQ ID NO: 145567 - DNA, 22 bp, Artificial Sequence
  chemically synthesized
aaatctcttattaattcatttc

SEQ ID NO: 145568 - DNA, 22 bp, Artificial Sequence
  chemically synthesized
ttattaattcatttcttttagt

SEQ ID NO: 145569 - DNA, 22 bp, Artificial Sequence
  chemically synthesized
attaattcatttcttttagtat

SEQ ID NO: 145570 - DNA, 22 bp, Artificial Sequence
  chemically synthesized
ttaattcatttcttttagtatg

SEQ ID NO: 145571 - DNA, 22 bp, Artificial Sequence
  chemically synthesized
attcatttcttttagtatgtat

SEQ ID NO: 145572 - DNA, 22 bp, Artificial Sequence
  chemically synthesized
atttcttttagtatgtatgctg

SEQ ID NO: 145573 - DNA, 22 bp, Artificial Sequence
  chemically synthesized
cttttagtatgtatgctggtct

SEQ ID NO: 145574 - DNA, 22 bp, Artificial Sequence
  chemically synthesized
ttttagtatgtatgctggtctc

SEQ ID NO: 145575 - DNA, 22 bp, Artificial Sequence
  chemically synthesized
ttagtatgtatgctggtctcct

SEQ ID NO: 145576 - DNA, 22 bp, Artificial Sequence
  chemically synthesized
tagtatgtatgctggtctcctc

SEQ ID NO: 145577 - DNA, 22 bp, Artificial Sequence
  chemically synthesized
agtatgtatgctggtctcctct

SEQ ID NO: 145578 - DNA, 22 bp, Artificial Sequence
  chemically synthesized
gtatgtatgctggtctcctctg

SEQ ID NO: 145579 - DNA, 22 bp, Artificial Sequence
  chemically synthesized
gtctcctctgctcactatagtg

SEQ ID NO: 145580 - DNA, 22 bp, Artificial Sequence
  chemically synthesized
ctctgctcactatagtgagggc

SEQ ID NO: 145581 - DNA, 22 bp, Artificial Sequence
  chemically synthesized
tgctcactatagtgagggcacc

SEQ ID NO: 145582 - DNA, 22 bp, Artificial Sequence
  chemically synthesized
ctcactatagtgagggcaccat

SEQ ID NO: 145583 - DNA, 22 bp, Artificial Sequence
  chemically synthesized
actatagtgagggcaccattag

SEQ ID NO: 145584 - DNA, 22 bp, Artificial Sequence
  chemically synthesized
tagtgagggcaccattagccag

SEQ ID NO: 145585 - DNA, 22 bp, Artificial Sequence
  chemically synthesized
gccagagaatctgtctgtctag

SEQ ID NO: 145586 - DNA, 22 bp, Artificial Sequence
  chemically synthesized
tctgtctagttcatgtaagatt

SEQ ID NO: 145587 - DNA, 22 bp, Artificial Sequence
  chemically synthesized
tctagttcatgtaagattctca

SEQ ID NO: 145588 - DNA, 22 bp, Artificial Sequence
  chemically synthesized
gttcatgtaagattctcagaat

SEQ ID NO: 145589 - DNA, 22 bp, Artificial Sequence
  chemically synthesized
atgtaagattctcagaattaag

SEQ ID NO: 145590 - DNA, 22 bp, Artificial Sequence
  chemically synthesized
tcagaattaagaaaaatggatg

SEQ ID NO: 145591 - DNA, 22 bp, Artificial Sequence
  chemically synthesized
agaattaagaaaaatggatggc

SEQ ID NO: 145592 - DNA, 22 bp, Artificial Sequence
  chemically synthesized
agaaaaatggatggcatatgaa

SEQ ID NO: 145593 - DNA, 22 bp, Artificial Sequence
  chemically synthesized
catggatgacatatggaatcta

SEQ ID NO: 145594 - DNA, 22 bp, Artificial Sequence
  chemically synthesized
atggatgacatatggaatctaa

SEQ ID NO: 145595 - DNA, 22 bp, Artificial Sequence
  chemically synthesized
atatgtatttgttgaattaatg

SEQ ID NO: 145596 - DNA, 22 bp, Artificial Sequence
  chemically synthesized
gttgaattaatgcataagatgc

SEQ ID NO: 145597 - DNA, 22 bp, Artificial Sequence
  chemically synthesized
ttgaattaatgcataagatgca

SEQ ID NO: 145598 - DNA, 22 bp, Artificial Sequence
  chemically synthesized
aattaatgcataagatgcaaca

SEQ ID NO: 145599 - DNA, 22 bp, Artificial Sequence
  chemically synthesized
atgcataagatgcaacagagag

SEQ ID NO: 145600 - DNA, 22 bp, Artificial Sequence
  chemically synthesized
acaactgcaatgataacctggt

SEQ ID NO: 145601 - DNA, 22 bp, Artificial Sequence
  chemically synthesized
caatgataacctggtattgatg

SEQ ID NO: 145602 - DNA, 22 bp, Artificial Sequence
  chemically synthesized
gtattgatgatataagagtcta

SEQ ID NO: 145603 - DNA, 22 bp, Artificial Sequence
  chemically synthesized
atgatataagagtctatagatc

SEQ ID NO: 145604 - DNA, 22 bp, Artificial Sequence
  chemically synthesized
tagatcacagtagaagcaataa

SEQ ID NO: 145605 - DNA, 22 bp, Artificial Sequence
  chemically synthesized
gaaatggggaacagccacaaac

SEQ ID NO: 145606 - DNA, 22 bp, Artificial Sequence
  chemically synthesized
ccaggaaagtgactgcaggtca

SEQ ID NO: 145607 - DNA, 22 bp, Artificial Sequence
  chemically synthesized
caggaaagtgactgcaggtcac

SEQ ID NO: 145608 - DNA, 22 bp, Artificial Sequence
  chemically synthesized
caggtcacttttcctggagcgg

SEQ ID NO: 145609 - DNA, 22 bp, Artificial Sequence
  chemically synthesized
ttcctggagcgggtgagagaaa

SEQ ID NO: 145610 - DNA, 22 bp, Artificial Sequence
  chemically synthesized
tcctggagcgggtgagagaaaa

SEQ ID NO: 145611 - DNA, 22 bp, Artificial Sequence
  chemically synthesized
cctggagcgggtgagagaaaag

SEQ ID NO: 145612 - DNA, 22 bp, Artificial Sequence
  chemically synthesized
ctggagcgggtgagagaaaagt

SEQ ID NO: 145613 - DNA, 22 bp, Artificial Sequence
  chemically synthesized
gagcgggtgagagaaaagtgga

SEQ ID NO: 145614 - DNA, 22 bp, Artificial Sequence
  chemically synthesized
gcagtaactgctgaattcctgg

SEQ ID NO: 145615 - DNA, 22 bp, Artificial Sequence
  chemically synthesized
ctgaattcctggttggctgatg

SEQ ID NO: 145616 - DNA, 22 bp, Artificial Sequence
  chemically synthesized
aattcctggttggctgatggaa

SEQ ID NO: 145617 - DNA, 22 bp, Artificial Sequence
  chemically synthesized
ctggttggctgatggaaagatg

SEQ ID NO: 145618 - DNA, 22 bp, Artificial Sequence
  chemically synthesized
gttggctgatggaaagatgggg

SEQ ID NO: 145619 - DNA, 22 bp, Artificial Sequence
  chemically synthesized
gctgatggaaagatggggcagc

SEQ ID NO: 145620 - DNA, 22 bp, Artificial Sequence
  chemically synthesized
atggaaagatggggcagctgtt

SEQ ID NO: 145621 - DNA, 22 bp, Artificial Sequence
  chemically synthesized
ttcactggtacgcagggtttta

SEQ ID NO: 145622 - DNA, 22 bp, Artificial Sequence
  chemically synthesized
actggtacgcagggttttagat

SEQ ID NO: 145623 - DNA, 22 bp, Artificial Sequence
  chemically synthesized
gtacgcagggttttagatgtat

SEQ ID NO: 145624 - DNA, 22 bp, Artificial Sequence
  chemically synthesized
tagatgtatgtacctaaggata

SEQ ID NO: 145625 - DNA, 22 bp, Artificial Sequence
  chemically synthesized
agatgtatgtacctaaggatat

SEQ ID NO: 145626 - DNA, 22 bp, Artificial Sequence
  chemically synthesized
gatgtatgtacctaaggatatg

SEQ ID NO: 145627 - DNA, 22 bp, Artificial Sequence
  chemically synthesized
aggatatgaggtatggcaatga

SEQ ID NO: 145628 - DNA, 22 bp, Artificial Sequence
  chemically synthesized
ttttgggaatgagttttagggc

SEQ ID NO: 145629 - DNA, 22 bp, Artificial Sequence
  chemically synthesized
ttgggaatgagttttagggcca

SEQ ID NO: 145630 - DNA, 22 bp, Artificial Sequence
  chemically synthesized
tgggaatgagttttagggccat

SEQ ID NO: 145631 - DNA, 22 bp, Artificial Sequence
  chemically synthesized
gggaatgagttttagggccatt

SEQ ID NO: 145632 - DNA, 22 bp, Artificial Sequence
  chemically synthesized
ggaatgagttttagggccatta

SEQ ID NO: 145633 - DNA, 22 bp, Artificial Sequence
  chemically synthesized
tagggccattaaaggacatgac

SEQ ID NO: 145634 - DNA, 22 bp, Artificial Sequence
  chemically synthesized
agggccattaaaggacatgacc

SEQ ID NO: 145635 - DNA, 22 bp, Artificial Sequence
  chemically synthesized
gggccattaaaggacatgacct

SEQ ID NO: 145636 - DNA, 22 bp, Artificial Sequence
  chemically synthesized
aaggacatgacctgaagtttcc

SEQ ID NO: 145637 - DNA, 22 bp, Artificial Sequence
  chemically synthesized
aagtttcctctgaggccagtcc

SEQ ID NO: 145638 - DNA, 22 bp, Artificial Sequence
  chemically synthesized
cctctgaggccagtccccacaa

SEQ ID NO: 145639 - DNA, 22 bp, Artificial Sequence
  chemically synthesized
ctctgaggccagtccccacaac

SEQ ID NO: 145640 - DNA, 22 bp, Artificial Sequence
  chemically synthesized
tgaggccagtccccacaactca

SEQ ID NO: 145641 - DNA, 22 bp, Artificial Sequence
  chemically synthesized
aggccagtccccacaactcaat

SEQ ID NO: 145642 - DNA, 22 bp, Artificial Sequence
  chemically synthesized
aatataaatgtgtttcctgcat

SEQ ID NO: 145643 - DNA, 22 bp, Artificial Sequence
  chemically synthesized
cctgcatatagtcaaagttgcc

SEQ ID NO: 145644 - DNA, 22 bp, Artificial Sequence
  chemically synthesized
ctgcatatagtcaaagttgcca

SEQ ID NO: 145645 - DNA, 22 bp, Artificial Sequence
  chemically synthesized
catatagtcaaagttgccactt

SEQ ID NO: 145646 - DNA, 22 bp, Artificial Sequence
  chemically synthesized
ccacttctttttcttcatatca

SEQ ID NO: 145647 - DNA, 22 bp, Artificial Sequence
  chemically synthesized
ctttttcttcatatcatcgatc

SEQ ID NO: 145648 - DNA, 22 bp, Artificial Sequence
  chemically synthesized
tttttcttcatatcatcgatct

SEQ ID NO: 145649 - DNA, 22 bp, Artificial Sequence
  chemically synthesized
tttcttcatatcatcgatctct

SEQ ID NO: 145650 - DNA, 22 bp, Artificial Sequence
  chemically synthesized
ttcttcatatcatcgatctctg

SEQ ID NO: 145651 - DNA, 22 bp, Artificial Sequence
  chemically synthesized
tcttcatatcatcgatctctgc

SEQ ID NO: 145652 - DNA, 22 bp, Artificial Sequence
  chemically synthesized
cttcatatcatcgatctctgct

SEQ ID NO: 145653 - DNA, 22 bp, Artificial Sequence
  chemically synthesized
ttcatatcatcgatctctgctc

SEQ ID NO: 145654 - DNA, 22 bp, Artificial Sequence
  chemically synthesized
catatcatcgatctctgctctt

SEQ ID NO: 145655 - DNA, 22 bp, Artificial Sequence
  chemically synthesized
atatcatcgatctctgctctta

SEQ ID NO: 145656 - DNA, 22 bp, Artificial Sequence
  chemically synthesized
tgctcttaaagataatcttggt

SEQ ID NO: 145657 - DNA, 22 bp, Artificial Sequence
  chemically synthesized
ctcttaaagataatcttggttt

SEQ ID NO: 145658 - DNA, 22 bp, Artificial Sequence
  chemically synthesized
ttaaagataatcttggttttgc

SEQ ID NO: 145659 - DNA, 22 bp, Artificial Sequence
  chemically synthesized
aaagataatcttggttttgcct

SEQ ID NO: 145660 - DNA, 22 bp, Artificial Sequence
  chemically synthesized
aagataatcttggttttgcctc

SEQ ID NO: 145661 - DNA, 22 bp, Artificial Sequence
  chemically synthesized
ggttttgcctcaaactgtttgt

SEQ ID NO: 145662 - DNA, 22 bp, Artificial Sequence
  chemically synthesized
gttttgcctcaaactgtttgtc

SEQ ID NO: 145663 - DNA, 22 bp, Artificial Sequence
  chemically synthesized
tgcctcaaactgtttgtcacta

SEQ ID NO: 145664 - DNA, 22 bp, Artificial Sequence
  chemically synthesized
gcctcaaactgtttgtcactac

SEQ ID NO: 145665 - DNA, 22 bp, Artificial Sequence
  chemically synthesized
cctcaaactgtttgtcactaca

SEQ ID NO: 145666 - DNA, 22 bp, Artificial Sequence
  chemically synthesized
aaactgtttgtcactacaaact

SEQ ID NO: 145667 - DNA, 22 bp, Artificial Sequence
  chemically synthesized
tttgtcactacaaactttcccc

SEQ ID NO: 145668 - DNA, 22 bp, Artificial Sequence
  chemically synthesized
gtcactacaaactttccccatg

SEQ ID NO: 145669 - DNA, 22 bp, Artificial Sequence
  chemically synthesized
tcactacaaactttccccatgt

SEQ ID NO: 145670 - DNA, 22 bp, Artificial Sequence
  chemically synthesized
caaactttccccatgttcctaa

SEQ ID NO: 145671 - DNA, 22 bp, Artificial Sequence
  chemically synthesized
tccccatgttcctaagtaaaac

SEQ ID NO: 145672 - DNA, 22 bp, Artificial Sequence
  chemically synthesized
ccccatgttcctaagtaaaaca

SEQ ID NO: 145673 - DNA, 22 bp, Artificial Sequence
  chemically synthesized
cccatgttcctaagtaaaacag

SEQ ID NO: 145674 - DNA, 22 bp, Artificial Sequence
  chemically synthesized
ctaagtaaaacaggtaactgcc

SEQ ID NO: 145675 - DNA, 22 bp, Artificial Sequence
  chemically synthesized
agtaaaacaggtaactgcctct

SEQ ID NO: 145676 - DNA, 22 bp, Artificial Sequence
  chemically synthesized
cctctcaactatatcaagtaga

SEQ ID NO: 145677 - DNA, 22 bp, Artificial Sequence
  chemically synthesized
tcaactatatcaagtagactaa

SEQ ID NO: 145678 - DNA, 22 bp, Artificial Sequence
  chemically synthesized
aactatatcaagtagactaaaa

SEQ ID NO: 145679 - DNA, 22 bp, Artificial Sequence
  chemically synthesized
tatcaagtagactaaaatattg

SEQ ID NO: 145680 - DNA, 22 bp, Artificial Sequence
  chemically synthesized
aaatattgtgtctctaatatca

SEQ ID NO: 145681 - DNA, 22 bp, Artificial Sequence
  chemically synthesized
tgtctctaatatcagaaattca

SEQ ID NO: 145682 - DNA, 22 bp, Artificial Sequence
  chemically synthesized
taatatcagaaattcagcttta

SEQ ID NO: 145683 - DNA, 22 bp, Artificial Sequence
  chemically synthesized
atatcagaaattcagctttaat

SEQ ID NO: 145684 - DNA, 22 bp, Artificial Sequence
  chemically synthesized
agctttaatatattgggtttaa

SEQ ID NO: 145685 - DNA, 22 bp, Artificial Sequence
  chemically synthesized
taatatattgggtttaactctt

SEQ ID NO: 145686 - DNA, 22 bp, Artificial Sequence
  chemically synthesized
aatatattgggtttaactcttt

SEQ ID NO: 145687 - DNA, 22 bp, Artificial Sequence
  chemically synthesized
atatattgggtttaactctttg

SEQ ID NO: 145688 - DNA, 22 bp, Artificial Sequence
  chemically synthesized
ggtttaactctttgaaatttag

SEQ ID NO: 145689 - DNA, 22 bp, Artificial Sequence
  chemically synthesized
aactctttgaaatttagagtct

SEQ ID NO: 145690 - DNA, 22 bp, Artificial Sequence
  chemically synthesized
actctttgaaatttagagtctc

SEQ ID NO: 145691 - DNA, 22 bp, Artificial Sequence
  chemically synthesized
tttgaaatttagagtctccttg

SEQ ID NO: 145692 - DNA, 22 bp, Artificial Sequence
  chemically synthesized
tgaaatttagagtctccttgaa

SEQ ID NO: 145693 - DNA, 22 bp, Artificial Sequence
  chemically synthesized
gaaatttagagtctccttgaaa

SEQ ID NO: 145694 - DNA, 22 bp, Artificial Sequence
  chemically synthesized
aaatttagagtctccttgaaat

SEQ ID NO: 145695 - DNA, 22 bp, Artificial Sequence
  chemically synthesized
agagtctccttgaaatacacat

SEQ ID NO: 145696 - DNA, 22 bp, Artificial Sequence
  chemically synthesized
gagtctccttgaaatacacatg

SEQ ID NO: 145697 - DNA, 22 bp, Artificial Sequence
  chemically synthesized
cttgaaatacacatgggggtga

SEQ ID NO: 145698 - DNA, 22 bp, Artificial Sequence
  chemically synthesized
gaaatacacatgggggtgattt

SEQ ID NO: 145699 - DNA, 22 bp, Artificial Sequence
  chemically synthesized
aaatacacatgggggtgatttc

SEQ ID NO: 145700 - DNA, 22 bp, Artificial Sequence
  chemically synthesized
cctaaactttatttcttgtaag

SEQ ID NO: 145701 - DNA, 22 bp, Artificial Sequence
  chemically synthesized
ctaaactttatttcttgtaagg

SEQ ID NO: 145702 - DNA, 22 bp, Artificial Sequence
  chemically synthesized
aactttatttcttgtaaggatt

SEQ ID NO: 145703 - DNA, 22 bp, Artificial Sequence
  chemically synthesized
tatttcttgtaaggatttatct

SEQ ID NO: 145704 - DNA, 22 bp, Artificial Sequence
  chemically synthesized
atttcttgtaaggatttatctc

SEQ ID NO: 145705 - DNA, 22 bp, Artificial Sequence
  chemically synthesized
tttcttgtaaggatttatctca

SEQ ID NO: 145706 - DNA, 22 bp, Artificial Sequence
  chemically synthesized
cttgtaaggatttatctcaggg

SEQ ID NO: 145707 - DNA, 22 bp, Artificial Sequence
  chemically synthesized
ttgtaaggatttatctcagggg

SEQ ID NO: 145708 - DNA, 22 bp, Artificial Sequence
  chemically synthesized
gtaaggatttatctcaggggta

SEQ ID NO: 145709 - DNA, 22 bp, Artificial Sequence
  chemically synthesized
taaggatttatctcaggggtaa

SEQ ID NO: 145710 - DNA, 22 bp, Artificial Sequence
  chemically synthesized
atctcaggggtaacacacaaac

SEQ ID NO: 145711 - DNA, 22 bp, Artificial Sequence
  chemically synthesized
tctcaggggtaacacacaaacc

SEQ ID NO: 145712 - DNA, 22 bp, Artificial Sequence
  chemically synthesized
aggggtaacacacaaaccagca

SEQ ID NO: 145713 - DNA, 22 bp, Artificial Sequence
  chemically synthesized
aacctctaagtatgaggacagt

SEQ ID NO: 145714 - DNA, 22 bp, Artificial Sequence
  chemically synthesized
taagtatgaggacagtaagcct

SEQ ID NO: 145715 - DNA, 22 bp, Artificial Sequence
  chemically synthesized
agtatgaggacagtaagcctta

SEQ ID NO: 145716 - DNA, 22 bp, Artificial Sequence
  chemically synthesized
aagaatataaaataaactgttc

SEQ ID NO: 145717 - DNA, 22 bp, Artificial Sequence
  chemically synthesized
agaatataaaataaactgttct

SEQ ID NO: 145718 - DNA, 22 bp, Artificial Sequence
  chemically synthesized
ttcttctctctgccggtggaag

SEQ ID NO: 145719 - DNA, 22 bp, Artificial Sequence
  chemically synthesized
ttctctctgccggtggaagtgt

SEQ ID NO: 145720 - DNA, 22 bp, Artificial Sequence
  chemically synthesized
ctctctgccggtggaagtgtgc

SEQ ID NO: 145721 - DNA, 22 bp, Artificial Sequence
  chemically synthesized
tctctgccggtggaagtgtgcc

SEQ ID NO: 145722 - DNA, 22 bp, Artificial Sequence
  chemically synthesized
tctgccggtggaagtgtgccct

SEQ ID NO: 145723 - DNA, 22 bp, Artificial Sequence
  chemically synthesized
tgccggtggaagtgtgccctgt

SEQ ID NO: 145724 - DNA, 22 bp, Artificial Sequence
  chemically synthesized
ccggtggaagtgtgccctgtct

SEQ ID NO: 145725 - DNA, 22 bp, Artificial Sequence
  chemically synthesized
tctattcctgaaattgcttgtt

SEQ ID NO: 145726 - DNA, 22 bp, Artificial Sequence
  chemically synthesized
ttcctgaaattgcttgtttgag

SEQ ID NO: 145727 - DNA, 22 bp, Artificial Sequence
  chemically synthesized
ctgaaattgcttgtttgagacg

SEQ ID NO: 145728 - DNA, 22 bp, Artificial Sequence
  chemically synthesized
aaattgcttgtttgagacgcat

SEQ ID NO: 145729 - DNA, 22 bp, Artificial Sequence
  chemically synthesized
cttgtttgagacgcatgagacg

SEQ ID NO: 145730 - DNA, 22 bp, Artificial Sequence
  chemically synthesized
gtttgagacgcatgagacgtgc

SEQ ID NO: 145731 - DNA, 22 bp, Artificial Sequence
  chemically synthesized
tttgagacgcatgagacgtgca

SEQ ID NO: 145732 - DNA, 22 bp, Artificial Sequence
  chemically synthesized
gagacgcatgagacgtgcagca

SEQ ID NO: 145733 - DNA, 22 bp, Artificial Sequence
  chemically synthesized
agacgcatgagacgtgcagcac

SEQ ID NO: 145734 - DNA, 22 bp, Artificial Sequence
  chemically synthesized
tggaatattgtcagtgaagaat

SEQ ID NO: 145735 - DNA, 22 bp, Artificial Sequence
  chemically synthesized
tcagtgaagaatgtctttgcct

SEQ ID NO: 145736 - DNA, 22 bp, Artificial Sequence
  chemically synthesized
tgcctgattagatataaagaca

SEQ ID NO: 145737 - DNA, 22 bp, Artificial Sequence
  chemically synthesized
gcctgattagatataaagacaa

SEQ ID NO: 145738 - DNA, 22 bp, Artificial Sequence
  chemically synthesized
cctgattagatataaagacaag

SEQ ID NO: 145739 - DNA, 22 bp, Artificial Sequence
  chemically synthesized
attagatataaagacaagttaa

SEQ ID NO: 145740 - DNA, 22 bp, Artificial Sequence
  chemically synthesized
gatataaagacaagttaaacac

SEQ ID NO: 145741 - DNA, 22 bp, Artificial Sequence
  chemically synthesized
aacacagcattagactatagat

SEQ ID NO: 145742 - DNA, 22 bp, Artificial Sequence
  chemically synthesized
gactatagatcaagcctgtgcc

SEQ ID NO: 145743 - DNA, 22 bp, Artificial Sequence
  chemically synthesized
tagatcaagcctgtgccagaca

SEQ ID NO: 145744 - DNA, 22 bp, Artificial Sequence
  chemically synthesized
tgccagacacaaatgacctaat

SEQ ID NO: 145745 - DNA, 22 bp, Artificial Sequence
  chemically synthesized
atgcccagcacgggccacggaa

SEQ ID NO: 145746 - DNA, 22 bp, Artificial Sequence
  chemically synthesized
ctatcctcttgcttgaacagag

SEQ ID NO: 145747 - DNA, 22 bp, Artificial Sequence
  chemically synthesized
tcctcttgcttgaacagagcag

SEQ ID NO: 145748 - DNA, 22 bp, Artificial Sequence
  chemically synthesized
ttgcttgaacagagcagcacac

SEQ ID NO: 145749 - DNA, 22 bp, Artificial Sequence
  chemically synthesized
gcttgaacagagcagcacactt

SEQ ID NO: 145750 - DNA, 22 bp, Artificial Sequence
  chemically synthesized
cttgaacagagcagcacacttc

SEQ ID NO: 145751 - DNA, 22 bp, Artificial Sequence
  chemically synthesized
gaacagagcagcacacttctcc

SEQ ID NO: 145752 - DNA, 22 bp, Artificial Sequence
  chemically synthesized
aacagagcagcacacttctccc

SEQ ID NO: 145753 - DNA, 22 bp, Artificial Sequence
  chemically synthesized
ctcccccaacactattagatgt

SEQ ID NO: 145754 - DNA, 22 bp, Artificial Sequence
  chemically synthesized
tcccccaacactattagatgtt

SEQ ID NO: 145755 - DNA, 22 bp, Artificial Sequence
  chemically synthesized
ccccaacactattagatgttct

SEQ ID NO: 145756 - DNA, 22 bp, Artificial Sequence
  chemically synthesized
ttagatgttctggcataatttt

SEQ ID NO: 145757 - DNA, 22 bp, Artificial Sequence
  chemically synthesized
gatgttctggcataattttgta

SEQ ID NO: 145758 - DNA, 22 bp, Artificial Sequence
  chemically synthesized
tggcataattttgtagatatgt

SEQ ID NO: 145759 - DNA, 22 bp, Artificial Sequence
  chemically synthesized
gcataattttgtagatatgtag

SEQ ID NO: 145760 - DNA, 22 bp, Artificial Sequence
  chemically synthesized
tgtagatatgtaggatttgaca

SEQ ID NO: 145761 - DNA, 22 bp, Artificial Sequence
  chemically synthesized
gtagatatgtaggatttgacat

SEQ ID NO: 145762 - DNA, 22 bp, Artificial Sequence
  chemically synthesized
tagatatgtaggatttgacatg

SEQ ID NO: 145763 - DNA, 22 bp, Artificial Sequence
  chemically synthesized
gacatggactattgttcaatga

SEQ ID NO: 145764 - DNA, 22 bp, Artificial Sequence
  chemically synthesized
acatggactattgttcaatgat

SEQ ID NO: 145765 - DNA, 22 bp, Artificial Sequence
  chemically synthesized
ttgttcaatgattcagaggaaa

SEQ ID NO: 145766 - DNA, 22 bp, Artificial Sequence
  chemically synthesized
ttcaatgattcagaggaaatct

SEQ ID NO: 145767 - DNA, 22 bp, Artificial Sequence
  chemically synthesized
aatgattcagaggaaatctcct

SEQ ID NO: 145768 - DNA, 22 bp, Artificial Sequence
  chemically synthesized
agaggaaatctcctttgttcag

SEQ ID NO: 145769 - DNA, 22 bp, Artificial Sequence
  chemically synthesized
ctttgttcagataagtacactg

SEQ ID NO: 145770 - DNA, 22 bp, Artificial Sequence
  chemically synthesized
tgttcagataagtacactgact

SEQ ID NO: 145771 - DNA, 22 bp, Artificial Sequence
  chemically synthesized
gttcagataagtacactgacta

SEQ ID NO: 145772 - DNA, 22 bp, Artificial Sequence
  chemically synthesized
ttcagataagtacactgactac

SEQ ID NO: 145773 - DNA, 22 bp, Artificial Sequence
  chemically synthesized
agataagtacactgactactaa

SEQ ID NO: 145774 - DNA, 22 bp, Artificial Sequence
  chemically synthesized
actactaaatggattaaaaaac

SEQ ID NO: 145775 - DNA, 22 bp, Artificial Sequence
  chemically synthesized
ctaaatggattaaaaaacacag

SEQ ID NO: 145776 - DNA, 22 bp, Artificial Sequence
  chemically synthesized
aatggattaaaaaacacagtaa

SEQ ID NO: 145777 - DNA, 22 bp, Artificial Sequence
  chemically synthesized
aaaaacacagtaataaaaccca

SEQ ID NO: 145778 - DNA, 22 bp, Artificial Sequence
  chemically synthesized
tccccttacttccctagtttgt

SEQ ID NO: 145779 - DNA, 22 bp, Artificial Sequence
  chemically synthesized
ccccttacttccctagtttgtt

SEQ ID NO: 145780 - DNA, 22 bp, Artificial Sequence
  chemically synthesized
cccttacttccctagtttgttt

SEQ ID NO: 145781 - DNA, 22 bp, Artificial Sequence
  chemically synthesized
acttccctagtttgtttcttat

SEQ ID NO: 145782 - DNA, 22 bp, Artificial Sequence
  chemically synthesized
cttccctagtttgtttcttatt

SEQ ID NO: 145783 - DNA, 22 bp, Artificial Sequence
  chemically synthesized
ccctagtttgtttcttattctg

SEQ ID NO: 145784 - DNA, 22 bp, Artificial Sequence
  chemically synthesized
cctagtttgtttcttattctgc

SEQ ID NO: 145785 - DNA, 22 bp, Artificial Sequence
  chemically synthesized
gtttgtttcttattctgctttc

SEQ ID NO: 145786 - DNA, 22 bp, Artificial Sequence
  chemically synthesized
gtttcttattctgctttcttcc

SEQ ID NO: 145787 - DNA, 22 bp, Artificial Sequence
  chemically synthesized
tttcttattctgctttcttcca

SEQ ID NO: 145788 - DNA, 22 bp, Artificial Sequence
  chemically synthesized
cttattctgctttcttccaagt

SEQ ID NO: 145789 - DNA, 22 bp, Artificial Sequence
  chemically synthesized
ttattctgctttcttccaagtt

SEQ ID NO: 145790 - DNA, 22 bp, Artificial Sequence
  chemically synthesized
attctgctttcttccaagttga

SEQ ID NO: 145791 - DNA, 22 bp, Artificial Sequence
  chemically synthesized
ttctgctttcttccaagttgat

SEQ ID NO: 145792 - DNA, 22 bp, Artificial Sequence
  chemically synthesized
tgctttcttccaagttgatgct

SEQ ID NO: 145793 - DNA, 22 bp, Artificial Sequence
  chemically synthesized
ctttcttccaagttgatgctgg

SEQ ID NO: 145794 - DNA, 22 bp, Artificial Sequence
  chemically synthesized
tcttccaagttgatgctggata

SEQ ID NO: 145795 - DNA, 22 bp, Artificial Sequence
  chemically synthesized
cttccaagttgatgctggatag

SEQ ID NO: 145796 - DNA, 22 bp, Artificial Sequence
  chemically synthesized
ttccaagttgatgctggataga

SEQ ID NO: 145797 - DNA, 22 bp, Artificial Sequence
  chemically synthesized
ccaagttgatgctggatagagg

SEQ ID NO: 145798 - DNA, 22 bp, Artificial Sequence
  chemically synthesized
caagttgatgctggatagaggt

SEQ ID NO: 145799 - DNA, 22 bp, Artificial Sequence
  chemically synthesized
atgctggatagaggtgtttatt

SEQ ID NO: 145800 - DNA, 22 bp, Artificial Sequence
  chemically synthesized
gatagaggtgtttatttctatt

SEQ ID NO: 145801 - DNA, 22 bp, Artificial Sequence
  chemically synthesized
atttctattctaaaaagtgatg

SEQ ID NO: 145802 - DNA, 22 bp, Artificial Sequence
  chemically synthesized
tttctattctaaaaagtgatga

SEQ ID NO: 145803 - DNA, 22 bp, Artificial Sequence
  chemically synthesized
ctattctaaaaagtgatgaaat

SEQ ID NO: 145804 - DNA, 22 bp, Artificial Sequence
  chemically synthesized
tattctaaaaagtgatgaaatt

SEQ ID NO: 145805 - DNA, 22 bp, Artificial Sequence
  chemically synthesized
ttctaaaaagtgatgaaattgg

SEQ ID NO: 145806 - DNA, 22 bp, Artificial Sequence
  chemically synthesized
taaaaagtgatgaaattggccg

SEQ ID NO: 145807 - DNA, 22 bp, Artificial Sequence
  chemically synthesized
aaaagtgatgaaattggccggg

SEQ ID NO: 145808 - DNA, 22 bp, Artificial Sequence
  chemically synthesized
gccgggcgcggtggctcacacc

SEQ ID NO: 145809 - DNA, 22 bp, Artificial Sequence
  chemically synthesized
acacctgtaatcccagcacttt

SEQ ID NO: 145810 - DNA, 22 bp, Artificial Sequence
  chemically synthesized
taatcccagcactttgggaggc

SEQ ID NO: 145811 - DNA, 22 bp, Artificial Sequence
  chemically synthesized
tgggaggctgaggtgggcggat

SEQ ID NO: 145812 - DNA, 22 bp, Artificial Sequence
  chemically synthesized
gggaggctgaggtgggcggatc

SEQ ID NO: 145813 - DNA, 22 bp, Artificial Sequence
  chemically synthesized
ggaggctgaggtgggcggatca

SEQ ID NO: 145814 - DNA, 22 bp, Artificial Sequence
  chemically synthesized
aggtgggcggatcacgaggtca

SEQ ID NO: 145815 - DNA, 22 bp, Artificial Sequence
  chemically synthesized
gctaacatggtgaaaccccatc

SEQ ID NO: 145816 - DNA, 22 bp, Artificial Sequence
  chemically synthesized
acatggtgaaaccccatctcta

SEQ ID NO: 145817 - DNA, 22 bp, Artificial Sequence
  chemically synthesized
tactaaaaatacaaaaaattag

SEQ ID NO: 145818 - DNA, 22 bp, Artificial Sequence
  chemically synthesized
ctaaaaatacaaaaaattagcc

SEQ ID NO: 145819 - DNA, 22 bp, Artificial Sequence
  chemically synthesized
aaaatacaaaaaattagccaga

SEQ ID NO: 145820 - DNA, 22 bp, Artificial Sequence
  chemically synthesized
gccagagacagtggcgggtgcc

SEQ ID NO: 145821 - DNA, 22 bp, Artificial Sequence
  chemically synthesized
tagtcccagctactcgggaggc

SEQ ID NO: 145822 - DNA, 22 bp, Artificial Sequence
  chemically synthesized
ctcgggaggctgaggcaggaga

SEQ ID NO: 145823 - DNA, 22 bp, Artificial Sequence
  chemically synthesized
gggaggctgaggcaggagaatg

SEQ ID NO: 145824 - DNA, 22 bp, Artificial Sequence
  chemically synthesized
aggcaggagaatggcgtgaacc

SEQ ID NO: 145825 - DNA, 22 bp, Artificial Sequence
  chemically synthesized
ggaggcagagcttgcggtgagc

SEQ ID NO: 145826 - DNA, 22 bp, Artificial Sequence
  chemically synthesized
gcggtgagcagagatcgcgcca

SEQ ID NO: 145827 - DNA, 22 bp, Artificial Sequence
  chemically synthesized
cggtgagcagagatcgcgccac

SEQ ID NO: 145828 - DNA, 22 bp, Artificial Sequence
  chemically synthesized
cacactccagcctgggtgacaa

SEQ ID NO: 145829 - DNA, 22 bp, Artificial Sequence
  chemically synthesized
cagcctgggtgacaaagcgaga

SEQ ID NO: 145830 - DNA, 22 bp, Artificial Sequence
  chemically synthesized
ggtgacaaagcgagactccatc

SEQ ID NO: 145831 - DNA, 22 bp, Artificial Sequence
  chemically synthesized
catctcaaaaaaaaaaaaaaaa

SEQ ID NO: 145832 - DNA, 22 bp, Artificial Sequence
  chemically synthesized
aaaaaaaaaaaaaaaaaaaaga

SEQ ID NO: 145833 - DNA, 22 bp, Artificial Sequence
  chemically synthesized
atgaaattgtgtattcaatgta

SEQ ID NO: 145834 - DNA, 22 bp, Artificial Sequence
  chemically synthesized
tgtattcaatgtagtctcaaga

SEQ ID NO: 145835 - DNA, 22 bp, Artificial Sequence
  chemically synthesized
aatgtagtctcaagagaattga

SEQ ID NO: 145836 - DNA, 22 bp, Artificial Sequence
  chemically synthesized
aagagaattgaaaaccaagaaa

SEQ ID NO: 145837 - DNA, 22 bp, Artificial Sequence
  chemically synthesized
aaaaccaagaaaggctgtggct

SEQ ID NO: 145838 - DNA, 22 bp, Artificial Sequence
  chemically synthesized
tggcttcttccacataaagcct

SEQ ID NO: 145839 - DNA, 22 bp, Artificial Sequence
  chemically synthesized
cttccacataaagcctggatga

SEQ ID NO: 145840 - DNA, 22 bp, Artificial Sequence
  chemically synthesized
ttccacataaagcctggatgaa

SEQ ID NO: 145841 - DNA, 22 bp, Artificial Sequence
  chemically synthesized
ccacataaagcctggatgaata

SEQ ID NO: 145842 - DNA, 22 bp, Artificial Sequence
  chemically synthesized
cacataaagcctggatgaataa

SEQ ID NO: 145843 - DNA, 22 bp, Artificial Sequence
  chemically synthesized
gatgaataacaggataacacgt

SEQ ID NO: 145844 - DNA, 22 bp, Artificial Sequence
  chemically synthesized
ttacattgtcacaactcctgat

SEQ ID NO: 145845 - DNA, 22 bp, Artificial Sequence
  chemically synthesized
cattgtcacaactcctgatcca

SEQ ID NO: 145846 - DNA, 22 bp, Artificial Sequence
  chemically synthesized
tcacaactcctgatccaggaat

SEQ ID NO: 145847 - DNA, 22 bp, Artificial Sequence
  chemically synthesized
ctgatccaggaattgatggcta

SEQ ID NO: 145848 - DNA, 22 bp, Artificial Sequence
  chemically synthesized
atccaggaattgatggctaaga

SEQ ID NO: 145849 - DNA, 22 bp, Artificial Sequence
  chemically synthesized
atggctaagatattcgtaattc

SEQ ID NO: 145850 - DNA, 22 bp, Artificial Sequence
  chemically synthesized
agatattcgtaattcttatcct

SEQ ID NO: 145851 - DNA, 22 bp, Artificial Sequence
  chemically synthesized
gtaattcttatccttttcagtt

SEQ ID NO: 145852 - DNA, 22 bp, Artificial Sequence
  chemically synthesized
ttatccttttcagttgtaactt

SEQ ID NO: 145853 - DNA, 22 bp, Artificial Sequence
  chemically synthesized
atccttttcagttgtaacttat

SEQ ID NO: 145854 - DNA, 22 bp, Artificial Sequence
  chemically synthesized
tccttttcagttgtaacttatt

SEQ ID NO: 145855 - DNA, 22 bp, Artificial Sequence
  chemically synthesized
ttcagttgtaacttattcctat

SEQ ID NO: 145856 - DNA, 22 bp, Artificial Sequence
  chemically synthesized
tcagttgtaacttattcctatt

SEQ ID NO: 145857 - DNA, 22 bp, Artificial Sequence
  chemically synthesized
cagttgtaacttattcctattt

SEQ ID NO: 145858 - DNA, 22 bp, Artificial Sequence
  chemically synthesized
agttgtaacttattcctatttg

SEQ ID NO: 145859 - DNA, 22 bp, Artificial Sequence
  chemically synthesized
taacttattcctatttgtcagc

SEQ ID NO: 145860 - DNA, 22 bp, Artificial Sequence
  chemically synthesized
attcctatttgtcagcattcag

SEQ ID NO: 145861 - DNA, 22 bp, Artificial Sequence
  chemically synthesized
ttcctatttgtcagcattcagg

SEQ ID NO: 145862 - DNA, 22 bp, Artificial Sequence
  chemically synthesized
ctatttgtcagcattcaggtta

SEQ ID NO: 145863 - DNA, 22 bp, Artificial Sequence
  chemically synthesized
tttgtcagcattcaggttatta

SEQ ID NO: 145864 - DNA, 22 bp, Artificial Sequence
  chemically synthesized
gtcagcattcaggttattagcg

SEQ ID NO: 145865 - DNA, 22 bp, Artificial Sequence
  chemically synthesized
tcagcattcaggttattagcgg

SEQ ID NO: 145866 - DNA, 22 bp, Artificial Sequence
  chemically synthesized
aggttattagcggctgctggcg

SEQ ID NO: 145867 - DNA, 22 bp, Artificial Sequence
  chemically synthesized
ttagcggctgctggcgaagtcc

SEQ ID NO: 145868 - DNA, 22 bp, Artificial Sequence
  chemically synthesized
gcggctgctggcgaagtccttg

SEQ ID NO: 145869 - DNA, 22 bp, Artificial Sequence
  chemically synthesized
ctggcgaagtccttgagaaata

SEQ ID NO: 145870 - DNA, 22 bp, Artificial Sequence
  chemically synthesized
gcgaagtccttgagaaataaac

SEQ ID NO: 145871 - DNA, 22 bp, Artificial Sequence
  chemically synthesized
gagaaataaactgcacactgga

SEQ ID NO: 145872 - DNA, 22 bp, Artificial Sequence
  chemically synthesized
agaaataaactgcacactggat

SEQ ID NO: 145873 - DNA, 22 bp, Artificial Sequence
  chemically synthesized
cacactggatggtgggggtagt

SEQ ID NO: 145874 - DNA, 22 bp, Artificial Sequence
  chemically synthesized
gatggtgggggtagtgtaggaa

SEQ ID NO: 145875 - DNA, 22 bp, Artificial Sequence
  chemically synthesized
caaattaagcctgaacagcaaa

SEQ ID NO: 145876 - DNA, 22 bp, Artificial Sequence
  chemically synthesized
aaattaagcctgaacagcaaag

SEQ ID NO: 145877 - DNA, 22 bp, Artificial Sequence
  chemically synthesized
agcctgaacagcaaagttcccc

SEQ ID NO: 145878 - DNA, 22 bp, Artificial Sequence
  chemically synthesized
aacagcaaagttcccctgagaa

SEQ ID NO: 145879 - DNA, 22 bp, Artificial Sequence
  chemically synthesized
ccctgagaaggccacctggatt

SEQ ID NO: 145880 - DNA, 22 bp, Artificial Sequence
  chemically synthesized
agaaggccacctggattctatc

SEQ ID NO: 145881 - DNA, 22 bp, Artificial Sequence
  chemically synthesized
gattctatcagaaactcgaatg

SEQ ID NO: 145882 - DNA, 22 bp, Artificial Sequence
  chemically synthesized
tatcagaaactcgaatgtccat

SEQ ID NO: 145883 - DNA, 22 bp, Artificial Sequence
  chemically synthesized
tcagaaactcgaatgtccatct

SEQ ID NO: 145884 - DNA, 22 bp, Artificial Sequence
  chemically synthesized
gaatgtccatcttgcaaaactt

SEQ ID NO: 145885 - DNA, 22 bp, Artificial Sequence
  chemically synthesized
gcaaaacttccttgcccaaacc

SEQ ID NO: 145886 - DNA, 22 bp, Artificial Sequence
  chemically synthesized
caaaacttccttgcccaaaccc

SEQ ID NO: 145887 - DNA, 22 bp, Artificial Sequence
  chemically synthesized
ccttgcccaaaccccacccctg

SEQ ID NO: 145888 - DNA, 22 bp, Artificial Sequence
  chemically synthesized
cttgcccaaaccccacccctgg

SEQ ID NO: 145889 - DNA, 22 bp, Artificial Sequence
  chemically synthesized
gcccaaaccccacccctggagt

SEQ ID NO: 145890 - DNA, 22 bp, Artificial Sequence
  chemically synthesized
cccaaaccccacccctggagtc

SEQ ID NO: 145891 - DNA, 22 bp, Artificial Sequence
  chemically synthesized
gagtcacaacccacccttgacc

SEQ ID NO: 145892 - DNA, 22 bp, Artificial Sequence
  chemically synthesized
gaccaatagattcattttactg

SEQ ID NO: 145893 - DNA, 22 bp, Artificial Sequence
  chemically synthesized
accaatagattcattttactga

SEQ ID NO: 145894 - DNA, 22 bp, Artificial Sequence
  chemically synthesized
attttactgagggaggcaaagg

SEQ ID NO: 145895 - DNA, 22 bp, Artificial Sequence
  chemically synthesized
tactgagggaggcaaagggctg

SEQ ID NO: 145896 - DNA, 22 bp, Artificial Sequence
  chemically synthesized
actgagggaggcaaagggctgg

SEQ ID NO: 145897 - DNA, 22 bp, Artificial Sequence
  chemically synthesized
ctgagggaggcaaagggctggt

SEQ ID NO: 145898 - DNA, 22 bp, Artificial Sequence
  chemically synthesized
agggaggcaaagggctggtcaa

SEQ ID NO: 145899 - DNA, 22 bp, Artificial Sequence
  chemically synthesized
gtcaatagattcatttcactgg

SEQ ID NO: 145900 - DNA, 22 bp, Artificial Sequence
  chemically synthesized
atttcactgggagaggcaaagg

SEQ ID NO: 145901 - DNA, 22 bp, Artificial Sequence
  chemically synthesized
cactgggagaggcaaagggctg

SEQ ID NO: 145902 - DNA, 22 bp, Artificial Sequence
  chemically synthesized
actgggagaggcaaagggctgg

SEQ ID NO: 145903 - DNA, 22 bp, Artificial Sequence
  chemically synthesized
ggagaggcaaagggctgggggc

SEQ ID NO: 145904 - DNA, 22 bp, Artificial Sequence
  chemically synthesized
ggggccagagaggagaagtaaa

SEQ ID NO: 145905 - DNA, 22 bp, Artificial Sequence
  chemically synthesized
ctggctcatctgtgatcaccag

SEQ ID NO: 145906 - DNA, 22 bp, Artificial Sequence
  chemically synthesized
tggctcatctgtgatcaccagg

SEQ ID NO: 145907 - DNA, 22 bp, Artificial Sequence
  chemically synthesized
gctcatctgtgatcaccaggaa

SEQ ID NO: 145908 - DNA, 22 bp, Artificial Sequence
  chemically synthesized
atctgtgatcaccaggaaactc

SEQ ID NO: 145909 - DNA, 22 bp, Artificial Sequence
  chemically synthesized
tgatcaccaggaaactcccaga

SEQ ID NO: 145910 - DNA, 22 bp, Artificial Sequence
  chemically synthesized
ccagatctgacactgtagtgca

SEQ ID NO: 145911 - DNA, 22 bp, Artificial Sequence
  chemically synthesized
acactgtagtgcatttcactgc

SEQ ID NO: 145912 - DNA, 22 bp, Artificial Sequence
  chemically synthesized
tagtgcatttcactgctgacaa

SEQ ID NO: 145913 - DNA, 22 bp, Artificial Sequence
  chemically synthesized
cactgctgacaagaaggctgct

SEQ ID NO: 145914 - DNA, 22 bp, Artificial Sequence
  chemically synthesized
actgctgacaagaaggctgctg

SEQ ID NO: 145915 - DNA, 22 bp, Artificial Sequence
  chemically synthesized
ctgacaagaaggctgctgccac

SEQ ID NO: 145916 - DNA, 22 bp, Artificial Sequence
  chemically synthesized
acaagaaggctgctgccaccag

SEQ ID NO: 145917 - DNA, 22 bp, Artificial Sequence
  chemically synthesized
ctgccaccagcctgtgaagcaa

SEQ ID NO: 145918 - DNA, 22 bp, Artificial Sequence
  chemically synthesized
ccaccagcctgtgaagcaaggt

SEQ ID NO: 145919 - DNA, 22 bp, Artificial Sequence
  chemically synthesized
tgaagcaaggttaaggtgagaa

SEQ ID NO: 145920 - DNA, 22 bp, Artificial Sequence
  chemically synthesized
aggtgagaaggctggaggtgag

SEQ ID NO: 145921 - DNA, 22 bp, Artificial Sequence
  chemically synthesized
gaggtgagattctgggcaggta

SEQ ID NO: 145922 - DNA, 22 bp, Artificial Sequence
  chemically synthesized
tgggcaggtaggtactggaagc

SEQ ID NO: 145923 - DNA, 22 bp, Artificial Sequence
  chemically synthesized
ggcaggtaggtactggaagccg

SEQ ID NO: 145924 - DNA, 22 bp, Artificial Sequence
  chemically synthesized
gaagccgggacaaggtgcagaa

SEQ ID NO: 145925 - DNA, 22 bp, Artificial Sequence
  chemically synthesized
ctgaaagagggattagcccgtt

SEQ ID NO: 145926 - DNA, 22 bp, Artificial Sequence
  chemically synthesized
tgaaagagggattagcccgttg

SEQ ID NO: 145927 - DNA, 22 bp, Artificial Sequence
  chemically synthesized
aaagagggattagcccgttgtc

SEQ ID NO: 145928 - DNA, 22 bp, Artificial Sequence
  chemically synthesized
gcccgttgtcttacatagtctg

SEQ ID NO: 145929 - DNA, 22 bp, Artificial Sequence
  chemically synthesized
tcttacatagtctgactttgca

SEQ ID NO: 145930 - DNA, 22 bp, Artificial Sequence
  chemically synthesized
acatagtctgactttgcacctg

SEQ ID NO: 145931 - DNA, 22 bp, Artificial Sequence
  chemically synthesized
catagtctgactttgcacctgc

SEQ ID NO: 145932 - DNA, 22 bp, Artificial Sequence
  chemically synthesized
actttgcacctgctctgtgatt

SEQ ID NO: 145933 - DNA, 22 bp, Artificial Sequence
  chemically synthesized
tgcacctgctctgtgattatga

SEQ ID NO: 145934 - DNA, 22 bp, Artificial Sequence
  chemically synthesized
gcacctgctctgtgattatgac

SEQ ID NO: 145935 - DNA, 22 bp, Artificial Sequence
  chemically synthesized
cacctgctctgtgattatgact

SEQ ID NO: 145936 - DNA, 22 bp, Artificial Sequence
  chemically synthesized
ctctgtgattatgactatccca

SEQ ID NO: 145937 - DNA, 22 bp, Artificial Sequence
  chemically synthesized
tgtgattatgactatcccacag

SEQ ID NO: 145938 - DNA, 22 bp, Artificial Sequence
  chemically synthesized
tgattatgactatcccacagtc

SEQ ID NO: 145939 - DNA, 22 bp, Artificial Sequence
  chemically synthesized
tgactatcccacagtctcctgg

SEQ ID NO: 145940 - DNA, 22 bp, Artificial Sequence
  chemically synthesized
tcccacagtctcctggttgtct

SEQ ID NO: 145941 - DNA, 22 bp, Artificial Sequence
  chemically synthesized
ctggttgtctacccatggacct

SEQ ID NO: 145942 - DNA, 22 bp, Artificial Sequence
  chemically synthesized
gttgtctacccatggacctaga

SEQ ID NO: 145943 - DNA, 22 bp, Artificial Sequence
  chemically synthesized
tctacccatggacctagaggta

SEQ ID NO: 145944 - DNA, 22 bp, Artificial Sequence
  chemically synthesized
cccatggacctagaggtacttt

SEQ ID NO: 145945 - DNA, 22 bp, Artificial Sequence
  chemically synthesized
gaggtactttgaaagttttgga

SEQ ID NO: 145946 - DNA, 22 bp, Artificial Sequence
  chemically synthesized
tgaaagttttggatatctgggc

SEQ ID NO: 145947 - DNA, 22 bp, Artificial Sequence
  chemically synthesized
gaaagttttggatatctgggct

SEQ ID NO: 145948 - DNA, 22 bp, Artificial Sequence
  chemically synthesized
aaagttttggatatctgggctc

SEQ ID NO: 145949 - DNA, 22 bp, Artificial Sequence
  chemically synthesized
tggatatctgggctctgactgt

SEQ ID NO: 145950 - DNA, 22 bp, Artificial Sequence
  chemically synthesized
ggatatctgggctctgactgtg

SEQ ID NO: 145951 - DNA, 22 bp, Artificial Sequence
  chemically synthesized
gatatctgggctctgactgtgc

SEQ ID NO: 145952 - DNA, 22 bp, Artificial Sequence
  chemically synthesized
ggctctgactgtgcaataatgg

SEQ ID NO: 145953 - DNA, 22 bp, Artificial Sequence
  chemically synthesized
tgactgtgcaataatgggcaac

SEQ ID NO: 145954 - DNA, 22 bp, Artificial Sequence
  chemically synthesized
actgtgcaataatgggcaaccc

SEQ ID NO: 145955 - DNA, 22 bp, Artificial Sequence
  chemically synthesized
tgcaataatgggcaaccccaaa

SEQ ID NO: 145956 - DNA, 22 bp, Artificial Sequence
  chemically synthesized
atctccttcggaaaagctgtta

SEQ ID NO: 145957 - DNA, 22 bp, Artificial Sequence
  chemically synthesized
cttcggaaaagctgttatgctc

SEQ ID NO: 145958 - DNA, 22 bp, Artificial Sequence
  chemically synthesized
cggaaaagctgttatgctcacg

SEQ ID NO: 145959 - DNA, 22 bp, Artificial Sequence
  chemically synthesized
ggaaaagctgttatgctcacgg

SEQ ID NO: 145960 - DNA, 22 bp, Artificial Sequence
  chemically synthesized
ttatgctcacggatgacctcaa

SEQ ID NO: 145961 - DNA, 22 bp, Artificial Sequence
  chemically synthesized
tgctcacggatgacctcaaagg

SEQ ID NO: 145962 - DNA, 22 bp, Artificial Sequence
  chemically synthesized
acggatgacctcaaaggcacct

SEQ ID NO: 145963 - DNA, 22 bp, Artificial Sequence
  chemically synthesized
aaaggcacctttgctacactga

SEQ ID NO: 145964 - DNA, 22 bp, Artificial Sequence
  chemically synthesized
tgctacactgagtgacctgcac

SEQ ID NO: 145965 - DNA, 22 bp, Artificial Sequence
  chemically synthesized
gctacactgagtgacctgcact

SEQ ID NO: 145966 - DNA, 22 bp, Artificial Sequence
  chemically synthesized
ctacactgagtgacctgcactg

SEQ ID NO: 145967 - DNA, 22 bp, Artificial Sequence
  chemically synthesized
cactgagtgacctgcactgtaa

SEQ ID NO: 145968 - DNA, 22 bp, Artificial Sequence
  chemically synthesized
agtgacctgcactgtaacaagc

SEQ ID NO: 145969 - DNA, 22 bp, Artificial Sequence
  chemically synthesized
cactgtaacaagctgcacgtgg

SEQ ID NO: 145970 - DNA, 22 bp, Artificial Sequence
  chemically synthesized
taacaagctgcacgtggaccct

SEQ ID NO: 145971 - DNA, 22 bp, Artificial Sequence
  chemically synthesized
cacgtggaccctgagaacttcc

SEQ ID NO: 145972 - DNA, 22 bp, Artificial Sequence
  chemically synthesized
agaacttcctggtgagtagtaa

SEQ ID NO: 145973 - DNA, 22 bp, Artificial Sequence
  chemically synthesized
cctggtgagtagtaagtacact

SEQ ID NO: 145974 - DNA, 22 bp, Artificial Sequence
  chemically synthesized
ctggtgagtagtaagtacactc

SEQ ID NO: 145975 - DNA, 22 bp, Artificial Sequence
  chemically synthesized
gtgagtagtaagtacactcacg

SEQ ID NO: 145976 - DNA, 22 bp, Artificial Sequence
  chemically synthesized
acgctttcttctttacccttag

SEQ ID NO: 145977 - DNA, 22 bp, Artificial Sequence
  chemically synthesized
tcttctttacccttagatattt

SEQ ID NO: 145978 - DNA, 22 bp, Artificial Sequence
  chemically synthesized
cttctttacccttagatatttg

SEQ ID NO: 145979 - DNA, 22 bp, Artificial Sequence
  chemically synthesized
ttctttacccttagatatttgc

SEQ ID NO: 145980 - DNA, 22 bp, Artificial Sequence
  chemically synthesized
ctttacccttagatatttgcac

SEQ ID NO: 145981 - DNA, 22 bp, Artificial Sequence
  chemically synthesized
tttacccttagatatttgcact

SEQ ID NO: 145982 - DNA, 22 bp, Artificial Sequence
  chemically synthesized
tacccttagatatttgcactat

SEQ ID NO: 145983 - DNA, 22 bp, Artificial Sequence
  chemically synthesized
acccttagatatttgcactatg

SEQ ID NO: 145984 - DNA, 22 bp, Artificial Sequence
  chemically synthesized
cccttagatatttgcactatgg

SEQ ID NO: 145985 - DNA, 22 bp, Artificial Sequence
  chemically synthesized
agatatttgcactatgggtact

SEQ ID NO: 145986 - DNA, 22 bp, Artificial Sequence
  chemically synthesized
gatatttgcactatgggtactt

SEQ ID NO: 145987 - DNA, 22 bp, Artificial Sequence
  chemically synthesized
gcactatgggtacttttgaaag

SEQ ID NO: 145988 - DNA, 22 bp, Artificial Sequence
  chemically synthesized
cactatgggtacttttgaaagc

SEQ ID NO: 145989 - DNA, 22 bp, Artificial Sequence
  chemically synthesized
tgggtacttttgaaagcagagg

SEQ ID NO: 145990 - DNA, 22 bp, Artificial Sequence
  chemically synthesized
ttgaaagcagaggtggctttct

SEQ ID NO: 145991 - DNA, 22 bp, Artificial Sequence
  chemically synthesized
tgaaagcagaggtggctttctc

SEQ ID NO: 145992 - DNA, 22 bp, Artificial Sequence
  chemically synthesized
gaaagcagaggtggctttctct

SEQ ID NO: 145993 - DNA, 22 bp, Artificial Sequence
  chemically synthesized
aaagcagaggtggctttctctt

SEQ ID NO: 145994 - DNA, 22 bp, Artificial Sequence
  chemically synthesized
tctcttgtgttatgagtcagct

SEQ ID NO: 145995 - DNA, 22 bp, Artificial Sequence
  chemically synthesized
ctcttgtgttatgagtcagcta

SEQ ID NO: 145996 - DNA, 22 bp, Artificial Sequence
  chemically synthesized
tcttgtgttatgagtcagctat

SEQ ID NO: 145997 - DNA, 22 bp, Artificial Sequence
  chemically synthesized
ttgtgttatgagtcagctatgg

SEQ ID NO: 145998 - DNA, 22 bp, Artificial Sequence
  chemically synthesized
gtgttatgagtcagctatggga

SEQ ID NO: 145999 - DNA, 22 bp, Artificial Sequence
  chemically synthesized
tgttatgagtcagctatgggat

SEQ ID NO: 146000 - DNA, 22 bp, Artificial Sequence
  chemically synthesized
tgagtcagctatgggatatgat

SEQ ID NO: 146001 - DNA, 22 bp, Artificial Sequence
  chemically synthesized
tgggatatgatatttcagcagt

SEQ ID NO: 146002 - DNA, 22 bp, Artificial Sequence
  chemically synthesized
cagcagtgggattttgagagtt

SEQ ID NO: 146003 - DNA, 22 bp, Artificial Sequence
  chemically synthesized
agcagtgggattttgagagtta

SEQ ID NO: 146004 - DNA, 22 bp, Artificial Sequence
  chemically synthesized
tgagagttatgttgctgtaaat

SEQ ID NO: 146005 - DNA, 22 bp, Artificial Sequence
  chemically synthesized
gagagttatgttgctgtaaata

SEQ ID NO: 146006 - DNA, 22 bp, Artificial Sequence
  chemically synthesized
agagttatgttgctgtaaataa

SEQ ID NO: 146007 - DNA, 22 bp, Artificial Sequence
  chemically synthesized
tgttgctgtaaataacataact

SEQ ID NO: 146008 - DNA, 22 bp, Artificial Sequence
  chemically synthesized
ctgtaaataacataactaaaat

SEQ ID NO: 146009 - DNA, 22 bp, Artificial Sequence
  chemically synthesized
taaataacataactaaaatttg

SEQ ID NO: 146010 - DNA, 22 bp, Artificial Sequence
  chemically synthesized
aaatttggtagagcaaggacta

SEQ ID NO: 146011 - DNA, 22 bp, Artificial Sequence
  chemically synthesized
ggtagagcaaggactatgaata

SEQ ID NO: 146012 - DNA, 22 bp, Artificial Sequence
  chemically synthesized
gtagagcaaggactatgaataa

SEQ ID NO: 146013 - DNA, 22 bp, Artificial Sequence
  chemically synthesized
tgaataatggaaggccacttac

SEQ ID NO: 146014 - DNA, 22 bp, Artificial Sequence
  chemically synthesized
accatttgatagctctgaaaaa

SEQ ID NO: 146015 - DNA, 22 bp, Artificial Sequence
  chemically synthesized
ccatttgatagctctgaaaaac

SEQ ID NO: 146016 - DNA, 22 bp, Artificial Sequence
  chemically synthesized
gatagctctgaaaaacacatct

SEQ ID NO: 146017 - DNA, 22 bp, Artificial Sequence
  chemically synthesized
atagctctgaaaaacacatctt

SEQ ID NO: 146018 - DNA, 22 bp, Artificial Sequence
  chemically synthesized
tgaaaaacacatcttataaaaa

SEQ ID NO: 146019 - DNA, 22 bp, Artificial Sequence
  chemically synthesized
aaaaacacatcttataaaaaat

SEQ ID NO: 146020 - DNA, 22 bp, Artificial Sequence
  chemically synthesized
ataaaaaattctggccaaaatc

SEQ ID NO: 146021 - DNA, 22 bp, Artificial Sequence
  chemically synthesized
taaaaaattctggccaaaatca

SEQ ID NO: 146022 - DNA, 22 bp, Artificial Sequence
  chemically synthesized
tggccaaaatcaaactgagtgt

SEQ ID NO: 146023 - DNA, 22 bp, Artificial Sequence
  chemically synthesized
gccaaaatcaaactgagtgttt

SEQ ID NO: 146024 - DNA, 22 bp, Artificial Sequence
  chemically synthesized
agtgtttttggatgagggaaca

SEQ ID NO: 146025 - DNA, 22 bp, Artificial Sequence
  chemically synthesized
ttggatgagggaacagaagttg

SEQ ID NO: 146026 - DNA, 22 bp, Artificial Sequence
  chemically synthesized
tggatgagggaacagaagttga

SEQ ID NO: 146027 - DNA, 22 bp, Artificial Sequence
  chemically synthesized
ggatgagggaacagaagttgag

SEQ ID NO: 146028 - DNA, 22 bp, Artificial Sequence
  chemically synthesized
gatgagggaacagaagttgaga

SEQ ID NO: 146029 - DNA, 22 bp, Artificial Sequence
  chemically synthesized
agatagagaaaataacatcttt

SEQ ID NO: 146030 - DNA, 22 bp, Artificial Sequence
  chemically synthesized
tcctttggtcagcgaaattttc

SEQ ID NO: 146031 - DNA, 22 bp, Artificial Sequence
  chemically synthesized
cctttggtcagcgaaattttct

SEQ ID NO: 146032 - DNA, 22 bp, Artificial Sequence
  chemically synthesized
ctttggtcagcgaaattttcta

SEQ ID NO: 146033 - DNA, 22 bp, Artificial Sequence
  chemically synthesized
tggtcagcgaaattttctataa

SEQ ID NO: 146034 - DNA, 22 bp, Artificial Sequence
  chemically synthesized
ggtcagcgaaattttctataaa

SEQ ID NO: 146035 - DNA, 22 bp, Artificial Sequence
  chemically synthesized
gtcagcgaaattttctataaaa

SEQ ID NO: 146036 - DNA, 22 bp, Artificial Sequence
  chemically synthesized
tctataaaaattaatagtcact

SEQ ID NO: 146037 - DNA, 22 bp, Artificial Sequence
  chemically synthesized
ctataaaaattaatagtcactt

SEQ ID NO: 146038 - DNA, 22 bp, Artificial Sequence
  chemically synthesized
tataaaaattaatagtcacttt

SEQ ID NO: 146039 - DNA, 22 bp, Artificial Sequence
  chemically synthesized
taaaaattaatagtcacttttc

SEQ ID NO: 146040 - DNA, 22 bp, Artificial Sequence
  chemically synthesized
atagtcacttttctgcatagtc

SEQ ID NO: 146041 - DNA, 22 bp, Artificial Sequence
  chemically synthesized
ttctgcatagtcctggaggtta

SEQ ID NO: 146042 - DNA, 22 bp, Artificial Sequence
  chemically synthesized
tctgcatagtcctggaggttag

SEQ ID NO: 146043 - DNA, 22 bp, Artificial Sequence
  chemically synthesized
ctgcatagtcctggaggttaga

SEQ ID NO: 146044 - DNA, 22 bp, Artificial Sequence
  chemically synthesized
tgcatagtcctggaggttagaa

SEQ ID NO: 146045 - DNA, 22 bp, Artificial Sequence
  chemically synthesized
catagtcctggaggttagaaaa

SEQ ID NO: 146046 - DNA, 22 bp, Artificial Sequence
  chemically synthesized
gaggttagaaaaagatcaactg

SEQ ID NO: 146047 - DNA, 22 bp, Artificial Sequence
  chemically synthesized
gaaaaagatcaactgaacaaag

SEQ ID NO: 146048 - DNA, 22 bp, Artificial Sequence
  chemically synthesized
aacaaagtagtgggaagctgtt

SEQ ID NO: 146049 - DNA, 22 bp, Artificial Sequence
  chemically synthesized
ttaaaaagaggattgtttccct

SEQ ID NO: 146050 - DNA, 22 bp, Artificial Sequence
  chemically synthesized
aaaagaggattgtttccctccg

SEQ ID NO: 146051 - DNA, 22 bp, Artificial Sequence
  chemically synthesized
tttccctccgaatgatgatggt

SEQ ID NO: 146052 - DNA, 22 bp, Artificial Sequence
  chemically synthesized
ccctccgaatgatgatggtata

SEQ ID NO: 146053 - DNA, 22 bp, Artificial Sequence
  chemically synthesized
cctccgaatgatgatggtatac

SEQ ID NO: 146054 - DNA, 22 bp, Artificial Sequence
  chemically synthesized
cgaatgatgatggtatactttt

SEQ ID NO: 146055 - DNA, 22 bp, Artificial Sequence
  chemically synthesized
ttgtacgcatggtacaggattc

SEQ ID NO: 146056 - DNA, 22 bp, Artificial Sequence
  chemically synthesized
tgtacgcatggtacaggattct

SEQ ID NO: 146057 - DNA, 22 bp, Artificial Sequence
  chemically synthesized
gtacgcatggtacaggattctt

SEQ ID NO: 146058 - DNA, 22 bp, Artificial Sequence
  chemically synthesized
tacgcatggtacaggattcttt

SEQ ID NO: 146059 - DNA, 22 bp, Artificial Sequence
  chemically synthesized
tttgttatgagtgtttgggaaa

SEQ ID NO: 146060 - DNA, 22 bp, Artificial Sequence
  chemically synthesized
tgttatgagtgtttgggaaaat

SEQ ID NO: 146061 - DNA, 22 bp, Artificial Sequence
  chemically synthesized
gttatgagtgtttgggaaaatt

SEQ ID NO: 146062 - DNA, 22 bp, Artificial Sequence
  chemically synthesized
ttatgagtgtttgggaaaattg

SEQ ID NO: 146063 - DNA, 22 bp, Artificial Sequence
  chemically synthesized
tgagtgtttgggaaaattgtat

SEQ ID NO: 146064 - DNA, 22 bp, Artificial Sequence
  chemically synthesized
gggaaaattgtatgtatgtatg

SEQ ID NO: 146065 - DNA, 22 bp, Artificial Sequence
  chemically synthesized
ggaaaattgtatgtatgtatgt

SEQ ID NO: 146066 - DNA, 22 bp, Artificial Sequence
  chemically synthesized
tatgtatgtatgtatgtatgta

SEQ ID NO: 146067 - DNA, 22 bp, Artificial Sequence
  chemically synthesized
gggacttatcctatccattact

SEQ ID NO: 146068 - DNA, 22 bp, Artificial Sequence
  chemically synthesized
atcctatccattactgttcctt

SEQ ID NO: 146069 - DNA, 22 bp, Artificial Sequence
  chemically synthesized
tcctatccattactgttccttg

SEQ ID NO: 146070 - DNA, 22 bp, Artificial Sequence
  chemically synthesized
tccattactgttccttgaagta

SEQ ID NO: 146071 - DNA, 22 bp, Artificial Sequence
  chemically synthesized
ctgttccttgaagtactattat

SEQ ID NO: 146072 - DNA, 22 bp, Artificial Sequence
  chemically synthesized
ttccttgaagtactattatcct

SEQ ID NO: 146073 - DNA, 22 bp, Artificial Sequence
  chemically synthesized
cttgaagtactattatcctact

SEQ ID NO: 146074 - DNA, 22 bp, Artificial Sequence
  chemically synthesized
gaagtactattatcctactttt

SEQ ID NO: 146075 - DNA, 22 bp, Artificial Sequence
  chemically synthesized
aagtactattatcctacttttt

SEQ ID NO: 146076 - DNA, 22 bp, Artificial Sequence
  chemically synthesized
ttatcctactttttaaaaggac

SEQ ID NO: 146077 - DNA, 22 bp, Artificial Sequence
  chemically synthesized
tcctactttttaaaaggacgaa

SEQ ID NO: 146078 - DNA, 22 bp, Artificial Sequence
  chemically synthesized
ctttttaaaaggacgaagtctc

SEQ ID NO: 146079 - DNA, 22 bp, Artificial Sequence
  chemically synthesized
tttaaaaggacgaagtctctaa

SEQ ID NO: 146080 - DNA, 22 bp, Artificial Sequence
  chemically synthesized
ttaaaaggacgaagtctctaaa

SEQ ID NO: 146081 - DNA, 22 bp, Artificial Sequence
  chemically synthesized
taaaaggacgaagtctctaaaa

SEQ ID NO: 146082 - DNA, 22 bp, Artificial Sequence
  chemically synthesized
aaaaggacgaagtctctaaaaa

SEQ ID NO: 146083 - DNA, 22 bp, Artificial Sequence
  chemically synthesized
aaaggacgaagtctctaaaaaa

SEQ ID NO: 146084 - DNA, 22 bp, Artificial Sequence
  chemically synthesized
taaaaaaaaaatgaaacaatca

SEQ ID NO: 146085 - DNA, 22 bp, Artificial Sequence
  chemically synthesized
aaaaaaaaatgaaacaatcaca

SEQ ID NO: 146086 - DNA, 22 bp, Artificial Sequence
  chemically synthesized
gggtagtgagttggcatagcaa

SEQ ID NO: 146087 - DNA, 22 bp, Artificial Sequence
  chemically synthesized
gcatagcaagtaagagaaggat

SEQ ID NO: 146088 - DNA, 22 bp, Artificial Sequence
  chemically synthesized
ccagtcatattgaagctgatat

SEQ ID NO: 146089 - DNA, 22 bp, Artificial Sequence
  chemically synthesized
aagctgatatctagcccataat

SEQ ID NO: 146090 - DNA, 22 bp, Artificial Sequence
  chemically synthesized
atatctagcccataatggtgag

SEQ ID NO: 146091 - DNA, 22 bp, Artificial Sequence
  chemically synthesized
gcccataatggtgagagttgct

SEQ ID NO: 146092 - DNA, 22 bp, Artificial Sequence
  chemically synthesized
ctcaaactctggtgaaaaagga

SEQ ID NO: 146093 - DNA, 22 bp, Artificial Sequence
  chemically synthesized
aaactctggtgaaaaaggatgt

SEQ ID NO: 146094 - DNA, 22 bp, Artificial Sequence
  chemically synthesized
tggtgaaaaaggatgtaagtgt

SEQ ID NO: 146095 - DNA, 22 bp, Artificial Sequence
  chemically synthesized
gtgaaaaaggatgtaagtgtta

SEQ ID NO: 146096 - DNA, 22 bp, Artificial Sequence
  chemically synthesized
tatctatttactgcaagtccag

SEQ ID NO: 146097 - DNA, 22 bp, Artificial Sequence
  chemically synthesized
tttactgcaagtccagcttgag

SEQ ID NO: 146098 - DNA, 22 bp, Artificial Sequence
  chemically synthesized
actgcaagtccagcttgaggcc

SEQ ID NO: 146099 - DNA, 22 bp, Artificial Sequence
  chemically synthesized
ctgcaagtccagcttgaggcct

SEQ ID NO: 146100 - DNA, 22 bp, Artificial Sequence
  chemically synthesized
caagtccagcttgaggccttct

SEQ ID NO: 146101 - DNA, 22 bp, Artificial Sequence
  chemically synthesized
gaggccttctattcactatgta

SEQ ID NO: 146102 - DNA, 22 bp, Artificial Sequence
  chemically synthesized
aggccttctattcactatgtac

SEQ ID NO: 146103 - DNA, 22 bp, Artificial Sequence
  chemically synthesized
ctattcactatgtaccattttc

SEQ ID NO: 146104 - DNA, 22 bp, Artificial Sequence
  chemically synthesized
tattcactatgtaccattttct

SEQ ID NO: 146105 - DNA, 22 bp, Artificial Sequence
  chemically synthesized
ttcactatgtaccattttcttt

SEQ ID NO: 146106 - DNA, 22 bp, Artificial Sequence
  chemically synthesized
actatgtaccattttctttttt

SEQ ID NO: 146107 - DNA, 22 bp, Artificial Sequence
  chemically synthesized
tgtaccattttcttttttatct

SEQ ID NO: 146108 - DNA, 22 bp, Artificial Sequence
  chemically synthesized
tcttttttatcttcactccctc

SEQ ID NO: 146109 - DNA, 22 bp, Artificial Sequence
  chemically synthesized
cttttttatcttcactccctcc

SEQ ID NO: 146110 - DNA, 22 bp, Artificial Sequence
  chemically synthesized
ttttttatcttcactccctccc

SEQ ID NO: 146111 - DNA, 22 bp, Artificial Sequence
  chemically synthesized
ttttatcttcactccctcccca

SEQ ID NO: 146112 - DNA, 22 bp, Artificial Sequence
  chemically synthesized
tttatcttcactccctccccag

SEQ ID NO: 146113 - DNA, 22 bp, Artificial Sequence
  chemically synthesized
ttatcttcactccctccccagc

SEQ ID NO: 146114 - DNA, 22 bp, Artificial Sequence
  chemically synthesized
tatcttcactccctccccagct

SEQ ID NO: 146115 - DNA, 22 bp, Artificial Sequence
  chemically synthesized
atcttcactccctccccagctc

SEQ ID NO: 146116 - DNA, 22 bp, Artificial Sequence
  chemically synthesized
tcttcactccctccccagctct

SEQ ID NO: 146117 - DNA, 22 bp, Artificial Sequence
  chemically synthesized
cactccctccccagctcttagg

SEQ ID NO: 146118 - DNA, 22 bp, Artificial Sequence
  chemically synthesized
actccctccccagctcttaggc

SEQ ID NO: 146119 - DNA, 22 bp, Artificial Sequence
  chemically synthesized
cctccccagctcttaggcaacg

SEQ ID NO: 146120 - DNA, 22 bp, Artificial Sequence
  chemically synthesized
cccagctcttaggcaacgtgat

SEQ ID NO: 146121 - DNA, 22 bp, Artificial Sequence
  chemically synthesized
ttaggcaacgtgatattgattg

SEQ ID NO: 146122 - DNA, 22 bp, Artificial Sequence
  chemically synthesized
aggcaacgtgatattgattgtt

SEQ ID NO: 146123 - DNA, 22 bp, Artificial Sequence
  chemically synthesized
ggcaacgtgatattgattgttt

SEQ ID NO: 146124 - DNA, 22 bp, Artificial Sequence
  chemically synthesized
attgttttggcaacccacttca

SEQ ID NO: 146125 - DNA, 22 bp, Artificial Sequence
  chemically synthesized
ttttggcaacccacttcagcga

SEQ ID NO: 146126 - DNA, 22 bp, Artificial Sequence
  chemically synthesized
tggcaacccacttcagcgagga

SEQ ID NO: 146127 - DNA, 22 bp, Artificial Sequence
  chemically synthesized
ggcaacccacttcagcgaggat

SEQ ID NO: 146128 - DNA, 22 bp, Artificial Sequence
  chemically synthesized
gcaacccacttcagcgaggatt

SEQ ID NO: 146129 - DNA, 22 bp, Artificial Sequence
  chemically synthesized
cagcgaggattttaccctacag

SEQ ID NO: 146130 - DNA, 22 bp, Artificial Sequence
  chemically synthesized
agcgaggattttaccctacaga

SEQ ID NO: 146131 - DNA, 22 bp, Artificial Sequence
  chemically synthesized
taccctacagatacaggcttct

SEQ ID NO: 146132 - DNA, 22 bp, Artificial Sequence
  chemically synthesized
accctacagatacaggcttctt

SEQ ID NO: 146133 - DNA, 22 bp, Artificial Sequence
  chemically synthesized
ccctacagatacaggcttcttg

SEQ ID NO: 146134 - DNA, 22 bp, Artificial Sequence
  chemically synthesized
cagatacaggcttcttggcagt

SEQ ID NO: 146135 - DNA, 22 bp, Artificial Sequence
  chemically synthesized
cttggcagtaactaacaaatgc

SEQ ID NO: 146136 - DNA, 22 bp, Artificial Sequence
  chemically synthesized
ttggcagtaactaacaaatgct

SEQ ID NO: 146137 - DNA, 22 bp, Artificial Sequence
  chemically synthesized
ggcagtaactaacaaatgctgt

SEQ ID NO: 146138 - DNA, 22 bp, Artificial Sequence
  chemically synthesized
gcagtaactaacaaatgctgtg

SEQ ID NO: 146139 - DNA, 22 bp, Artificial Sequence
  chemically synthesized
acaaatgctgtggttaatgctg

SEQ ID NO: 146140 - DNA, 22 bp, Artificial Sequence
  chemically synthesized
tggttaatgctgtagcccacaa

SEQ ID NO: 146141 - DNA, 22 bp, Artificial Sequence
  chemically synthesized
atgctgtagcccacaagaccac

SEQ ID NO: 146142 - DNA, 22 bp, Artificial Sequence
  chemically synthesized
tagcccacaagaccactgagtt

SEQ ID NO: 146143 - DNA, 22 bp, Artificial Sequence
  chemically synthesized
agttccctgtccactatgtttg

SEQ ID NO: 146144 - DNA, 22 bp, Artificial Sequence
  chemically synthesized
cctgtccactatgtttgtacct

SEQ ID NO: 146145 - DNA, 22 bp, Artificial Sequence
  chemically synthesized
tccactatgtttgtacctatgg

SEQ ID NO: 146146 - DNA, 22 bp, Artificial Sequence
  chemically synthesized
tgtttgtacctatggtccacta

SEQ ID NO: 146147 - DNA, 22 bp, Artificial Sequence
  chemically synthesized
gtacctatggtccactatgttt

SEQ ID NO: 146148 - DNA, 22 bp, Artificial Sequence
  chemically synthesized
tacctatggtccactatgtttg

SEQ ID NO: 146149 - DNA, 22 bp, Artificial Sequence
  chemically synthesized
tggtccactatgtttgtaccta

SEQ ID NO: 146150 - DNA, 22 bp, Artificial Sequence
  chemically synthesized
tgtttgtacctatgtcccaaaa

SEQ ID NO: 146151 - DNA, 22 bp, Artificial Sequence
  chemically synthesized
gtacctatgtcccaaaatctca

SEQ ID NO: 146152 - DNA, 22 bp, Artificial Sequence
  chemically synthesized
tacctatgtcccaaaatctcat

SEQ ID NO: 146153 - DNA, 22 bp, Artificial Sequence
  chemically synthesized
tgtcccaaaatctcatctcctt

SEQ ID NO: 146154 - DNA, 22 bp, Artificial Sequence
  chemically synthesized
atctcctttagatgggggaggt

SEQ ID NO: 146155 - DNA, 22 bp, Artificial Sequence
  chemically synthesized
ctttagatgggggaggttgggg

SEQ ID NO: 146156 - DNA, 22 bp, Artificial Sequence
  chemically synthesized
tagatgggggaggttggggaga

SEQ ID NO: 146157 - DNA, 22 bp, Artificial Sequence
  chemically synthesized
agatgggggaggttggggagaa

SEQ ID NO: 146158 - DNA, 22 bp, Artificial Sequence
  chemically synthesized
gatgggggaggttggggagaag

SEQ ID NO: 146159 - DNA, 22 bp, Artificial Sequence
  chemically synthesized
gggagaagagcagtatcctgcc

SEQ ID NO: 146160 - DNA, 22 bp, Artificial Sequence
  chemically synthesized
cctgctgattcagttcctgcat

SEQ ID NO: 146161 - DNA, 22 bp, Artificial Sequence
  chemically synthesized
ctgattcagttcctgcatgata

SEQ ID NO: 146162 - DNA, 22 bp, Artificial Sequence
  chemically synthesized
attcagttcctgcatgataaaa

SEQ ID NO: 146163 - DNA, 22 bp, Artificial Sequence
  chemically synthesized
agttcctgcatgataaaaatag

SEQ ID NO: 146164 - DNA, 22 bp, Artificial Sequence
  chemically synthesized
ctgcatgataaaaatagaataa

SEQ ID NO: 146165 - DNA, 22 bp, Artificial Sequence
  chemically synthesized
catgataaaaatagaataaaga

SEQ ID NO: 146166 - DNA, 22 bp, Artificial Sequence
  chemically synthesized
tctaagaaatatcattgtactc

SEQ ID NO: 146167 - DNA, 22 bp, Artificial Sequence
  chemically synthesized
taagaaatatcattgtactctt

SEQ ID NO: 146168 - DNA, 22 bp, Artificial Sequence
  chemically synthesized
agaaatatcattgtactctttt

SEQ ID NO: 146169 - DNA, 22 bp, Artificial Sequence
  chemically synthesized
tactctttttctgtctttatat

SEQ ID NO: 146170 - DNA, 22 bp, Artificial Sequence
  chemically synthesized
tttttctgtctttatattttac

SEQ ID NO: 146171 - DNA, 22 bp, Artificial Sequence
  chemically synthesized
tttctgtctttatattttaccc

SEQ ID NO: 146172 - DNA, 22 bp, Artificial Sequence
  chemically synthesized
ttctgtctttatattttaccct

SEQ ID NO: 146173 - DNA, 22 bp, Artificial Sequence
  chemically synthesized
tctgtctttatattttaccctg

SEQ ID NO: 146174 - DNA, 22 bp, Artificial Sequence
  chemically synthesized
ctgtctttatattttaccctga

SEQ ID NO: 146175 - DNA, 22 bp, Artificial Sequence
  chemically synthesized
tgtctttatattttaccctgat

SEQ ID NO: 146176 - DNA, 22 bp, Artificial Sequence
  chemically synthesized
tctttatattttaccctgattc

SEQ ID NO: 146177 - DNA, 22 bp, Artificial Sequence
  chemically synthesized
tatattttaccctgattcagcc

SEQ ID NO: 146178 - DNA, 22 bp, Artificial Sequence
  chemically synthesized
atattttaccctgattcagcca

SEQ ID NO: 146179 - DNA, 22 bp, Artificial Sequence
  chemically synthesized
tattttaccctgattcagccaa

SEQ ID NO: 146180 - DNA, 22 bp, Artificial Sequence
  chemically synthesized
taccctgattcagccaaaagga

SEQ ID NO: 146181 - DNA, 22 bp, Artificial Sequence
  chemically synthesized
accctgattcagccaaaaggac

SEQ ID NO: 146182 - DNA, 22 bp, Artificial Sequence
  chemically synthesized
ccctgattcagccaaaaggacg

SEQ ID NO: 146183 - DNA, 22 bp, Artificial Sequence
  chemically synthesized
attcagccaaaaggacgcacta

SEQ ID NO: 146184 - DNA, 22 bp, Artificial Sequence
  chemically synthesized
agccaaaaggacgcactatttc

SEQ ID NO: 146185 - DNA, 22 bp, Artificial Sequence
  chemically synthesized
tttctgatggaaatgagaatgt

SEQ ID NO: 146186 - DNA, 22 bp, Artificial Sequence
  chemically synthesized
ctgatggaaatgagaatgttgg

SEQ ID NO: 146187 - DNA, 22 bp, Artificial Sequence
  chemically synthesized
tgatggaaatgagaatgttgga

SEQ ID NO: 146188 - DNA, 22 bp, Artificial Sequence
  chemically synthesized
atggaaatgagaatgttggaga

SEQ ID NO: 146189 - DNA, 22 bp, Artificial Sequence
  chemically synthesized
gagaatgggagtttaaggacag

SEQ ID NO: 146190 - DNA, 22 bp, Artificial Sequence
  chemically synthesized
aaggacagagaagatactttct

SEQ ID NO: 146191 - DNA, 22 bp, Artificial Sequence
  chemically synthesized
aggacagagaagatactttctt

SEQ ID NO: 146192 - DNA, 22 bp, Artificial Sequence
  chemically synthesized
tcttgcaatcctgcaagaaaag

SEQ ID NO: 146193 - DNA, 22 bp, Artificial Sequence
  chemically synthesized
cttgcaatcctgcaagaaaaga

SEQ ID NO: 146194 - DNA, 22 bp, Artificial Sequence
  chemically synthesized
ttgcaatcctgcaagaaaagag

SEQ ID NO: 146195 - DNA, 22 bp, Artificial Sequence
  chemically synthesized
gcaatcctgcaagaaaagagag

SEQ ID NO: 146196 - DNA, 22 bp, Artificial Sequence
  chemically synthesized
caatcctgcaagaaaagagaga

SEQ ID NO: 146197 - DNA, 22 bp, Artificial Sequence
  chemically synthesized
caagaaaagagagaactcgtgg

SEQ ID NO: 146198 - DNA, 22 bp, Artificial Sequence
  chemically synthesized
gtgggtggatttagtggggtag

SEQ ID NO: 146199 - DNA, 22 bp, Artificial Sequence
  chemically synthesized
agtggggtagttactcctagga

SEQ ID NO: 146200 - DNA, 22 bp, Artificial Sequence
  chemically synthesized
gtggggtagttactcctaggaa

SEQ ID NO: 146201 - DNA, 22 bp, Artificial Sequence
  chemically synthesized
ctcctaggaaggggaaatcgtc

SEQ ID NO: 146202 - DNA, 22 bp, Artificial Sequence
  chemically synthesized
ctaggaaggggaaatcgtctct

SEQ ID NO: 146203 - DNA, 22 bp, Artificial Sequence
  chemically synthesized
ggaaggggaaatcgtctctaga

SEQ ID NO: 146204 - DNA, 22 bp, Artificial Sequence
  chemically synthesized
tagaataagacaatgtttttac

SEQ ID NO: 146205 - DNA, 22 bp, Artificial Sequence
  chemically synthesized
gaataagacaatgtttttacag

SEQ ID NO: 146206 - DNA, 22 bp, Artificial Sequence
  chemically synthesized
ttacagaaagggaggtcaatgg

SEQ ID NO: 146207 - DNA, 22 bp, Artificial Sequence
  chemically synthesized
tacagaaagggaggtcaatgga

SEQ ID NO: 146208 - DNA, 22 bp, Artificial Sequence
  chemically synthesized
acagaaagggaggtcaatggag

SEQ ID NO: 146209 - DNA, 22 bp, Artificial Sequence
  chemically synthesized
cagaaagggaggtcaatggagg

SEQ ID NO: 146210 - DNA, 22 bp, Artificial Sequence
  chemically synthesized
tttggaggtgtaagaggattgt

SEQ ID NO: 146211 - DNA, 22 bp, Artificial Sequence
  chemically synthesized
tggaggtgtaagaggattgttg

SEQ ID NO: 146212 - DNA, 22 bp, Artificial Sequence
  chemically synthesized
ggaggtgtaagaggattgttgg

SEQ ID NO: 146213 - DNA, 22 bp, Artificial Sequence
  chemically synthesized
gaggtgtaagaggattgttggt

SEQ ID NO: 146214 - DNA, 22 bp, Artificial Sequence
  chemically synthesized
ttggtagtgtgtagaggtatgt

SEQ ID NO: 146215 - DNA, 22 bp, Artificial Sequence
  chemically synthesized
gtagtgtgtagaggtatgttag

SEQ ID NO: 146216 - DNA, 22 bp, Artificial Sequence
  chemically synthesized
ggactcaaattagaagttctgt

SEQ ID NO: 146217 - DNA, 22 bp, Artificial Sequence
  chemically synthesized
aaattagaagttctgtataggc

SEQ ID NO: 146218 - DNA, 22 bp, Artificial Sequence
  chemically synthesized
gaagttctgtataggctattat

SEQ ID NO: 146219 - DNA, 22 bp, Artificial Sequence
  chemically synthesized
tgtataggctattatttgtatg

SEQ ID NO: 146220 - DNA, 22 bp, Artificial Sequence
  chemically synthesized
tataggctattatttgtatgaa

SEQ ID NO: 146221 - DNA, 22 bp, Artificial Sequence
  chemically synthesized
ttatttgtatgaaactcaggat

SEQ ID NO: 146222 - DNA, 22 bp, Artificial Sequence
  chemically synthesized
tttgtatgaaactcaggatata

SEQ ID NO: 146223 - DNA, 22 bp, Artificial Sequence
  chemically synthesized
gtatgaaactcaggatatagct

SEQ ID NO: 146224 - DNA, 22 bp, Artificial Sequence
  chemically synthesized
tatgaaactcaggatatagctc

SEQ ID NO: 146225 - DNA, 22 bp, Artificial Sequence
  chemically synthesized
aggatatagctcatttggtgac

SEQ ID NO: 146226 - DNA, 22 bp, Artificial Sequence
  chemically synthesized
atttggtgactgcagttcactt

SEQ ID NO: 146227 - DNA, 22 bp, Artificial Sequence
  chemically synthesized
ggtgactgcagttcacttctac

SEQ ID NO: 146228 - DNA, 22 bp, Artificial Sequence
  chemically synthesized
gtgactgcagttcacttctact

SEQ ID NO: 146229 - DNA, 22 bp, Artificial Sequence
  chemically synthesized
cagttcacttctacttatttta

SEQ ID NO: 146230 - DNA, 22 bp, Artificial Sequence
  chemically synthesized
acttctacttattttaaacaac

SEQ ID NO: 146231 - DNA, 22 bp, Artificial Sequence
  chemically synthesized
ctacttattttaaacaacatat

SEQ ID NO: 146232 - DNA, 22 bp, Artificial Sequence
  chemically synthesized
tacttattttaaacaacatatt

SEQ ID NO: 146233 - DNA, 22 bp, Artificial Sequence
  chemically synthesized
cttattttaaacaacatatttt

SEQ ID NO: 146234 - DNA, 22 bp, Artificial Sequence
  chemically synthesized
attttaaacaacatatttttta

SEQ ID NO: 146235 - DNA, 22 bp, Artificial Sequence
  chemically synthesized
ttttaaacaacatattttttat

SEQ ID NO: 146236 - DNA, 22 bp, Artificial Sequence
  chemically synthesized
taaacaacatattttttattat

SEQ ID NO: 146237 - DNA, 22 bp, Artificial Sequence
  chemically synthesized
aaacaacatattttttattatt

SEQ ID NO: 146238 - DNA, 22 bp, Artificial Sequence
  chemically synthesized
aacaacatattttttattattt

SEQ ID NO: 146239 - DNA, 22 bp, Artificial Sequence
  chemically synthesized
tttattatttataatgaagtgg

SEQ ID NO: 146240 - DNA, 22 bp, Artificial Sequence
  chemically synthesized
ttattatttataatgaagtggg

SEQ ID NO: 146241 - DNA, 22 bp, Artificial Sequence
  chemically synthesized
tattatttataatgaagtgggg

SEQ ID NO: 146242 - DNA, 22 bp, Artificial Sequence
  chemically synthesized
attatttataatgaagtgggga

SEQ ID NO: 146243 - DNA, 22 bp, Artificial Sequence
  chemically synthesized
ttatttataatgaagtggggat

SEQ ID NO: 146244 - DNA, 22 bp, Artificial Sequence
  chemically synthesized
tttataatgaagtggggatggg

SEQ ID NO: 146245 - DNA, 22 bp, Artificial Sequence
  chemically synthesized
ataatgaagtggggatggggct

SEQ ID NO: 146246 - DNA, 22 bp, Artificial Sequence
  chemically synthesized
taatgaagtggggatggggctt

SEQ ID NO: 146247 - DNA, 22 bp, Artificial Sequence
  chemically synthesized
cctagagaccaatcaagggcca

SEQ ID NO: 146248 - DNA, 22 bp, Artificial Sequence
  chemically synthesized
ctagagaccaatcaagggccaa

SEQ ID NO: 146249 - DNA, 22 bp, Artificial Sequence
  chemically synthesized
gagaccaatcaagggccaaacc

SEQ ID NO: 146250 - DNA, 22 bp, Artificial Sequence
  chemically synthesized
gaactttctcttaacgtcttca

SEQ ID NO: 146251 - DNA, 22 bp, Artificial Sequence
  chemically synthesized
aactttctcttaacgtcttcaa

SEQ ID NO: 146252 - DNA, 22 bp, Artificial Sequence
  chemically synthesized
tctcttaacgtcttcaatggta

SEQ ID NO: 146253 - DNA, 22 bp, Artificial Sequence
  chemically synthesized
ctcttaacgtcttcaatggtat

SEQ ID NO: 146254 - DNA, 22 bp, Artificial Sequence
  chemically synthesized
tcttaacgtcttcaatggtatt

SEQ ID NO: 146255 - DNA, 22 bp, Artificial Sequence
  chemically synthesized
ttaacgtcttcaatggtattaa

SEQ ID NO: 146256 - DNA, 22 bp, Artificial Sequence
  chemically synthesized
aacgtcttcaatggtattaata

SEQ ID NO: 146257 - DNA, 22 bp, Artificial Sequence
  chemically synthesized
acgtcttcaatggtattaatag

SEQ ID NO: 146258 - DNA, 22 bp, Artificial Sequence
  chemically synthesized
caatggtattaatagagaatta

SEQ ID NO: 146259 - DNA, 22 bp, Artificial Sequence
  chemically synthesized
aatggtattaatagagaattat

SEQ ID NO: 146260 - DNA, 22 bp, Artificial Sequence
  chemically synthesized
atagagaattatctctaaggca

SEQ ID NO: 146261 - DNA, 22 bp, Artificial Sequence
  chemically synthesized
tctctaaggcatgtgaactggc

SEQ ID NO: 146262 - DNA, 22 bp, Artificial Sequence
  chemically synthesized
taaggcatgtgaactggctgtc

SEQ ID NO: 146263 - DNA, 22 bp, Artificial Sequence
  chemically synthesized
aggcatgtgaactggctgtctt

SEQ ID NO: 146264 - DNA, 22 bp, Artificial Sequence
  chemically synthesized
gctgtcttggttttcatctgta

SEQ ID NO: 146265 - DNA, 22 bp, Artificial Sequence
  chemically synthesized
tcttggttttcatctgtacttc

SEQ ID NO: 146266 - DNA, 22 bp, Artificial Sequence
  chemically synthesized
ggttttcatctgtacttcatct

SEQ ID NO: 146267 - DNA, 22 bp, Artificial Sequence
  chemically synthesized
gttttcatctgtacttcatctg

SEQ ID NO: 146268 - DNA, 22 bp, Artificial Sequence
  chemically synthesized
tcatctgtacttcatctgctac

SEQ ID NO: 146269 - DNA, 22 bp, Artificial Sequence
  chemically synthesized
catctgtacttcatctgctacc

SEQ ID NO: 146270 - DNA, 22 bp, Artificial Sequence
  chemically synthesized
atctgtacttcatctgctacct

SEQ ID NO: 146271 - DNA, 22 bp, Artificial Sequence
  chemically synthesized
tacttcatctgctacctctgtg

SEQ ID NO: 146272 - DNA, 22 bp, Artificial Sequence
  chemically synthesized
catctgctacctctgtgacctg

SEQ ID NO: 146273 - DNA, 22 bp, Artificial Sequence
  chemically synthesized
atctgctacctctgtgacctga

SEQ ID NO: 146274 - DNA, 22 bp, Artificial Sequence
  chemically synthesized
ctacctctgtgacctgaaacat

SEQ ID NO: 146275 - DNA, 22 bp, Artificial Sequence
  chemically synthesized
cctctgtgacctgaaacatatt

SEQ ID NO: 146276 - DNA, 22 bp, Artificial Sequence
  chemically synthesized
tgtgacctgaaacatatttata

SEQ ID NO: 146277 - DNA, 22 bp, Artificial Sequence
  chemically synthesized
tgacctgaaacatatttataat

SEQ ID NO: 146278 - DNA, 22 bp, Artificial Sequence
  chemically synthesized
aaacatatttataattccatta

SEQ ID NO: 146279 - DNA, 22 bp, Artificial Sequence
  chemically synthesized
ataattccattaagctgtgcat

SEQ ID NO: 146280 - DNA, 22 bp, Artificial Sequence
  chemically synthesized
taattccattaagctgtgcata

SEQ ID NO: 146281 - DNA, 22 bp, Artificial Sequence
  chemically synthesized
cattaagctgtgcatatgatag

SEQ ID NO: 146282 - DNA, 22 bp, Artificial Sequence
  chemically synthesized
agctgtgcatatgatagattta

SEQ ID NO: 146283 - DNA, 22 bp, Artificial Sequence
  chemically synthesized
tgcatatgatagatttatcata

SEQ ID NO: 146284 - DNA, 22 bp, Artificial Sequence
  chemically synthesized
atcatatgtattttccttaaag

SEQ ID NO: 146285 - DNA, 22 bp, Artificial Sequence
  chemically synthesized
tcatatgtattttccttaaagg

SEQ ID NO: 146286 - DNA, 22 bp, Artificial Sequence
  chemically synthesized
tccttaaaggatttttgtaaga

SEQ ID NO: 146287 - DNA, 22 bp, Artificial Sequence
  chemically synthesized
ccttaaaggatttttgtaagaa

SEQ ID NO: 146288 - DNA, 22 bp, Artificial Sequence
  chemically synthesized
cttaaaggatttttgtaagaac

SEQ ID NO: 146289 - DNA, 22 bp, Artificial Sequence
  chemically synthesized
aaaggatttttgtaagaactaa

SEQ ID NO: 146290 - DNA, 22 bp, Artificial Sequence
  chemically synthesized
aaggatttttgtaagaactaat

SEQ ID NO: 146291 - DNA, 22 bp, Artificial Sequence
  chemically synthesized
ttgtaagaactaattgaattga

SEQ ID NO: 146292 - DNA, 22 bp, Artificial Sequence
  chemically synthesized
tgtaagaactaattgaattgat

SEQ ID NO: 146293 - DNA, 22 bp, Artificial Sequence
  chemically synthesized
gtaagaactaattgaattgata

SEQ ID NO: 146294 - DNA, 22 bp, Artificial Sequence
  chemically synthesized
taagaactaattgaattgatac

SEQ ID NO: 146295 - DNA, 22 bp, Artificial Sequence
  chemically synthesized
attgaattgatacctgtaaagt

SEQ ID NO: 146296 - DNA, 22 bp, Artificial Sequence
  chemically synthesized
aattgatacctgtaaagtcttt

SEQ ID NO: 146297 - DNA, 22 bp, Artificial Sequence
  chemically synthesized
atacctgtaaagtctttatcac

SEQ ID NO: 146298 - DNA, 22 bp, Artificial Sequence
  chemically synthesized
taaagtctttatcacactaccc

SEQ ID NO: 146299 - DNA, 22 bp, Artificial Sequence
  chemically synthesized
tatcacactacccaataaataa

SEQ ID NO: 146300 - DNA, 22 bp, Artificial Sequence
  chemically synthesized
atcacactacccaataaataat

SEQ ID NO: 146301 - DNA, 22 bp, Artificial Sequence
  chemically synthesized
tcacactacccaataaataata

SEQ ID NO: 146302 - DNA, 22 bp, Artificial Sequence
  chemically synthesized
cccaataaataataaatctctt

SEQ ID NO: 146303 - DNA, 22 bp, Artificial Sequence
  chemically synthesized
tttgttcagctctctgtttcta

SEQ ID NO: 146304 - DNA, 22 bp, Artificial Sequence
  chemically synthesized
tgttcagctctctgtttctata

SEQ ID NO: 146305 - DNA, 22 bp, Artificial Sequence
  chemically synthesized
gttcagctctctgtttctataa

SEQ ID NO: 146306 - DNA, 22 bp, Artificial Sequence
  chemically synthesized
ttcagctctctgtttctataaa

SEQ ID NO: 146307 - DNA, 22 bp, Artificial Sequence
  chemically synthesized
agctctctgtttctataaatat

SEQ ID NO: 146308 - DNA, 22 bp, Artificial Sequence
  chemically synthesized
tctgtttctataaatatgtaca

SEQ ID NO: 146309 - DNA, 22 bp, Artificial Sequence
  chemically synthesized
tgtttctataaatatgtacaag

SEQ ID NO: 146310 - DNA, 22 bp, Artificial Sequence
  chemically synthesized
tttctataaatatgtacaagtt

SEQ ID NO: 146311 - DNA, 22 bp, Artificial Sequence
  chemically synthesized
ctataaatatgtacaagtttta

SEQ ID NO: 146312 - DNA, 22 bp, Artificial Sequence
  chemically synthesized
tataaatatgtacaagttttat

SEQ ID NO: 146313 - DNA, 22 bp, Artificial Sequence
  chemically synthesized
taaatatgtacaagttttattg

SEQ ID NO: 146314 - DNA, 22 bp, Artificial Sequence
  chemically synthesized
tattgtttttagtggtagtgat

SEQ ID NO: 146315 - DNA, 22 bp, Artificial Sequence
  chemically synthesized
attgtttttagtggtagtgatt

SEQ ID NO: 146316 - DNA, 22 bp, Artificial Sequence
  chemically synthesized
ttgtttttagtggtagtgattt

SEQ ID NO: 146317 - DNA, 22 bp, Artificial Sequence
  chemically synthesized
tttttagtggtagtgattttat

SEQ ID NO: 146318 - DNA, 22 bp, Artificial Sequence
  chemically synthesized
ttagtggtagtgattttattct

SEQ ID NO: 146319 - DNA, 22 bp, Artificial Sequence
  chemically synthesized
tagtggtagtgattttattctc

SEQ ID NO: 146320 - DNA, 22 bp, Artificial Sequence
  chemically synthesized
agtggtagtgattttattctct

SEQ ID NO: 146321 - DNA, 22 bp, Artificial Sequence
  chemically synthesized
gtggtagtgattttattctctt

SEQ ID NO: 146322 - DNA, 22 bp, Artificial Sequence
  chemically synthesized
tattctctttctatatatatac

SEQ ID NO: 146323 - DNA, 22 bp, Artificial Sequence
  chemically synthesized
attctctttctatatatataca

SEQ ID NO: 146324 - DNA, 22 bp, Artificial Sequence
  chemically synthesized
ttctctttctatatatatacac

SEQ ID NO: 146325 - DNA, 22 bp, Artificial Sequence
  chemically synthesized
tctttctatatatatacacaca

SEQ ID NO: 146326 - DNA, 22 bp, Artificial Sequence
  chemically synthesized
tttctatatatatacacacaca

SEQ ID NO: 146327 - DNA, 22 bp, Artificial Sequence
  chemically synthesized
tctatatatatacacacacatg

SEQ ID NO: 146328 - DNA, 22 bp, Artificial Sequence
  chemically synthesized
ctatatatatacacacacatgt

SEQ ID NO: 146329 - DNA, 22 bp, Artificial Sequence
  chemically synthesized
tatatatatacacacacatgtg

SEQ ID NO: 146330 - DNA, 22 bp, Artificial Sequence
  chemically synthesized
tatatatacacacacatgtgtg

SEQ ID NO: 146331 - DNA, 22 bp, Artificial Sequence
  chemically synthesized
ataaatatatacaatttttatg

SEQ ID NO: 146332 - DNA, 22 bp, Artificial Sequence
  chemically synthesized
ttatgaataaaaaattattagc

SEQ ID NO: 146333 - DNA, 22 bp, Artificial Sequence
  chemically synthesized
tatgaataaaaaattattagca

SEQ ID NO: 146334 - DNA, 22 bp, Artificial Sequence
  chemically synthesized
atgaataaaaaattattagcaa

SEQ ID NO: 146335 - DNA, 22 bp, Artificial Sequence
  chemically synthesized
tgaataaaaaattattagcaat

SEQ ID NO: 146336 - DNA, 22 bp, Artificial Sequence
  chemically synthesized
ttagcaatcaatattgaaaacc

SEQ ID NO: 146337 - DNA, 22 bp, Artificial Sequence
  chemically synthesized
gcaatcaatattgaaaaccact

SEQ ID NO: 146338 - DNA, 22 bp, Artificial Sequence
  chemically synthesized
aaaaccactgatttttgtttat

SEQ ID NO: 146339 - DNA, 22 bp, Artificial Sequence
  chemically synthesized
atttttgtttatgtgagcaaac

SEQ ID NO: 146340 - DNA, 22 bp, Artificial Sequence
  chemically synthesized
ttgtttatgtgagcaaacagca

SEQ ID NO: 146341 - DNA, 22 bp, Artificial Sequence
  chemically synthesized
tgtttatgtgagcaaacagcag

SEQ ID NO: 146342 - DNA, 22 bp, Artificial Sequence
  chemically synthesized
gtttatgtgagcaaacagcaga

SEQ ID NO: 146343 - DNA, 22 bp, Artificial Sequence
  chemically synthesized
tttatgtgagcaaacagcagat

SEQ ID NO: 146344 - DNA, 22 bp, Artificial Sequence
  chemically synthesized
atgtgagcaaacagcagattaa

SEQ ID NO: 146345 - DNA, 22 bp, Artificial Sequence
  chemically synthesized
tgtgagcaaacagcagattaaa

SEQ ID NO: 146346 - DNA, 22 bp, Artificial Sequence
  chemically synthesized
aaaggctgagatttaggaaaca

SEQ ID NO: 146347 - DNA, 22 bp, Artificial Sequence
  chemically synthesized
agatttaggaaacagcacgtta

SEQ ID NO: 146348 - DNA, 22 bp, Artificial Sequence
  chemically synthesized
aggaaacagcacgttaagtcaa

SEQ ID NO: 146349 - DNA, 22 bp, Artificial Sequence
  chemically synthesized
ggaaacagcacgttaagtcaag

SEQ ID NO: 146350 - DNA, 22 bp, Artificial Sequence
  chemically synthesized
agtcaagttgatagaggagaat

SEQ ID NO: 146351 - DNA, 22 bp, Artificial Sequence
  chemically synthesized
atagaggagaatatggacattt

SEQ ID NO: 146352 - DNA, 22 bp, Artificial Sequence
  chemically synthesized
aaaagaggcaggatgatataaa

SEQ ID NO: 146353 - DNA, 22 bp, Artificial Sequence
  chemically synthesized
aaagaggcaggatgatataaaa

SEQ ID NO: 146354 - DNA, 22 bp, Artificial Sequence
  chemically synthesized
gggaaactggatgcagagacca

SEQ ID NO: 146355 - DNA, 22 bp, Artificial Sequence
  chemically synthesized
gatgcagagaccagatgaagta

SEQ ID NO: 146356 - DNA, 22 bp, Artificial Sequence
  chemically synthesized
tcgttttgagcaaaaatcactg

SEQ ID NO: 146357 - DNA, 22 bp, Artificial Sequence
  chemically synthesized
tgagcaaaaatcactgaagttt

SEQ ID NO: 146358 - DNA, 22 bp, Artificial Sequence
  chemically synthesized
gagcaaaaatcactgaagtttc

SEQ ID NO: 146359 - DNA, 22 bp, Artificial Sequence
  chemically synthesized
agcaaaaatcactgaagtttct

SEQ ID NO: 146360 - DNA, 22 bp, Artificial Sequence
  chemically synthesized
aagtttcttgcatatgagagtg

SEQ ID NO: 146361 - DNA, 22 bp, Artificial Sequence
  chemically synthesized
cttgcatatgagagtgacataa

SEQ ID NO: 146362 - DNA, 22 bp, Artificial Sequence
  chemically synthesized
ttgcatatgagagtgacataat

SEQ ID NO: 146363 - DNA, 22 bp, Artificial Sequence
  chemically synthesized
gcatatgagagtgacataataa

SEQ ID NO: 146364 - DNA, 22 bp, Artificial Sequence
  chemically synthesized
catatgagagtgacataataaa

SEQ ID NO: 146365 - DNA, 22 bp, Artificial Sequence
  chemically synthesized
attcacatgtatatatatatat

SEQ ID NO: 146366 - DNA, 22 bp, Artificial Sequence
  chemically synthesized
acatgtatatatatatatagaa

SEQ ID NO: 146367 - DNA, 22 bp, Artificial Sequence
  chemically synthesized
attagacaaagtctaacttggg

SEQ ID NO: 146368 - DNA, 22 bp, Artificial Sequence
  chemically synthesized
gacaaagtctaacttgggtata

SEQ ID NO: 146369 - DNA, 22 bp, Artificial Sequence
  chemically synthesized
acttgggtatagtcagaggagc

SEQ ID NO: 146370 - DNA, 22 bp, Artificial Sequence
  chemically synthesized
gggtatagtcagaggagcttgc

SEQ ID NO: 146371 - DNA, 22 bp, Artificial Sequence
  chemically synthesized
ggtatagtcagaggagcttgct

SEQ ID NO: 146372 - DNA, 22 bp, Artificial Sequence
  chemically synthesized
gctgtaattatattgaggtgat

SEQ ID NO: 146373 - DNA, 22 bp, Artificial Sequence
  chemically synthesized
ctgtaattatattgaggtgatg

SEQ ID NO: 146374 - DNA, 22 bp, Artificial Sequence
  chemically synthesized
taattatattgaggtgatggat

SEQ ID NO: 146375 - DNA, 22 bp, Artificial Sequence
  chemically synthesized
tattgaggtgatggataaagaa

SEQ ID NO: 146376 - DNA, 22 bp, Artificial Sequence
  chemically synthesized
aggtgatggataaagaactgaa

SEQ ID NO: 146377 - DNA, 22 bp, Artificial Sequence
  chemically synthesized
aagttgatggaaacaatgaagt

SEQ ID NO: 146378 - DNA, 22 bp, Artificial Sequence
  chemically synthesized
atggaaacaatgaagttaagaa

SEQ ID NO: 146379 - DNA, 22 bp, Artificial Sequence
  chemically synthesized
agaaaaaaaatcgagtaagaga

SEQ ID NO: 146380 - DNA, 22 bp, Artificial Sequence
  chemically synthesized
tggcagtgattgcacagaactg

SEQ ID NO: 146381 - DNA, 22 bp, Artificial Sequence
  chemically synthesized
cacagaactggaaaacattgtg

SEQ ID NO: 146382 - DNA, 22 bp, Artificial Sequence
  chemically synthesized
gaaaacattgtgaaacagagag

SEQ ID NO: 146383 - DNA, 22 bp, Artificial Sequence
  chemically synthesized
tgaaacagagagtcagagatga

SEQ ID NO: 146384 - DNA, 22 bp, Artificial Sequence
  chemically synthesized
aaatccctgtctgtgaatgaaa

SEQ ID NO: 146385 - DNA, 22 bp, Artificial Sequence
  chemically synthesized
tctgtgaatgaaaagaaggaaa

SEQ ID NO: 146386 - DNA, 22 bp, Artificial Sequence
  chemically synthesized
tgaatgaaaagaaggaaattta

SEQ ID NO: 146387 - DNA, 22 bp, Artificial Sequence
  chemically synthesized
attgacagaacagcaaatgcct

SEQ ID NO: 146388 - DNA, 22 bp, Artificial Sequence
  chemically synthesized
ttgacagaacagcaaatgccta

SEQ ID NO: 146389 - DNA, 22 bp, Artificial Sequence
  chemically synthesized
acagaacagcaaatgcctacaa

SEQ ID NO: 146390 - DNA, 22 bp, Artificial Sequence
  chemically synthesized
caagccccctgtttggatctgg

SEQ ID NO: 146391 - DNA, 22 bp, Artificial Sequence
  chemically synthesized
tttggatctggcaatgaacgta

SEQ ID NO: 146392 - DNA, 22 bp, Artificial Sequence
  chemically synthesized
ggatctggcaatgaacgtagcc

SEQ ID NO: 146393 - DNA, 22 bp, Artificial Sequence
  chemically synthesized
gatctggcaatgaacgtagcca

SEQ ID NO: 146394 - DNA, 22 bp, Artificial Sequence
  chemically synthesized
gcaatgaacgtagccattctgt

SEQ ID NO: 146395 - DNA, 22 bp, Artificial Sequence
  chemically synthesized
tgtggcaatcacttcaaactcc

SEQ ID NO: 146396 - DNA, 22 bp, Artificial Sequence
  chemically synthesized
tggcaatcacttcaaactcctg

SEQ ID NO: 146397 - DNA, 22 bp, Artificial Sequence
  chemically synthesized
caaactcctgtacccaagaccc

SEQ ID NO: 146398 - DNA, 22 bp, Artificial Sequence
  chemically synthesized
aaactcctgtacccaagaccct

SEQ ID NO: 146399 - DNA, 22 bp, Artificial Sequence
  chemically synthesized
ctgtacccaagacccttaggaa

SEQ ID NO: 146400 - DNA, 22 bp, Artificial Sequence
  chemically synthesized
tacccaagacccttaggaagta

SEQ ID NO: 146401 - DNA, 22 bp, Artificial Sequence
  chemically synthesized
aggaagtatgtagcaccctcaa

SEQ ID NO: 146402 - DNA, 22 bp, Artificial Sequence
  chemically synthesized
ggaagtatgtagcaccctcaaa

SEQ ID NO: 146403 - DNA, 22 bp, Artificial Sequence
  chemically synthesized
aaacctaaaacctcaaagaaag

SEQ ID NO: 146404 - DNA, 22 bp, Artificial Sequence
  chemically synthesized
aaacctcaaagaaagaggtttt

SEQ ID NO: 146405 - DNA, 22 bp, Artificial Sequence
  chemically synthesized
aaagaaagaggttttagaagat

SEQ ID NO: 146406 - DNA, 22 bp, Artificial Sequence
  chemically synthesized
tagaagatataataccctttct

SEQ ID NO: 146407 - DNA, 22 bp, Artificial Sequence
  chemically synthesized
agaagatataataccctttctt

SEQ ID NO: 146408 - DNA, 22 bp, Artificial Sequence
  chemically synthesized
gaagatataataccctttcttc

SEQ ID NO: 146409 - DNA, 22 bp, Artificial Sequence
  chemically synthesized
tcttctccagtttcattaatcc

SEQ ID NO: 146410 - DNA, 22 bp, Artificial Sequence
  chemically synthesized
cttctccagtttcattaatccc

SEQ ID NO: 146411 - DNA, 22 bp, Artificial Sequence
  chemically synthesized
ttctccagtttcattaatccca

SEQ ID NO: 146412 - DNA, 22 bp, Artificial Sequence
  chemically synthesized
ctccagtttcattaatcccaaa

SEQ ID NO: 146413 - DNA, 22 bp, Artificial Sequence
  chemically synthesized
tccagtttcattaatcccaaaa

SEQ ID NO: 146414 - DNA, 22 bp, Artificial Sequence
  chemically synthesized
cagtttcattaatcccaaaacc

SEQ ID NO: 146415 - DNA, 22 bp, Artificial Sequence
  chemically synthesized
cattaatcccaaaacctctttc

SEQ ID NO: 146416 - DNA, 22 bp, Artificial Sequence
  chemically synthesized
attaatcccaaaacctctttct

SEQ ID NO: 146417 - DNA, 22 bp, Artificial Sequence
  chemically synthesized
atcccaaaacctctttctcaaa

SEQ ID NO: 146418 - DNA, 22 bp, Artificial Sequence
  chemically synthesized
tttctcaaagtatttcctctat

SEQ ID NO: 146419 - DNA, 22 bp, Artificial Sequence
  chemically synthesized
tctcaaagtatttcctctatgt

SEQ ID NO: 146420 - DNA, 22 bp, Artificial Sequence
  chemically synthesized
ctcaaagtatttcctctatgtg

SEQ ID NO: 146421 - DNA, 22 bp, Artificial Sequence
  chemically synthesized
tcaaagtatttcctctatgtgt

SEQ ID NO: 146422 - DNA, 22 bp, Artificial Sequence
  chemically synthesized
aaagtatttcctctatgtgtcc

SEQ ID NO: 146423 - DNA, 22 bp, Artificial Sequence
  chemically synthesized
cctctatgtgtccaccccaaag

SEQ ID NO: 146424 - DNA, 22 bp, Artificial Sequence
  chemically synthesized
ctctatgtgtccaccccaaaga

SEQ ID NO: 146425 - DNA, 22 bp, Artificial Sequence
  chemically synthesized
tatgtgtccaccccaaagagct

SEQ ID NO: 146426 - DNA, 22 bp, Artificial Sequence
  chemically synthesized
tgtgtccaccccaaagagctca

SEQ ID NO: 146427 - DNA, 22 bp, Artificial Sequence
  chemically synthesized
acctcaccatatctcttgagtg

SEQ ID NO: 146428 - DNA, 22 bp, Artificial Sequence
  chemically synthesized
accatatctcttgagtgggagc

SEQ ID NO: 146429 - DNA, 22 bp, Artificial Sequence
  chemically synthesized
ttgagtgggagcacatagatag

SEQ ID NO: 146430 - DNA, 22 bp, Artificial Sequence
  chemically synthesized
gagtgggagcacatagataggc

SEQ ID NO: 146431 - DNA, 22 bp, Artificial Sequence
  chemically synthesized
agtgggagcacatagataggcg

SEQ ID NO: 146432 - DNA, 22 bp, Artificial Sequence
  chemically synthesized
ccatctaacagcttctgaaatt

SEQ ID NO: 146433 - DNA, 22 bp, Artificial Sequence
  chemically synthesized
acagcttctgaaattcctttgt

SEQ ID NO: 146434 - DNA, 22 bp, Artificial Sequence
  chemically synthesized
ctgaaattcctttgtcatattt

SEQ ID NO: 146435 - DNA, 22 bp, Artificial Sequence
  chemically synthesized
tgaaattcctttgtcatatttt

SEQ ID NO: 146436 - DNA, 22 bp, Artificial Sequence
  chemically synthesized
aaattcctttgtcatatttttg

SEQ ID NO: 146437 - DNA, 22 bp, Artificial Sequence
  chemically synthesized
ctttgtcatatttttgagtccc

SEQ ID NO: 146438 - DNA, 22 bp, Artificial Sequence
  chemically synthesized
tgtcatatttttgagtccccac

SEQ ID NO: 146439 - DNA, 22 bp, Artificial Sequence
  chemically synthesized
gtcatatttttgagtccccact

SEQ ID NO: 146440 - DNA, 22 bp, Artificial Sequence
  chemically synthesized
tcatatttttgagtccccacta

SEQ ID NO: 146441 - DNA, 22 bp, Artificial Sequence
  chemically synthesized
ttgagtccccactaataaccca

SEQ ID NO: 146442 - DNA, 22 bp, Artificial Sequence
  chemically synthesized
tgagtccccactaataacccac

SEQ ID NO: 146443 - DNA, 22 bp, Artificial Sequence
  chemically synthesized
gagtccccactaataacccaca

SEQ ID NO: 146444 - DNA, 22 bp, Artificial Sequence
  chemically synthesized
agtccccactaataacccacaa

SEQ ID NO: 146445 - DNA, 22 bp, Artificial Sequence
  chemically synthesized
ataacccacaaagcagaataaa

SEQ ID NO: 146446 - DNA, 22 bp, Artificial Sequence
  chemically synthesized
ctcatgtacaataatcactcaa

SEQ ID NO: 146447 - DNA, 22 bp, Artificial Sequence
  chemically synthesized
atgtacaataatcactcaactg

SEQ ID NO: 146448 - DNA, 22 bp, Artificial Sequence
  chemically synthesized
aactgctgtcttgtagcataca

SEQ ID NO: 146449 - DNA, 22 bp, Artificial Sequence
  chemically synthesized
ctgtcttgtagcatacattaat

SEQ ID NO: 146450 - DNA, 22 bp, Artificial Sequence
  chemically synthesized
tcttgtagcatacattaattaa

SEQ ID NO: 146451 - DNA, 22 bp, Artificial Sequence
  chemically synthesized
gtagcatacattaattaagcac

SEQ ID NO: 146452 - DNA, 22 bp, Artificial Sequence
  chemically synthesized
tagcatacattaattaagcaca

SEQ ID NO: 146453 - DNA, 22 bp, Artificial Sequence
  chemically synthesized
attaagcacattctttgaataa

SEQ ID NO: 146454 - DNA, 22 bp, Artificial Sequence
  chemically synthesized
agcacattctttgaataattac

SEQ ID NO: 146455 - DNA, 22 bp, Artificial Sequence
  chemically synthesized
tttgaataattactgtgtccaa

SEQ ID NO: 146456 - DNA, 22 bp, Artificial Sequence
  chemically synthesized
tgaataattactgtgtccaaac

SEQ ID NO: 146457 - DNA, 22 bp, Artificial Sequence
  chemically synthesized
gaataattactgtgtccaaaca

SEQ ID NO: 146458 - DNA, 22 bp, Artificial Sequence
  chemically synthesized
aataattactgtgtccaaacaa

SEQ ID NO: 146459 - DNA, 22 bp, Artificial Sequence
  chemically synthesized
ctgtgtccaaacaatcacactt

SEQ ID NO: 146460 - DNA, 22 bp, Artificial Sequence
  chemically synthesized
tgtccaaacaatcacactttaa

SEQ ID NO: 146461 - DNA, 22 bp, Artificial Sequence
  chemically synthesized
taaaatctcacacttgtgctat

SEQ ID NO: 146462 - DNA, 22 bp, Artificial Sequence
  chemically synthesized
aaaatctcacacttgtgctatc

SEQ ID NO: 146463 - DNA, 22 bp, Artificial Sequence
  chemically synthesized
aaatctcacacttgtgctatcc

SEQ ID NO: 146464 - DNA, 22 bp, Artificial Sequence
  chemically synthesized
acacttgtgctatcccttgccc

SEQ ID NO: 146465 - DNA, 22 bp, Artificial Sequence
  chemically synthesized
gtgctatcccttgcccttctga

SEQ ID NO: 146466 - DNA, 22 bp, Artificial Sequence
  chemically synthesized
tgctatcccttgcccttctgaa

SEQ ID NO: 146467 - DNA, 22 bp, Artificial Sequence
  chemically synthesized
tcccttgcccttctgaatgtca

SEQ ID NO: 146468 - DNA, 22 bp, Artificial Sequence
  chemically synthesized
gcccttctgaatgtcactctgt

SEQ ID NO: 146469 - DNA, 22 bp, Artificial Sequence
  chemically synthesized
cccttctgaatgtcactctgta

SEQ ID NO: 146470 - DNA, 22 bp, Artificial Sequence
  chemically synthesized
ctgaatgtcactctgtatttta

SEQ ID NO: 146471 - DNA, 22 bp, Artificial Sequence
  chemically synthesized
tgaatgtcactctgtattttaa

SEQ ID NO: 146472 - DNA, 22 bp, Artificial Sequence
  chemically synthesized
aatgtcactctgtattttaaat

SEQ ID NO: 146473 - DNA, 22 bp, Artificial Sequence
  chemically synthesized
tgtattttaaatgaagagatga

SEQ ID NO: 146474 - DNA, 22 bp, Artificial Sequence
  chemically synthesized
tattttaaatgaagagatgagg

SEQ ID NO: 146475 - DNA, 22 bp, Artificial Sequence
  chemically synthesized
taaatgaagagatgagggttga

SEQ ID NO: 146476 - DNA, 22 bp, Artificial Sequence
  chemically synthesized
aaatgaagagatgagggttgaa

SEQ ID NO: 146477 - DNA, 22 bp, Artificial Sequence
  chemically synthesized
aatgaagagatgagggttgaat

SEQ ID NO: 146478 - DNA, 22 bp, Artificial Sequence
  chemically synthesized
aatttcctgtgttacttattgt

SEQ ID NO: 146479 - DNA, 22 bp, Artificial Sequence
  chemically synthesized
cctgtgttacttattgttcatt

SEQ ID NO: 146480 - DNA, 22 bp, Artificial Sequence
  chemically synthesized
ctgtgttacttattgttcattt

SEQ ID NO: 146481 - DNA, 22 bp, Artificial Sequence
  chemically synthesized
tgttacttattgttcatttctc

SEQ ID NO: 146482 - DNA, 22 bp, Artificial Sequence
  chemically synthesized
cttattgttcatttctcgatga

SEQ ID NO: 146483 - DNA, 22 bp, Artificial Sequence
  chemically synthesized
attgttcatttctcgatgagga

SEQ ID NO: 146484 - DNA, 22 bp, Artificial Sequence
  chemically synthesized
ttgttcatttctcgatgaggag

SEQ ID NO: 146485 - DNA, 22 bp, Artificial Sequence
  chemically synthesized
ttcatttctcgatgaggagttt

SEQ ID NO: 146486 - DNA, 22 bp, Artificial Sequence
  chemically synthesized
atttctcgatgaggagttttca

SEQ ID NO: 146487 - DNA, 22 bp, Artificial Sequence
  chemically synthesized
ctcgatgaggagttttcacatt

SEQ ID NO: 146488 - DNA, 22 bp, Artificial Sequence
  chemically synthesized
tcgatgaggagttttcacattc

SEQ ID NO: 146489 - DNA, 22 bp, Artificial Sequence
  chemically synthesized
gatgaggagttttcacattcac

SEQ ID NO: 146490 - DNA, 22 bp, Artificial Sequence
  chemically synthesized
tcacattcacctttagtggaaa

SEQ ID NO: 146491 - DNA, 22 bp, Artificial Sequence
  chemically synthesized
cacattcacctttagtggaaaa

SEQ ID NO: 146492 - DNA, 22 bp, Artificial Sequence
  chemically synthesized
acattcacctttagtggaaaac

SEQ ID NO: 146493 - DNA, 22 bp, Artificial Sequence
  chemically synthesized
acctttagtggaaaacacataa

SEQ ID NO: 146494 - DNA, 22 bp, Artificial Sequence
  chemically synthesized
tagtggaaaacacataagtaca

SEQ ID NO: 146495 - DNA, 22 bp, Artificial Sequence
  chemically synthesized
agtggaaaacacataagtacac

SEQ ID NO: 146496 - DNA, 22 bp, Artificial Sequence
  chemically synthesized
gtggaaaacacataagtacaca

SEQ ID NO: 146497 - DNA, 22 bp, Artificial Sequence
  chemically synthesized
acaggaaaaatataccaaactg

SEQ ID NO: 146498 - DNA, 22 bp, Artificial Sequence
  chemically synthesized
caggaaaaatataccaaactga

SEQ ID NO: 146499 - DNA, 22 bp, Artificial Sequence
  chemically synthesized
acatgtagcatgaatgcttgtg

SEQ ID NO: 146500 - DNA, 22 bp, Artificial Sequence
  chemically synthesized
gtgcatgtagtcatataaaatc

SEQ ID NO: 146501 - DNA, 22 bp, Artificial Sequence
  chemically synthesized
tgcatgtagtcatataaaatct

SEQ ID NO: 146502 - DNA, 22 bp, Artificial Sequence
  chemically synthesized
gtagcaatgtaaacattctctg

SEQ ID NO: 146503 - DNA, 22 bp, Artificial Sequence
  chemically synthesized
tagcaatgtaaacattctctga

SEQ ID NO: 146504 - DNA, 22 bp, Artificial Sequence
  chemically synthesized
tctgatatacacatacagatgt

SEQ ID NO: 146505 - DNA, 22 bp, Artificial Sequence
  chemically synthesized
tgatatacacatacagatgtgt

SEQ ID NO: 146506 - DNA, 22 bp, Artificial Sequence
  chemically synthesized
atatacacatacagatgtgtct

SEQ ID NO: 146507 - DNA, 22 bp, Artificial Sequence
  chemically synthesized
tatgtctacacaatttcttatg

SEQ ID NO: 146508 - DNA, 22 bp, Artificial Sequence
  chemically synthesized
cacaatttcttatgctccatga

SEQ ID NO: 146509 - DNA, 22 bp, Artificial Sequence
  chemically synthesized
cttatgctccatgaacaaacat

SEQ ID NO: 146510 - DNA, 22 bp, Artificial Sequence
  chemically synthesized
ttatgctccatgaacaaacatt

SEQ ID NO: 146511 - DNA, 22 bp, Artificial Sequence
  chemically synthesized
atgctccatgaacaaacattcc

SEQ ID NO: 146512 - DNA, 22 bp, Artificial Sequence
  chemically synthesized
tgctccatgaacaaacattcca

SEQ ID NO: 146513 - DNA, 22 bp, Artificial Sequence
  chemically synthesized
catgaacaaacattccatgcac

SEQ ID NO: 146514 - DNA, 22 bp, Artificial Sequence
  chemically synthesized
catgcacacataagaacacaca

SEQ ID NO: 146515 - DNA, 22 bp, Artificial Sequence
  chemically synthesized
ttacagatgcatacttgagtgc

SEQ ID NO: 146516 - DNA, 22 bp, Artificial Sequence
  chemically synthesized
cagatgcatacttgagtgcatt

SEQ ID NO: 146517 - DNA, 22 bp, Artificial Sequence
  chemically synthesized
gagtgcattgacaaaattaccc

SEQ ID NO: 146518 - DNA, 22 bp, Artificial Sequence
  chemically synthesized
agtgcattgacaaaattacccc

SEQ ID NO: 146519 - DNA, 22 bp, Artificial Sequence
  chemically synthesized
acaaaattaccccagtcaatct

SEQ ID NO: 146520 - DNA, 22 bp, Artificial Sequence
  chemically synthesized
ccccagtcaatctagagaattt

SEQ ID NO: 146521 - DNA, 22 bp, Artificial Sequence
  chemically synthesized
gagaatttggatttctgcattt

SEQ ID NO: 146522 - DNA, 22 bp, Artificial Sequence
  chemically synthesized
ggatttctgcatttgactctgt

SEQ ID NO: 146523 - DNA, 22 bp, Artificial Sequence
  chemically synthesized
gatttctgcatttgactctgtt

SEQ ID NO: 146524 - DNA, 22 bp, Artificial Sequence
  chemically synthesized
ctgcatttgactctgttagctt

SEQ ID NO: 146525 - DNA, 22 bp, Artificial Sequence
  chemically synthesized
tgcatttgactctgttagcttt

SEQ ID NO: 146526 - DNA, 22 bp, Artificial Sequence
  chemically synthesized
catttgactctgttagctttgt

SEQ ID NO: 146527 - DNA, 22 bp, Artificial Sequence
  chemically synthesized
gactctgttagctttgtacatg

SEQ ID NO: 146528 - DNA, 22 bp, Artificial Sequence
  chemically synthesized
actctgttagctttgtacatgc

SEQ ID NO: 146529 - DNA, 22 bp, Artificial Sequence
  chemically synthesized
tgttagctttgtacatgctgtt

SEQ ID NO: 146530 - DNA, 22 bp, Artificial Sequence
  chemically synthesized
ttagctttgtacatgctgttca

SEQ ID NO: 146531 - DNA, 22 bp, Artificial Sequence
  chemically synthesized
gctttgtacatgctgttcattt

SEQ ID NO: 146532 - DNA, 22 bp, Artificial Sequence
  chemically synthesized
tgtacatgctgttcatttactc

SEQ ID NO: 146533 - DNA, 22 bp, Artificial Sequence
  chemically synthesized
gtacatgctgttcatttactct

SEQ ID NO: 146534 - DNA, 22 bp, Artificial Sequence
  chemically synthesized
tacatgctgttcatttactctg

SEQ ID NO: 146535 - DNA, 22 bp, Artificial Sequence
  chemically synthesized
ttcatttactctgggtgatgtc

SEQ ID NO: 146536 - DNA, 22 bp, Artificial Sequence
  chemically synthesized
atttactctgggtgatgtcttt

SEQ ID NO: 146537 - DNA, 22 bp, Artificial Sequence
  chemically synthesized
actctgggtgatgtctttccct

SEQ ID NO: 146538 - DNA, 22 bp, Artificial Sequence
  chemically synthesized
ctctgggtgatgtctttccctc

SEQ ID NO: 146539 - DNA, 22 bp, Artificial Sequence
  chemically synthesized
tgggtgatgtctttccctcatt

SEQ ID NO: 146540 - DNA, 22 bp, Artificial Sequence
  chemically synthesized
ggtgatgtctttccctcatttt

SEQ ID NO: 146541 - DNA, 22 bp, Artificial Sequence
  chemically synthesized
tccctcattttgccttgtctat

SEQ ID NO: 146542 - DNA, 22 bp, Artificial Sequence
  chemically synthesized
ccctcattttgccttgtctatc

SEQ ID NO: 146543 - DNA, 22 bp, Artificial Sequence
  chemically synthesized
cctcattttgccttgtctatct

SEQ ID NO: 146544 - DNA, 22 bp, Artificial Sequence
  chemically synthesized
attttgccttgtctatcttgta

SEQ ID NO: 146545 - DNA, 22 bp, Artificial Sequence
  chemically synthesized
tgccttgtctatcttgtactca

SEQ ID NO: 146546 - DNA, 22 bp, Artificial Sequence
  chemically synthesized
gccttgtctatcttgtactcat

SEQ ID NO: 146547 - DNA, 22 bp, Artificial Sequence
  chemically synthesized
ccttgtctatcttgtactcata

SEQ ID NO: 146548 - DNA, 22 bp, Artificial Sequence
  chemically synthesized
gtctatcttgtactcatacttt

SEQ ID NO: 146549 - DNA, 22 bp, Artificial Sequence
  chemically synthesized
tctatcttgtactcatacttta

SEQ ID NO: 146550 - DNA, 22 bp, Artificial Sequence
  chemically synthesized
tcttgtactcatactttaagtc

SEQ ID NO: 146551 - DNA, 22 bp, Artificial Sequence
  chemically synthesized
gtactcatactttaagtcctaa

SEQ ID NO: 146552 - DNA, 22 bp, Artificial Sequence
  chemically synthesized
tactcatactttaagtcctaac

SEQ ID NO: 146553 - DNA, 22 bp, Artificial Sequence
  chemically synthesized
atactttaagtcctaacttata

SEQ ID NO: 146554 - DNA, 22 bp, Artificial Sequence
  chemically synthesized
taagtcctaacttatatgttat

SEQ ID NO: 146555 - DNA, 22 bp, Artificial Sequence
  chemically synthesized
aagtcctaacttatatgttatc

SEQ ID NO: 146556 - DNA, 22 bp, Artificial Sequence
  chemically synthesized
agtcctaacttatatgttatct

SEQ ID NO: 146557 - DNA, 22 bp, Artificial Sequence
  chemically synthesized
acttatatgttatctcaactaa

SEQ ID NO: 146558 - DNA, 22 bp, Artificial Sequence
  chemically synthesized
atatgttatctcaactaagaag

SEQ ID NO: 146559 - DNA, 22 bp, Artificial Sequence
  chemically synthesized
tatgttatctcaactaagaagc

SEQ ID NO: 146560 - DNA, 22 bp, Artificial Sequence
  chemically synthesized
tctcaactaagaagctattttt

SEQ ID NO: 146561 - DNA, 22 bp, Artificial Sequence
  chemically synthesized
aactaagaagctattttttttt

SEQ ID NO: 146562 - DNA, 22 bp, Artificial Sequence
  chemically synthesized
agaagctatttttttttaattt

SEQ ID NO: 146563 - DNA, 22 bp, Artificial Sequence
  chemically synthesized
tttttttttaattttaactggg

SEQ ID NO: 146564 - DNA, 22 bp, Artificial Sequence
  chemically synthesized
ttttttaattttaactgggctt

SEQ ID NO: 146565 - DNA, 22 bp, Artificial Sequence
  chemically synthesized
tttttaattttaactgggctta

SEQ ID NO: 146566 - DNA, 22 bp, Artificial Sequence
  chemically synthesized
ttttaattttaactgggcttaa

SEQ ID NO: 146567 - DNA, 22 bp, Artificial Sequence
  chemically synthesized
tttaattttaactgggcttaaa

SEQ ID NO: 146568 - DNA, 22 bp, Artificial Sequence
  chemically synthesized
ttaattttaactgggcttaaag

SEQ ID NO: 146569 - DNA, 22 bp, Artificial Sequence
  chemically synthesized
taattttaactgggcttaaagc

SEQ ID NO: 146570 - DNA, 22 bp, Artificial Sequence
  chemically synthesized
aattttaactgggcttaaagcc

SEQ ID NO: 146571 - DNA, 22 bp, Artificial Sequence
  chemically synthesized
attttaactgggcttaaagccc

SEQ ID NO: 146572 - DNA, 22 bp, Artificial Sequence
  chemically synthesized
taactgggcttaaagccctgtc

SEQ ID NO: 146573 - DNA, 22 bp, Artificial Sequence
  chemically synthesized
aactgggcttaaagccctgtct

SEQ ID NO: 146574 - DNA, 22 bp, Artificial Sequence
  chemically synthesized
actgggcttaaagccctgtcta

SEQ ID NO: 146575 - DNA, 22 bp, Artificial Sequence
  chemically synthesized
ggcttaaagccctgtctataaa

SEQ ID NO: 146576 - DNA, 22 bp, Artificial Sequence
  chemically synthesized
aaagccctgtctataaactctg

SEQ ID NO: 146577 - DNA, 22 bp, Artificial Sequence
  chemically synthesized
aagccctgtctataaactctgc

SEQ ID NO: 146578 - DNA, 22 bp, Artificial Sequence
  chemically synthesized
tctataaactctgctacaatta

SEQ ID NO: 146579 - DNA, 22 bp, Artificial Sequence
  chemically synthesized
taaactctgctacaattatggg

SEQ ID NO: 146580 - DNA, 22 bp, Artificial Sequence
  chemically synthesized
tgctacaattatgggctctttc

SEQ ID NO: 146581 - DNA, 22 bp, Artificial Sequence
  chemically synthesized
ctacaattatgggctctttctt

SEQ ID NO: 146582 - DNA, 22 bp, Artificial Sequence
  chemically synthesized
caattatgggctctttcttata

SEQ ID NO: 146583 - DNA, 22 bp, Artificial Sequence
  chemically synthesized
tgggctctttcttataatattt

SEQ ID NO: 146584 - DNA, 22 bp, Artificial Sequence
  chemically synthesized
tttcttataatatttagtgttt

SEQ ID NO: 146585 - DNA, 22 bp, Artificial Sequence
  chemically synthesized
tcttataatatttagtgttttt

SEQ ID NO: 146586 - DNA, 22 bp, Artificial Sequence
  chemically synthesized
cttataatatttagtgtttttc

SEQ ID NO: 146587 - DNA, 22 bp, Artificial Sequence
  chemically synthesized
ttataatatttagtgtttttcc

SEQ ID NO: 146588 - DNA, 22 bp, Artificial Sequence
  chemically synthesized
ataatatttagtgtttttccta

SEQ ID NO: 146589 - DNA, 22 bp, Artificial Sequence
  chemically synthesized
taatatttagtgtttttcctac

SEQ ID NO: 146590 - DNA, 22 bp, Artificial Sequence
  chemically synthesized
agtgtttttcctactaatgtac

SEQ ID NO: 146591 - DNA, 22 bp, Artificial Sequence
  chemically synthesized
gtgtttttcctactaatgtact

SEQ ID NO: 146592 - DNA, 22 bp, Artificial Sequence
  chemically synthesized
ttcctactaatgtacttaatct

SEQ ID NO: 146593 - DNA, 22 bp, Artificial Sequence
  chemically synthesized
tcctactaatgtacttaatctg

SEQ ID NO: 146594 - DNA, 22 bp, Artificial Sequence
  chemically synthesized
cctactaatgtacttaatctgc

SEQ ID NO: 146595 - DNA, 22 bp, Artificial Sequence
  chemically synthesized
ctactaatgtacttaatctgct

SEQ ID NO: 146596 - DNA, 22 bp, Artificial Sequence
  chemically synthesized
ctaatgtacttaatctgctcat

SEQ ID NO: 146597 - DNA, 22 bp, Artificial Sequence
  chemically synthesized
atgtacttaatctgctcattgt

SEQ ID NO: 146598 - DNA, 22 bp, Artificial Sequence
  chemically synthesized
aatctgctcattgtatattcct

SEQ ID NO: 146599 - DNA, 22 bp, Artificial Sequence
  chemically synthesized
atctgctcattgtatattccta

SEQ ID NO: 146600 - DNA, 22 bp, Artificial Sequence
  chemically synthesized
ctcattgtatattcctaccact

SEQ ID NO: 146601 - DNA, 22 bp, Artificial Sequence
  chemically synthesized
attgtatattcctaccactaaa

SEQ ID NO: 146602 - DNA, 22 bp, Artificial Sequence
  chemically synthesized
tatattcctaccactaaatttt

SEQ ID NO: 146603 - DNA, 22 bp, Artificial Sequence
  chemically synthesized
ctaccactaaattttaacctct

SEQ ID NO: 146604 - DNA, 22 bp, Artificial Sequence
  chemically synthesized
ccactaaattttaacctctttt

SEQ ID NO: 146605 - DNA, 22 bp, Artificial Sequence
  chemically synthesized
aattttaacctcttttatggta

SEQ ID NO: 146606 - DNA, 22 bp, Artificial Sequence
  chemically synthesized
taacctcttttatggtagagac

SEQ ID NO: 146607 - DNA, 22 bp, Artificial Sequence
  chemically synthesized
aacctcttttatggtagagaca

SEQ ID NO: 146608 - DNA, 22 bp, Artificial Sequence
  chemically synthesized
acctcttttatggtagagacat

SEQ ID NO: 146609 - DNA, 22 bp, Artificial Sequence
  chemically synthesized
ttttatggtagagacattgtct

SEQ ID NO: 146610 - DNA, 22 bp, Artificial Sequence
  chemically synthesized
ttatggtagagacattgtcttg

SEQ ID NO: 146611 - DNA, 22 bp, Artificial Sequence
  chemically synthesized
tatggtagagacattgtcttgt

SEQ ID NO: 146612 - DNA, 22 bp, Artificial Sequence
  chemically synthesized
atggtagagacattgtcttgta

SEQ ID NO: 146613 - DNA, 22 bp, Artificial Sequence
  chemically synthesized
tggtagagacattgtcttgtaa

SEQ ID NO: 146614 - DNA, 22 bp, Artificial Sequence
  chemically synthesized
tcttgtaaactcttatttccct

SEQ ID NO: 146615 - DNA, 22 bp, Artificial Sequence
  chemically synthesized
gtaaactcttatttccctagta

SEQ ID NO: 146616 - DNA, 22 bp, Artificial Sequence
  chemically synthesized
taaactcttatttccctagtat

SEQ ID NO: 146617 - DNA, 22 bp, Artificial Sequence
  chemically synthesized
ttatttccctagtatttggaga

SEQ ID NO: 146618 - DNA, 22 bp, Artificial Sequence
  chemically synthesized
atttccctagtatttggagatg

SEQ ID NO: 146619 - DNA, 22 bp, Artificial Sequence
  chemically synthesized
tttccctagtatttggagatga

SEQ ID NO: 146620 - DNA, 22 bp, Artificial Sequence
  chemically synthesized
ccctagtatttggagatgaaaa

SEQ ID NO: 146621 - DNA, 22 bp, Artificial Sequence
  chemically synthesized
cctagtatttggagatgaaaaa

SEQ ID NO: 146622 - DNA, 22 bp, Artificial Sequence
  chemically synthesized
gtatttggagatgaaaaaaaag

SEQ ID NO: 146623 - DNA, 22 bp, Artificial Sequence
  chemically synthesized
ggagatgaaaaaaaagattaaa

SEQ ID NO: 146624 - DNA, 22 bp, Artificial Sequence
  chemically synthesized
gagatgaaaaaaaagattaaat

SEQ ID NO: 146625 - DNA, 22 bp, Artificial Sequence
  chemically synthesized
aattatccaaaattagatctct

SEQ ID NO: 146626 - DNA, 22 bp, Artificial Sequence
  chemically synthesized
tccaaaattagatctctctttt

SEQ ID NO: 146627 - DNA, 22 bp, Artificial Sequence
  chemically synthesized
gatctctcttttctacattatg

SEQ ID NO: 146628 - DNA, 22 bp, Artificial Sequence
  chemically synthesized
tcttttctacattatgagtatt

SEQ ID NO: 146629 - DNA, 22 bp, Artificial Sequence
  chemically synthesized
ttttctacattatgagtattac

SEQ ID NO: 146630 - DNA, 22 bp, Artificial Sequence
  chemically synthesized
ttctacattatgagtattacac

SEQ ID NO: 146631 - DNA, 22 bp, Artificial Sequence
  chemically synthesized
tctacattatgagtattacact

SEQ ID NO: 146632 - DNA, 22 bp, Artificial Sequence
  chemically synthesized
ctacattatgagtattacacta

SEQ ID NO: 146633 - DNA, 22 bp, Artificial Sequence
  chemically synthesized
tacattatgagtattacactat

SEQ ID NO: 146634 - DNA, 22 bp, Artificial Sequence
  chemically synthesized
cattatgagtattacactatcc

SEQ ID NO: 146635 - DNA, 22 bp, Artificial Sequence
  chemically synthesized
tgagtattacactatccataga

SEQ ID NO: 146636 - DNA, 22 bp, Artificial Sequence
  chemically synthesized
cactatccatagagaagtttgt

SEQ ID NO: 146637 - DNA, 22 bp, Artificial Sequence
  chemically synthesized
tccatagagaagtttgtttgag

SEQ ID NO: 146638 - DNA, 22 bp, Artificial Sequence
  chemically synthesized
gtttgagacctaaactgaggaa

SEQ ID NO: 146639 - DNA, 22 bp, Artificial Sequence
  chemically synthesized
tttgagacctaaactgaggaac

SEQ ID NO: 146640 - DNA, 22 bp, Artificial Sequence
  chemically synthesized
gagacctaaactgaggaacctt

SEQ ID NO: 146641 - DNA, 22 bp, Artificial Sequence
  chemically synthesized
agacctaaactgaggaaccttt

SEQ ID NO: 146642 - DNA, 22 bp, Artificial Sequence
  chemically synthesized
aactgaggaacctttggttcta

SEQ ID NO: 146643 - DNA, 22 bp, Artificial Sequence
  chemically synthesized
aggaacctttggttctaaaatg

SEQ ID NO: 146644 - DNA, 22 bp, Artificial Sequence
  chemically synthesized
tggttctaaaatgactatgtga

SEQ ID NO: 146645 - DNA, 22 bp, Artificial Sequence
  chemically synthesized
ggttctaaaatgactatgtgat

SEQ ID NO: 146646 - DNA, 22 bp, Artificial Sequence
  chemically synthesized
gttctaaaatgactatgtgata

SEQ ID NO: 146647 - DNA, 22 bp, Artificial Sequence
  chemically synthesized
taaaatgactatgtgatatctt

SEQ ID NO: 146648 - DNA, 22 bp, Artificial Sequence
  chemically synthesized
aaatgactatgtgatatcttag

SEQ ID NO: 146649 - DNA, 22 bp, Artificial Sequence
  chemically synthesized
tgtgatatcttagtatttatag

SEQ ID NO: 146650 - DNA, 22 bp, Artificial Sequence
  chemically synthesized
agtatttataggtcatgaggtt

SEQ ID NO: 146651 - DNA, 22 bp, Artificial Sequence
  chemically synthesized
gtatttataggtcatgaggttc

SEQ ID NO: 146652 - DNA, 22 bp, Artificial Sequence
  chemically synthesized
ataggtcatgaggttccttcct

SEQ ID NO: 146653 - DNA, 22 bp, Artificial Sequence
  chemically synthesized
taggtcatgaggttccttcctc

SEQ ID NO: 146654 - DNA, 22 bp, Artificial Sequence
  chemically synthesized
cttcctctgcctctgctatagt

SEQ ID NO: 146655 - DNA, 22 bp, Artificial Sequence
  chemically synthesized
cctctgcctctgctatagtttg

SEQ ID NO: 146656 - DNA, 22 bp, Artificial Sequence
  chemically synthesized
ctctgcctctgctatagtttga

SEQ ID NO: 146657 - DNA, 22 bp, Artificial Sequence
  chemically synthesized
tgcctctgctatagtttgatta

SEQ ID NO: 146658 - DNA, 22 bp, Artificial Sequence
  chemically synthesized
cctctgctatagtttgattagt

SEQ ID NO: 146659 - DNA, 22 bp, Artificial Sequence
  chemically synthesized
tgctatagtttgattagtcaac

SEQ ID NO: 146660 - DNA, 22 bp, Artificial Sequence
  chemically synthesized
ctatagtttgattagtcaacaa

SEQ ID NO: 146661 - DNA, 22 bp, Artificial Sequence
  chemically synthesized
tagtttgattagtcaacaagca

SEQ ID NO: 146662 - DNA, 22 bp, Artificial Sequence
  chemically synthesized
gattagtcaacaagcatgtgtc

SEQ ID NO: 146663 - DNA, 22 bp, Artificial Sequence
  chemically synthesized
attagtcaacaagcatgtgtca

SEQ ID NO: 146664 - DNA, 22 bp, Artificial Sequence
  chemically synthesized
gtcaacaagcatgtgtcatgca

SEQ ID NO: 146665 - DNA, 22 bp, Artificial Sequence
  chemically synthesized
attcacatcagaatttcataca

SEQ ID NO: 146666 - DNA, 22 bp, Artificial Sequence
  chemically synthesized
ttcacatcagaatttcatacac

SEQ ID NO: 146667 - DNA, 22 bp, Artificial Sequence
  chemically synthesized
acatcagaatttcatacactaa

SEQ ID NO: 146668 - DNA, 22 bp, Artificial Sequence
  chemically synthesized
catacactaataagacatagta

SEQ ID NO: 146669 - DNA, 22 bp, Artificial Sequence
  chemically synthesized
atacactaataagacatagtat

SEQ ID NO: 146670 - DNA, 22 bp, Artificial Sequence
  chemically synthesized
ataagacatagtatcagaagtc

SEQ ID NO: 146671 - DNA, 22 bp, Artificial Sequence
  chemically synthesized
attagttatatcagttagggtc

SEQ ID NO: 146672 - DNA, 22 bp, Artificial Sequence
  chemically synthesized
ttagttatatcagttagggtcc

SEQ ID NO: 146673 - DNA, 22 bp, Artificial Sequence
  chemically synthesized
gttatatcagttagggtccatc

SEQ ID NO: 146674 - DNA, 22 bp, Artificial Sequence
  chemically synthesized
tatcagttagggtccatcaagg

SEQ ID NO: 146675 - DNA, 22 bp, Artificial Sequence
  chemically synthesized
gggtccatcaaggaaaggacaa

SEQ ID NO: 146676 - DNA, 22 bp, Artificial Sequence
  chemically synthesized
tcagttactcaacctagaatta

SEQ ID NO: 146677 - DNA, 22 bp, Artificial Sequence
  chemically synthesized
ctcaacctagaattaaatacag

SEQ ID NO: 146678 - DNA, 22 bp, Artificial Sequence
  chemically synthesized
aacctagaattaaatacagctc

SEQ ID NO: 146679 - DNA, 22 bp, Artificial Sequence
  chemically synthesized
gaattaaatacagctcttaata

SEQ ID NO: 146680 - DNA, 22 bp, Artificial Sequence
  chemically synthesized
aatacagctcttaatagttaat

SEQ ID NO: 146681 - DNA, 22 bp, Artificial Sequence
  chemically synthesized
ttaatagttaattatccttgta

SEQ ID NO: 146682 - DNA, 22 bp, Artificial Sequence
  chemically synthesized
aatagttaattatccttgtatt

SEQ ID NO: 146683 - DNA, 22 bp, Artificial Sequence
  chemically synthesized
atagttaattatccttgtattg

SEQ ID NO: 146684 - DNA, 22 bp, Artificial Sequence
  chemically synthesized
attatccttgtattggaagagc

SEQ ID NO: 146685 - DNA, 22 bp, Artificial Sequence
  chemically synthesized
tccttgtattggaagagctaaa

SEQ ID NO: 146686 - DNA, 22 bp, Artificial Sequence
  chemically synthesized
gtattggaagagctaaaatatc

SEQ ID NO: 146687 - DNA, 22 bp, Artificial Sequence
  chemically synthesized
tattggaagagctaaaatatca

SEQ ID NO: 146688 - DNA, 22 bp, Artificial Sequence
  chemically synthesized
gaagagctaaaatatcaaataa

SEQ ID NO: 146689 - DNA, 22 bp, Artificial Sequence
  chemically synthesized
aaatatcaaataaaggacagtg

SEQ ID NO: 146690 - DNA, 22 bp, Artificial Sequence
  chemically synthesized
gatgttagtaacatcagaaaac

SEQ ID NO: 146691 - DNA, 22 bp, Artificial Sequence
  chemically synthesized
gtaacatcagaaaacctcttcc

SEQ ID NO: 146692 - DNA, 22 bp, Artificial Sequence
  chemically synthesized
ttccgccattaggcctagaagg

SEQ ID NO: 146693 - DNA, 22 bp, Artificial Sequence
  chemically synthesized
ccgccattaggcctagaagggc

SEQ ID NO: 146694 - DNA, 22 bp, Artificial Sequence
  chemically synthesized
cgccattaggcctagaagggca

SEQ ID NO: 146695 - DNA, 22 bp, Artificial Sequence
  chemically synthesized
ggcctagaagggcagaaggaga

SEQ ID NO: 146696 - DNA, 22 bp, Artificial Sequence
  chemically synthesized
gaagggcagaaggagaaaatgt

SEQ ID NO: 146697 - DNA, 22 bp, Artificial Sequence
  chemically synthesized
ataccaccagagtccagaacca

SEQ ID NO: 146698 - DNA, 22 bp, Artificial Sequence
  chemically synthesized
taccaccagagtccagaaccag

SEQ ID NO: 146699 - DNA, 22 bp, Artificial Sequence
  chemically synthesized
gattcagtgagctagtgggtgc

SEQ ID NO: 146700 - DNA, 22 bp, Artificial Sequence
  chemically synthesized
agtgagctagtgggtgctcctt

SEQ ID NO: 146701 - DNA, 22 bp, Artificial Sequence
  chemically synthesized
gtgggtgctccttggagagagc

SEQ ID NO: 146702 - DNA, 22 bp, Artificial Sequence
  chemically synthesized
cttggagagagccagaactgtc

SEQ ID NO: 146703 - DNA, 22 bp, Artificial Sequence
  chemically synthesized
ggagagagccagaactgtctaa

SEQ ID NO: 146704 - DNA, 22 bp, Artificial Sequence
  chemically synthesized
gagagagccagaactgtctaat

SEQ ID NO: 146705 - DNA, 22 bp, Artificial Sequence
  chemically synthesized
tctaatgggggcatcaaagtat

SEQ ID NO: 146706 - DNA, 22 bp, Artificial Sequence
  chemically synthesized
atgggggcatcaaagtatcagc

SEQ ID NO: 146707 - DNA, 22 bp, Artificial Sequence
  chemically synthesized
tctgctgtaggagatccgttca

SEQ ID NO: 146708 - DNA, 22 bp, Artificial Sequence
  chemically synthesized
ctgtaggagatccgttcagaga

SEQ ID NO: 146709 - DNA, 22 bp, Artificial Sequence
  chemically synthesized
taggagatccgttcagagagag

SEQ ID NO: 146710 - DNA, 22 bp, Artificial Sequence
  chemically synthesized
agagagagagagagaccagaaa

SEQ ID NO: 146711 - DNA, 22 bp, Artificial Sequence
  chemically synthesized
gcttatgctttccctcagccag

SEQ ID NO: 146712 - DNA, 22 bp, Artificial Sequence
  chemically synthesized
cttatgctttccctcagccagt

SEQ ID NO: 146713 - DNA, 22 bp, Artificial Sequence
  chemically synthesized
atgctttccctcagccagtgtt

SEQ ID NO: 146714 - DNA, 22 bp, Artificial Sequence
  chemically synthesized
tgctttccctcagccagtgttt

SEQ ID NO: 146715 - DNA, 22 bp, Artificial Sequence
  chemically synthesized
tccctcagccagtgtttaccat

SEQ ID NO: 146716 - DNA, 22 bp, Artificial Sequence
  chemically synthesized
ccctcagccagtgtttaccatt

SEQ ID NO: 146717 - DNA, 22 bp, Artificial Sequence
  chemically synthesized
cctcagccagtgtttaccattg

SEQ ID NO: 146718 - DNA, 22 bp, Artificial Sequence
  chemically synthesized
agccagtgtttaccattgcaga

SEQ ID NO: 146719 - DNA, 22 bp, Artificial Sequence
  chemically synthesized
accattgcagaatgtacatgcg

SEQ ID NO: 146720 - DNA, 22 bp, Artificial Sequence
  chemically synthesized
ccattgcagaatgtacatgcga

SEQ ID NO: 146721 - DNA, 22 bp, Artificial Sequence
  chemically synthesized
cagaatgtacatgcgactgaaa

SEQ ID NO: 146722 - DNA, 22 bp, Artificial Sequence
  chemically synthesized
aaagggtgaggaaacctgggaa

SEQ ID NO: 146723 - DNA, 22 bp, Artificial Sequence
  chemically synthesized
ggaaatgtcagttcctcaaata

SEQ ID NO: 146724 - DNA, 22 bp, Artificial Sequence
  chemically synthesized
ctcaaatacagagaacactgag

SEQ ID NO: 146725 - DNA, 22 bp, Artificial Sequence
  chemically synthesized
aaatacagagaacactgaggga

SEQ ID NO: 146726 - DNA, 22 bp, Artificial Sequence
  chemically synthesized
agggaaggatgagaaataaatg

SEQ ID NO: 146727 - DNA, 22 bp, Artificial Sequence
  chemically synthesized
acagaaggaaactaggatgtgt

SEQ ID NO: 146728 - DNA, 22 bp, Artificial Sequence
  chemically synthesized
ggatgtgtccagtaaatgaata

SEQ ID NO: 146729 - DNA, 22 bp, Artificial Sequence
  chemically synthesized
cagtgtgcagtgattattgcaa

SEQ ID NO: 146730 - DNA, 22 bp, Artificial Sequence
  chemically synthesized
ttgcaatgattaatgtattgat

SEQ ID NO: 146731 - DNA, 22 bp, Artificial Sequence
  chemically synthesized
caatgattaatgtattgataag

SEQ ID NO: 146732 - DNA, 22 bp, Artificial Sequence
  chemically synthesized
atgtattgataagataatatga

SEQ ID NO: 146733 - DNA, 22 bp, Artificial Sequence
  chemically synthesized
ataagataatatgaaaacacag

SEQ ID NO: 146734 - DNA, 22 bp, Artificial Sequence
  chemically synthesized
aaacagcagtgaactgagatta

SEQ ID NO: 146735 - DNA, 22 bp, Artificial Sequence
  chemically synthesized
agattagaattgtggagagcac

SEQ ID NO: 146736 - DNA, 22 bp, Artificial Sequence
  chemically synthesized
gaattgtggagagcactggcat

SEQ ID NO: 146737 - DNA, 22 bp, Artificial Sequence
  chemically synthesized
tggagagcactggcatttaaga

SEQ ID NO: 146738 - DNA, 22 bp, Artificial Sequence
  chemically synthesized
gcatttaagaatgtcacactta

SEQ ID NO: 146739 - DNA, 22 bp, Artificial Sequence
  chemically synthesized
aagaatgtcacacttagaatgt

SEQ ID NO: 146740 - DNA, 22 bp, Artificial Sequence
  chemically synthesized
agaatgtcacacttagaatgtg

SEQ ID NO: 146741 - DNA, 22 bp, Artificial Sequence
  chemically synthesized
agaatgtgtctctaggcattgt

SEQ ID NO: 146742 - DNA, 22 bp, Artificial Sequence
  chemically synthesized
gaatgtgtctctaggcattgtt

SEQ ID NO: 146743 - DNA, 22 bp, Artificial Sequence
  chemically synthesized
taggcattgttctgtgcatata

SEQ ID NO: 146744 - DNA, 22 bp, Artificial Sequence
  chemically synthesized
ggcattgttctgtgcatatatc

SEQ ID NO: 146745 - DNA, 22 bp, Artificial Sequence
  chemically synthesized
ttctgtgcatatatcatctcaa

SEQ ID NO: 146746 - DNA, 22 bp, Artificial Sequence
  chemically synthesized
tgtgcatatatcatctcaatat

SEQ ID NO: 146747 - DNA, 22 bp, Artificial Sequence
  chemically synthesized
tgcatatatcatctcaatattc

SEQ ID NO: 146748 - DNA, 22 bp, Artificial Sequence
  chemically synthesized
aatattcattatctgaaaatta

SEQ ID NO: 146749 - DNA, 22 bp, Artificial Sequence
  chemically synthesized
attatctgaaaattatgaatta

SEQ ID NO: 146750 - DNA, 22 bp, Artificial Sequence
  chemically synthesized
tctgaaaattatgaattaggta

SEQ ID NO: 146751 - DNA, 22 bp, Artificial Sequence
  chemically synthesized
aaaattatgaattaggtacaaa

SEQ ID NO: 146752 - DNA, 22 bp, Artificial Sequence
  chemically synthesized
tgaattaggtacaaagctcaaa

SEQ ID NO: 146753 - DNA, 22 bp, Artificial Sequence
  chemically synthesized
ggtacaaagctcaaataattta

SEQ ID NO: 146754 - DNA, 22 bp, Artificial Sequence
  chemically synthesized
aaataatttattttttcaggtt

SEQ ID NO: 146755 - DNA, 22 bp, Artificial Sequence
  chemically synthesized
attttttcaggttagcaagaac

SEQ ID NO: 146756 - DNA, 22 bp, Artificial Sequence
  chemically synthesized
ttttttcaggttagcaagaact

SEQ ID NO: 146757 - DNA, 22 bp, Artificial Sequence
  chemically synthesized
tttcaggttagcaagaactttt

SEQ ID NO: 146758 - DNA, 22 bp, Artificial Sequence
  chemically synthesized
ttcaggttagcaagaacttttt

SEQ ID NO: 146759 - DNA, 22 bp, Artificial Sequence
  chemically synthesized
tcaggttagcaagaactttttt

SEQ ID NO: 146760 - DNA, 22 bp, Artificial Sequence
  chemically synthesized
caggttagcaagaacttttttt

SEQ ID NO: 146761 - DNA, 22 bp, Artificial Sequence
  chemically synthesized
aggttagcaagaactttttttt

SEQ ID NO: 146762 - DNA, 22 bp, Artificial Sequence
  chemically synthesized
gcaagaactttttttttttttt

SEQ ID NO: 146763 - DNA, 22 bp, Artificial Sequence
  chemically synthesized
tttttttttttttctgagatag

SEQ ID NO: 146764 - DNA, 22 bp, Artificial Sequence
  chemically synthesized
ttttttttttttctgagataga

SEQ ID NO: 146765 - DNA, 22 bp, Artificial Sequence
  chemically synthesized
tttttttttttctgagatagag

SEQ ID NO: 146766 - DNA, 22 bp, Artificial Sequence
  chemically synthesized
ttttttttttctgagatagagc

SEQ ID NO: 146767 - DNA, 22 bp, Artificial Sequence
  chemically synthesized
tttttttttctgagatagagca

SEQ ID NO: 146768 - DNA, 22 bp, Artificial Sequence
  chemically synthesized
ttttttttctgagatagagcat

SEQ ID NO: 146769 - DNA, 22 bp, Artificial Sequence
  chemically synthesized
tttttttctgagatagagcatt

SEQ ID NO: 146770 - DNA, 22 bp, Artificial Sequence
  chemically synthesized
ttttttctgagatagagcattg

SEQ ID NO: 146771 - DNA, 22 bp, Artificial Sequence
  chemically synthesized
tttttctgagatagagcattgc

SEQ ID NO: 146772 - DNA, 22 bp, Artificial Sequence
  chemically synthesized
ttttctgagatagagcattgct

SEQ ID NO: 146773 - DNA, 22 bp, Artificial Sequence
  chemically synthesized
tttctgagatagagcattgcta

SEQ ID NO: 146774 - DNA, 22 bp, Artificial Sequence
  chemically synthesized
ttctgagatagagcattgctat

SEQ ID NO: 146775 - DNA, 22 bp, Artificial Sequence
  chemically synthesized
tctgagatagagcattgctatg

SEQ ID NO: 146776 - DNA, 22 bp, Artificial Sequence
  chemically synthesized
ctgagatagagcattgctatgg

SEQ ID NO: 146777 - DNA, 22 bp, Artificial Sequence
  chemically synthesized
tgagatagagcattgctatggt

SEQ ID NO: 146778 - DNA, 22 bp, Artificial Sequence
  chemically synthesized
agatagagcattgctatggttg

SEQ ID NO: 146779 - DNA, 22 bp, Artificial Sequence
  chemically synthesized
ctatggttgcccaggctggagt

SEQ ID NO: 146780 - DNA, 22 bp, Artificial Sequence
  chemically synthesized
tggttgcccaggctggagtgca

SEQ ID NO: 146781 - DNA, 22 bp, Artificial Sequence
  chemically synthesized
cccaggctggagtgcaatggca

SEQ ID NO: 146782 - DNA, 22 bp, Artificial Sequence
  chemically synthesized
gagtgcaatggcatgatccagg

SEQ ID NO: 146783 - DNA, 22 bp, Artificial Sequence
  chemically synthesized
actgcaacatctgcctcccagg

SEQ ID NO: 146784 - DNA, 22 bp, Artificial Sequence
  chemically synthesized
caacatctgcctcccaggttca

SEQ ID NO: 146785 - DNA, 22 bp, Artificial Sequence
  chemically synthesized
cctcccaggttcaagcgattct

SEQ ID NO: 146786 - DNA, 22 bp, Artificial Sequence
  chemically synthesized
ccaggttcaagcgattctcctg

SEQ ID NO: 146787 - DNA, 22 bp, Artificial Sequence
  chemically synthesized
aagcgattctcctgcctcagcc

SEQ ID NO: 146788 - DNA, 22 bp, Artificial Sequence
  chemically synthesized
tcctgcctcagcctcccaagta

SEQ ID NO: 146789 - DNA, 22 bp, Artificial Sequence
  chemically synthesized
ctgcctcagcctcccaagtagc

SEQ ID NO: 146790 - DNA, 22 bp, Artificial Sequence
  chemically synthesized
cctcagcctcccaagtagctgg

SEQ ID NO: 146791 - DNA, 22 bp, Artificial Sequence
  chemically synthesized
agcctcccaagtagctggcact

SEQ ID NO: 146792 - DNA, 22 bp, Artificial Sequence
  chemically synthesized
ccaagtagctggcactacaggc

SEQ ID NO: 146793 - DNA, 22 bp, Artificial Sequence
  chemically synthesized
gcactacaggcatgtgccacca

SEQ ID NO: 146794 - DNA, 22 bp, Artificial Sequence
  chemically synthesized
caggcatgtgccaccaccatgc

SEQ ID NO: 146795 - DNA, 22 bp, Artificial Sequence
  chemically synthesized
gctaattttctatttttagtag

SEQ ID NO: 146796 - DNA, 22 bp, Artificial Sequence
  chemically synthesized
attttctatttttagtagatag

SEQ ID NO: 146797 - DNA, 22 bp, Artificial Sequence
  chemically synthesized
tctatttttagtagataggggg

SEQ ID NO: 146798 - DNA, 22 bp, Artificial Sequence
  chemically synthesized
ctatttttagtagatagggggt

SEQ ID NO: 146799 - DNA, 22 bp, Artificial Sequence
  chemically synthesized
tatttttagtagatagggggtt

SEQ ID NO: 146800 - DNA, 22 bp, Artificial Sequence
  chemically synthesized
tttttagtagatagggggtttc

SEQ ID NO: 146801 - DNA, 22 bp, Artificial Sequence
  chemically synthesized
ttagtagatagggggtttcacc

SEQ ID NO: 146802 - DNA, 22 bp, Artificial Sequence
  chemically synthesized
tagtagatagggggtttcacca

SEQ ID NO: 146803 - DNA, 22 bp, Artificial Sequence
  chemically synthesized
agtagatagggggtttcaccat

SEQ ID NO: 146804 - DNA, 22 bp, Artificial Sequence
  chemically synthesized
gtagatagggggtttcaccatg

SEQ ID NO: 146805 - DNA, 22 bp, Artificial Sequence
  chemically synthesized
caccatgttggtcaggctgatc

SEQ ID NO: 146806 - DNA, 22 bp, Artificial Sequence
  chemically synthesized
accatgttggtcaggctgatct

SEQ ID NO: 146807 - DNA, 22 bp, Artificial Sequence
  chemically synthesized
gtcaggctgatctcgaactcct

SEQ ID NO: 146808 - DNA, 22 bp, Artificial Sequence
  chemically synthesized
atctcgaactcctaacatcagg

SEQ ID NO: 146809 - DNA, 22 bp, Artificial Sequence
  chemically synthesized
gaactcctaacatcaggtgatc

SEQ ID NO: 146810 - DNA, 22 bp, Artificial Sequence
  chemically synthesized
ctaacatcaggtgatccaccct

SEQ ID NO: 146811 - DNA, 22 bp, Artificial Sequence
  chemically synthesized
acatcaggtgatccaccctcct

SEQ ID NO: 146812 - DNA, 22 bp, Artificial Sequence
  chemically synthesized
ctcggcctctgaaagtgctggg

SEQ ID NO: 146813 - DNA, 22 bp, Artificial Sequence
  chemically synthesized
ggcctctgaaagtgctgggatc

SEQ ID NO: 146814 - DNA, 22 bp, Artificial Sequence
  chemically synthesized
tgaaagtgctgggatcacaggc

SEQ ID NO: 146815 - DNA, 22 bp, Artificial Sequence
  chemically synthesized
aaagtgctgggatcacaggcgt

SEQ ID NO: 146816 - DNA, 22 bp, Artificial Sequence
  chemically synthesized
ggatcacaggcgtgagccacca

SEQ ID NO: 146817 - DNA, 22 bp, Artificial Sequence
  chemically synthesized
tgtagaaggatataacccatat

SEQ ID NO: 146818 - DNA, 22 bp, Artificial Sequence
  chemically synthesized
gtagaaggatataacccatatt

SEQ ID NO: 146819 - DNA, 22 bp, Artificial Sequence
  chemically synthesized
tagaaggatataacccatattt

SEQ ID NO: 146820 - DNA, 22 bp, Artificial Sequence
  chemically synthesized
ctctgaccctagagtccttagt

SEQ ID NO: 146821 - DNA, 22 bp, Artificial Sequence
  chemically synthesized
tctgaccctagagtccttagta

SEQ ID NO: 146822 - DNA, 22 bp, Artificial Sequence
  chemically synthesized
tgaccctagagtccttagtata

SEQ ID NO: 146823 - DNA, 22 bp, Artificial Sequence
  chemically synthesized
accctagagtccttagtatacc

SEQ ID NO: 146824 - DNA, 22 bp, Artificial Sequence
  chemically synthesized
gagtccttagtatacctcccat

SEQ ID NO: 146825 - DNA, 22 bp, Artificial Sequence
  chemically synthesized
agtatacctcccataccatgtg

SEQ ID NO: 146826 - DNA, 22 bp, Artificial Sequence
  chemically synthesized
gtatacctcccataccatgtgg

SEQ ID NO: 146827 - DNA, 22 bp, Artificial Sequence
  chemically synthesized
ccataccatgtggctcatcctc

SEQ ID NO: 146828 - DNA, 22 bp, Artificial Sequence
  chemically synthesized
atcctccttacatacatttccc

SEQ ID NO: 146829 - DNA, 22 bp, Artificial Sequence
  chemically synthesized
cttacatacatttcccatcttt

SEQ ID NO: 146830 - DNA, 22 bp, Artificial Sequence
  chemically synthesized
acatacatttcccatctttcac

SEQ ID NO: 146831 - DNA, 22 bp, Artificial Sequence
  chemically synthesized
catacatttcccatctttcacc

SEQ ID NO: 146832 - DNA, 22 bp, Artificial Sequence
  chemically synthesized
cccatctttcaccctacctttt

SEQ ID NO: 146833 - DNA, 22 bp, Artificial Sequence
  chemically synthesized
ccatctttcaccctaccttttc

SEQ ID NO: 146834 - DNA, 22 bp, Artificial Sequence
  chemically synthesized
tcaccctaccttttcctttttg

SEQ ID NO: 146835 - DNA, 22 bp, Artificial Sequence
  chemically synthesized
caccctaccttttcctttttgt

SEQ ID NO: 146836 - DNA, 22 bp, Artificial Sequence
  chemically synthesized
accctaccttttcctttttgtt

SEQ ID NO: 146837 - DNA, 22 bp, Artificial Sequence
  chemically synthesized
ccttttcctttttgtttcagct

SEQ ID NO: 146838 - DNA, 22 bp, Artificial Sequence
  chemically synthesized
ttcctttttgtttcagcttttc

SEQ ID NO: 146839 - DNA, 22 bp, Artificial Sequence
  chemically synthesized
tcctttttgtttcagcttttca

SEQ ID NO: 146840 - DNA, 22 bp, Artificial Sequence
  chemically synthesized
cctttttgtttcagcttttcac

SEQ ID NO: 146841 - DNA, 22 bp, Artificial Sequence
  chemically synthesized
ctttttgtttcagcttttcact

SEQ ID NO: 146842 - DNA, 22 bp, Artificial Sequence
  chemically synthesized
tttgtttcagcttttcactgtg

SEQ ID NO: 146843 - DNA, 22 bp, Artificial Sequence
  chemically synthesized
ttgtttcagcttttcactgtgt

SEQ ID NO: 146844 - DNA, 22 bp, Artificial Sequence
  chemically synthesized
tgtttcagcttttcactgtgtc

SEQ ID NO: 146845 - DNA, 22 bp, Artificial Sequence
  chemically synthesized
gtttcagcttttcactgtgtca

SEQ ID NO: 146846 - DNA, 22 bp, Artificial Sequence
  chemically synthesized
tttcagcttttcactgtgtcaa

SEQ ID NO: 146847 - DNA, 22 bp, Artificial Sequence
  chemically synthesized
cagcttttcactgtgtcaaaat

SEQ ID NO: 146848 - DNA, 22 bp, Artificial Sequence
  chemically synthesized
agcttttcactgtgtcaaaatc

SEQ ID NO: 146849 - DNA, 22 bp, Artificial Sequence
  chemically synthesized
ttcactgtgtcaaaatctagaa

SEQ ID NO: 146850 - DNA, 22 bp, Artificial Sequence
  chemically synthesized
tcactgtgtcaaaatctagaac

SEQ ID NO: 146851 - DNA, 22 bp, Artificial Sequence
  chemically synthesized
cactgtgtcaaaatctagaacc

SEQ ID NO: 146852 - DNA, 22 bp, Artificial Sequence
  chemically synthesized
actgtgtcaaaatctagaacct

SEQ ID NO: 146853 - DNA, 22 bp, Artificial Sequence
  chemically synthesized
tgtcaaaatctagaaccttatc

SEQ ID NO: 146854 - DNA, 22 bp, Artificial Sequence
  chemically synthesized
gaaccttatctcctacctgctc

SEQ ID NO: 146855 - DNA, 22 bp, Artificial Sequence
  chemically synthesized
atctcctacctgctctgaaacc

SEQ ID NO: 146856 - DNA, 22 bp, Artificial Sequence
  chemically synthesized
tctcctacctgctctgaaacca

SEQ ID NO: 146857 - DNA, 22 bp, Artificial Sequence
  chemically synthesized
ctacctgctctgaaaccaacag

SEQ ID NO: 146858 - DNA, 22 bp, Artificial Sequence
  chemically synthesized
cctgctctgaaaccaacagcaa

SEQ ID NO: 146859 - DNA, 22 bp, Artificial Sequence
  chemically synthesized
ctctgaaaccaacagcaagttg

SEQ ID NO: 146860 - DNA, 22 bp, Artificial Sequence
  chemically synthesized
tgaaaccaacagcaagttgact

SEQ ID NO: 146861 - DNA, 22 bp, Artificial Sequence
  chemically synthesized
aaaccaacagcaagttgacttc

SEQ ID NO: 146862 - DNA, 22 bp, Artificial Sequence
  chemically synthesized
acttccattctaacccacattg

SEQ ID NO: 146863 - DNA, 22 bp, Artificial Sequence
  chemically synthesized
ccattctaacccacattggcat

SEQ ID NO: 146864 - DNA, 22 bp, Artificial Sequence
  chemically synthesized
cattctaacccacattggcatt

SEQ ID NO: 146865 - DNA, 22 bp, Artificial Sequence
  chemically synthesized
taacccacattggcattacact

SEQ ID NO: 146866 - DNA, 22 bp, Artificial Sequence
  chemically synthesized
acccacattggcattacactaa

SEQ ID NO: 146867 - DNA, 22 bp, Artificial Sequence
  chemically synthesized
gcattacactaattaaaatcga

SEQ ID NO: 146868 - DNA, 22 bp, Artificial Sequence
  chemically synthesized
cactaattaaaatcgatactga

SEQ ID NO: 146869 - DNA, 22 bp, Artificial Sequence
  chemically synthesized
attaaaatcgatactgagttct

SEQ ID NO: 146870 - DNA, 22 bp, Artificial Sequence
  chemically synthesized
aaatcgatactgagttctaaaa

SEQ ID NO: 146871 - DNA, 22 bp, Artificial Sequence
  chemically synthesized
agttctaaaatcatcggggatt

SEQ ID NO: 146872 - DNA, 22 bp, Artificial Sequence
  chemically synthesized
taaaatcatcggggattttggg

SEQ ID NO: 146873 - DNA, 22 bp, Artificial Sequence
  chemically synthesized
aaatcatcggggattttgggga

SEQ ID NO: 146874 - DNA, 22 bp, Artificial Sequence
  chemically synthesized
tggggactatgtcttacttcat

SEQ ID NO: 146875 - DNA, 22 bp, Artificial Sequence
  chemically synthesized
ggggactatgtcttacttcata

SEQ ID NO: 146876 - DNA, 22 bp, Artificial Sequence
  chemically synthesized
gggactatgtcttacttcatac

SEQ ID NO: 146877 - DNA, 22 bp, Artificial Sequence
  chemically synthesized
tgtcttacttcatacttccttg

SEQ ID NO: 146878 - DNA, 22 bp, Artificial Sequence
  chemically synthesized
acttcatacttccttgagattt

SEQ ID NO: 146879 - DNA, 22 bp, Artificial Sequence
  chemically synthesized
cttcatacttccttgagatttc

SEQ ID NO: 146880 - DNA, 22 bp, Artificial Sequence
  chemically synthesized
catacttccttgagatttcaca

SEQ ID NO: 146881 - DNA, 22 bp, Artificial Sequence
  chemically synthesized
atacttccttgagatttcacat

SEQ ID NO: 146882 - DNA, 22 bp, Artificial Sequence
  chemically synthesized
ccttgagatttcacattaaatg

SEQ ID NO: 146883 - DNA, 22 bp, Artificial Sequence
  chemically synthesized
cttgagatttcacattaaatgt

SEQ ID NO: 146884 - DNA, 22 bp, Artificial Sequence
  chemically synthesized
gagatttcacattaaatgttgg

SEQ ID NO: 146885 - DNA, 22 bp, Artificial Sequence
  chemically synthesized
agatttcacattaaatgttggt

SEQ ID NO: 146886 - DNA, 22 bp, Artificial Sequence
  chemically synthesized
cacattaaatgttggtgttcat

SEQ ID NO: 146887 - DNA, 22 bp, Artificial Sequence
  chemically synthesized
acattaaatgttggtgttcatt

SEQ ID NO: 146888 - DNA, 22 bp, Artificial Sequence
  chemically synthesized
aatgttggtgttcattaaaggt

SEQ ID NO: 146889 - DNA, 22 bp, Artificial Sequence
  chemically synthesized
gtgttcattaaaggtccttcat

SEQ ID NO: 146890 - DNA, 22 bp, Artificial Sequence
  chemically synthesized
attaaaggtccttcatttaact

SEQ ID NO: 146891 - DNA, 22 bp, Artificial Sequence
  chemically synthesized
aaggtccttcatttaactttgt

SEQ ID NO: 146892 - DNA, 22 bp, Artificial Sequence
  chemically synthesized
catttaactttgtattcatcac

SEQ ID NO: 146893 - DNA, 22 bp, Artificial Sequence
  chemically synthesized
atttaactttgtattcatcaca

SEQ ID NO: 146894 - DNA, 22 bp, Artificial Sequence
  chemically synthesized
aactttgtattcatcacactct

SEQ ID NO: 146895 - DNA, 22 bp, Artificial Sequence
  chemically synthesized
actttgtattcatcacactctt

SEQ ID NO: 146896 - DNA, 22 bp, Artificial Sequence
  chemically synthesized
tgtattcatcacactcttggat

SEQ ID NO: 146897 - DNA, 22 bp, Artificial Sequence
  chemically synthesized
gtattcatcacactcttggatt

SEQ ID NO: 146898 - DNA, 22 bp, Artificial Sequence
  chemically synthesized
tattcatcacactcttggattc

SEQ ID NO: 146899 - DNA, 22 bp, Artificial Sequence
  chemically synthesized
atcacactcttggattcacagt

SEQ ID NO: 146900 - DNA, 22 bp, Artificial Sequence
  chemically synthesized
ttggattcacagttatatctaa

SEQ ID NO: 146901 - DNA, 22 bp, Artificial Sequence
  chemically synthesized
ggattcacagttatatctaaac

SEQ ID NO: 146902 - DNA, 22 bp, Artificial Sequence
  chemically synthesized
gattcacagttatatctaaact

SEQ ID NO: 146903 - DNA, 22 bp, Artificial Sequence
  chemically synthesized
acagttatatctaaactcttaa

SEQ ID NO: 146904 - DNA, 22 bp, Artificial Sequence
  chemically synthesized
tatctaaactcttaaatacagc

SEQ ID NO: 146905 - DNA, 22 bp, Artificial Sequence
  chemically synthesized
aactcttaaatacagcctgtat

SEQ ID NO: 146906 - DNA, 22 bp, Artificial Sequence
  chemically synthesized
ttaaatacagcctgtataatcc

SEQ ID NO: 146907 - DNA, 22 bp, Artificial Sequence
  chemically synthesized
aaatacagcctgtataatccca

SEQ ID NO: 146908 - DNA, 22 bp, Artificial Sequence
  chemically synthesized
aatacagcctgtataatcccaa

SEQ ID NO: 146909 - DNA, 22 bp, Artificial Sequence
  chemically synthesized
tataatcccaattcccaactct

SEQ ID NO: 146910 - DNA, 22 bp, Artificial Sequence
  chemically synthesized
ccaactctgatttctaacctct

SEQ ID NO: 146911 - DNA, 22 bp, Artificial Sequence
  chemically synthesized
tgatttctaacctctgacctcc

SEQ ID NO: 146912 - DNA, 22 bp, Artificial Sequence
  chemically synthesized
atttctaacctctgacctccaa

SEQ ID NO: 146913 - DNA, 22 bp, Artificial Sequence
  chemically synthesized
ctaacctctgacctccaacctc

SEQ ID NO: 146914 - DNA, 22 bp, Artificial Sequence
  chemically synthesized
taacctctgacctccaacctca

SEQ ID NO: 146915 - DNA, 22 bp, Artificial Sequence
  chemically synthesized
acctctgacctccaacctcagt

SEQ ID NO: 146916 - DNA, 22 bp, Artificial Sequence
  chemically synthesized
tgacctccaacctcagtgccaa

SEQ ID NO: 146917 - DNA, 22 bp, Artificial Sequence
  chemically synthesized
acctccaacctcagtgccaaac

SEQ ID NO: 146918 - DNA, 22 bp, Artificial Sequence
  chemically synthesized
caacctcagtgccaaacccata

SEQ ID NO: 146919 - DNA, 22 bp, Artificial Sequence
  chemically synthesized
agtgccaaacccatatatcaaa

SEQ ID NO: 146920 - DNA, 22 bp, Artificial Sequence
  chemically synthesized
ggcttatttatatagatgtcct

SEQ ID NO: 146921 - DNA, 22 bp, Artificial Sequence
  chemically synthesized
atttatatagatgtcctatagg

SEQ ID NO: 146922 - DNA, 22 bp, Artificial Sequence
  chemically synthesized
tttatatagatgtcctataggc

SEQ ID NO: 146923 - DNA, 22 bp, Artificial Sequence
  chemically synthesized
atatagatgtcctataggcacc

SEQ ID NO: 146924 - DNA, 22 bp, Artificial Sequence
  chemically synthesized
tatagatgtcctataggcacct

SEQ ID NO: 146925 - DNA, 22 bp, Artificial Sequence
  chemically synthesized
taggcacctcagactcagcatg

SEQ ID NO: 146926 - DNA, 22 bp, Artificial Sequence
  chemically synthesized
agactcagcatgggtatttcac

SEQ ID NO: 146927 - DNA, 22 bp, Artificial Sequence
  chemically synthesized
agcatgggtatttcacttgtta

SEQ ID NO: 146928 - DNA, 22 bp, Artificial Sequence
  chemically synthesized
cacttgttatactaaaactgtt

SEQ ID NO: 146929 - DNA, 22 bp, Artificial Sequence
  chemically synthesized
acttgttatactaaaactgttt

SEQ ID NO: 146930 - DNA, 22 bp, Artificial Sequence
  chemically synthesized
gttatactaaaactgtttctct

SEQ ID NO: 146931 - DNA, 22 bp, Artificial Sequence
  chemically synthesized
ttatactaaaactgtttctctt

SEQ ID NO: 146932 - DNA, 22 bp, Artificial Sequence
  chemically synthesized
tactaaaactgtttctcttcca

SEQ ID NO: 146933 - DNA, 22 bp, Artificial Sequence
  chemically synthesized
aaactgtttctcttccagtgtt

SEQ ID NO: 146934 - DNA, 22 bp, Artificial Sequence
  chemically synthesized
tttctcttccagtgttttccat

SEQ ID NO: 146935 - DNA, 22 bp, Artificial Sequence
  chemically synthesized
ctcttccagtgttttccatttt

SEQ ID NO: 146936 - DNA, 22 bp, Artificial Sequence
  chemically synthesized
tcttccagtgttttccatttta

SEQ ID NO: 146937 - DNA, 22 bp, Artificial Sequence
  chemically synthesized
ttccagtgttttccattttagt

SEQ ID NO: 146938 - DNA, 22 bp, Artificial Sequence
  chemically synthesized
ccagtgttttccattttagtca

SEQ ID NO: 146939 - DNA, 22 bp, Artificial Sequence
  chemically synthesized
cagtgttttccattttagtcat

SEQ ID NO: 146940 - DNA, 22 bp, Artificial Sequence
  chemically synthesized
tccattttagtcattagatagc

SEQ ID NO: 146941 - DNA, 22 bp, Artificial Sequence
  chemically synthesized
ccattttagtcattagatagct

SEQ ID NO: 146942 - DNA, 22 bp, Artificial Sequence
  chemically synthesized
cattttagtcattagatagcta

SEQ ID NO: 146943 - DNA, 22 bp, Artificial Sequence
  chemically synthesized
tagtcattagatagctacttgc

SEQ ID NO: 146944 - DNA, 22 bp, Artificial Sequence
  chemically synthesized
agtcattagatagctacttgcc

SEQ ID NO: 146945 - DNA, 22 bp, Artificial Sequence
  chemically synthesized
gtcattagatagctacttgccc

SEQ ID NO: 146946 - DNA, 22 bp, Artificial Sequence
  chemically synthesized
gatagctacttgcccattcacc

SEQ ID NO: 146947 - DNA, 22 bp, Artificial Sequence
  chemically synthesized
cttgcccattcaccaaggtcac

SEQ ID NO: 146948 - DNA, 22 bp, Artificial Sequence
  chemically synthesized
gcccattcaccaaggtcacaga

SEQ ID NO: 146949 - DNA, 22 bp, Artificial Sequence
  chemically synthesized
cccattcaccaaggtcacagat

SEQ ID NO: 146950 - DNA, 22 bp, Artificial Sequence
  chemically synthesized
accaaggtcacagattaaaatc

SEQ ID NO: 146951 - DNA, 22 bp, Artificial Sequence
  chemically synthesized
aaatcatttccctacctctaat

SEQ ID NO: 146952 - DNA, 22 bp, Artificial Sequence
  chemically synthesized
ccctacctctaatcaacagttc

SEQ ID NO: 146953 - DNA, 22 bp, Artificial Sequence
  chemically synthesized
cctacctctaatcaacagttcg

SEQ ID NO: 146954 - DNA, 22 bp, Artificial Sequence
  chemically synthesized
cctctaatcaacagttcgattc

SEQ ID NO: 146955 - DNA, 22 bp, Artificial Sequence
  chemically synthesized
taatcaacagttcgattctgct

SEQ ID NO: 146956 - DNA, 22 bp, Artificial Sequence
  chemically synthesized
atcaacagttcgattctgcttc

SEQ ID NO: 146957 - DNA, 22 bp, Artificial Sequence
  chemically synthesized
gattctgcttcaatttgtccct

SEQ ID NO: 146958 - DNA, 22 bp, Artificial Sequence
  chemically synthesized
tgcttcaatttgtccctatcta

SEQ ID NO: 146959 - DNA, 22 bp, Artificial Sequence
  chemically synthesized
cttcaatttgtccctatctatt

SEQ ID NO: 146960 - DNA, 22 bp, Artificial Sequence
  chemically synthesized
caatttgtccctatctattaat

SEQ ID NO: 146961 - DNA, 22 bp, Artificial Sequence
  chemically synthesized
aatttgtccctatctattaatc

SEQ ID NO: 146962 - DNA, 22 bp, Artificial Sequence
  chemically synthesized
gtccctatctattaatcaccac

SEQ ID NO: 146963 - DNA, 22 bp, Artificial Sequence
  chemically synthesized
tccctatctattaatcaccact

SEQ ID NO: 146964 - DNA, 22 bp, Artificial Sequence
  chemically synthesized
tctattaatcaccactcttact

SEQ ID NO: 146965 - DNA, 22 bp, Artificial Sequence
  chemically synthesized
ttaatcaccactcttactgccc

SEQ ID NO: 146966 - DNA, 22 bp, Artificial Sequence
  chemically synthesized
atcaccactcttactgcccagt

SEQ ID NO: 146967 - DNA, 22 bp, Artificial Sequence
  chemically synthesized
ttactgcccagtcaggtcctca

SEQ ID NO: 146968 - DNA, 22 bp, Artificial Sequence
  chemically synthesized
actgcccagtcaggtcctcatt

SEQ ID NO: 146969 - DNA, 22 bp, Artificial Sequence
  chemically synthesized
ctgcccagtcaggtcctcattg

SEQ ID NO: 146970 - DNA, 22 bp, Artificial Sequence
  chemically synthesized
cccagtcaggtcctcattgttt

SEQ ID NO: 146971 - DNA, 22 bp, Artificial Sequence
  chemically synthesized
attgtttcctgaacaagagtag

SEQ ID NO: 146972 - DNA, 22 bp, Artificial Sequence
  chemically synthesized
tttcctgaacaagagtagatgc

SEQ ID NO: 146973 - DNA, 22 bp, Artificial Sequence
  chemically synthesized
cctgaacaagagtagatgctat

SEQ ID NO: 146974 - DNA, 22 bp, Artificial Sequence
  chemically synthesized
ctgaacaagagtagatgctatt

SEQ ID NO: 146975 - DNA, 22 bp, Artificial Sequence
  chemically synthesized
aacaagagtagatgctattctt

SEQ ID NO: 146976 - DNA, 22 bp, Artificial Sequence
  chemically synthesized
ttctttccacttttagacctta

SEQ ID NO: 146977 - DNA, 22 bp, Artificial Sequence
  chemically synthesized
tttccacttttagaccttatcc

SEQ ID NO: 146978 - DNA, 22 bp, Artificial Sequence
  chemically synthesized
tccacttttagaccttatcctg

SEQ ID NO: 146979 - DNA, 22 bp, Artificial Sequence
  chemically synthesized
ccacttttagaccttatcctgg

SEQ ID NO: 146980 - DNA, 22 bp, Artificial Sequence
  chemically synthesized
cacttttagaccttatcctggc

SEQ ID NO: 146981 - DNA, 22 bp, Artificial Sequence
  chemically synthesized
ttagaccttatcctggctggat

SEQ ID NO: 146982 - DNA, 22 bp, Artificial Sequence
  chemically synthesized
tagaccttatcctggctggatg

SEQ ID NO: 146983 - DNA, 22 bp, Artificial Sequence
  chemically synthesized
agaccttatcctggctggatgc

SEQ ID NO: 146984 - DNA, 22 bp, Artificial Sequence
  chemically synthesized
gaccttatcctggctggatgcg

SEQ ID NO: 146985 - DNA, 22 bp, Artificial Sequence
  chemically synthesized
atcctggctggatgcggtggct

SEQ ID NO: 146986 - DNA, 22 bp, Artificial Sequence
  chemically synthesized
tcctggctggatgcggtggctc

SEQ ID NO: 146987 - DNA, 22 bp, Artificial Sequence
  chemically synthesized
gctggatgcggtggctcaggct

SEQ ID NO: 146988 - DNA, 22 bp, Artificial Sequence
  chemically synthesized
gatgcggtggctcaggcttgta

SEQ ID NO: 146989 - DNA, 22 bp, Artificial Sequence
  chemically synthesized
aggcttgtaaacccagcacttt

SEQ ID NO: 146990 - DNA, 22 bp, Artificial Sequence
  chemically synthesized
gtaaacccagcactttgggagg

SEQ ID NO: 146991 - DNA, 22 bp, Artificial Sequence
  chemically synthesized
taaacccagcactttgggaggc

SEQ ID NO: 146992 - DNA, 22 bp, Artificial Sequence
  chemically synthesized
tgggaggccaaggcaggcagat

SEQ ID NO: 146993 - DNA, 22 bp, Artificial Sequence
  chemically synthesized
gggaggccaaggcaggcagatc

SEQ ID NO: 146994 - DNA, 22 bp, Artificial Sequence
  chemically synthesized
ggaggccaaggcaggcagatca

SEQ ID NO: 146995 - DNA, 22 bp, Artificial Sequence
  chemically synthesized
gaggtcaggagttcaagaccag

SEQ ID NO: 146996 - DNA, 22 bp, Artificial Sequence
  chemically synthesized
aggtcaggagttcaagaccagc

SEQ ID NO: 146997 - DNA, 22 bp, Artificial Sequence
  chemically synthesized
aagaccagcctgaccaacatgg

SEQ ID NO: 146998 - DNA, 22 bp, Artificial Sequence
  chemically synthesized
accaacatggtgaaaccccatc

SEQ ID NO: 146999 - DNA, 22 bp, Artificial Sequence
  chemically synthesized
tactaaaaatacaaaatcagcc

SEQ ID NO: 147000 - DNA, 22 bp, Artificial Sequence
  chemically synthesized
ctaaaaatacaaaatcagccgg

SEQ ID NO: 147001 - DNA, 22 bp, Artificial Sequence
  chemically synthesized
aaaatacaaaatcagccgggcg

SEQ ID NO: 147002 - DNA, 22 bp, Artificial Sequence
  chemically synthesized
cagtcccagctattcaggtggc

SEQ ID NO: 147003 - DNA, 22 bp, Artificial Sequence
  chemically synthesized
ttcaggtggctgaggcaggaga

SEQ ID NO: 147004 - DNA, 22 bp, Artificial Sequence
  chemically synthesized
aggtggctgaggcaggagaatt

SEQ ID NO: 147005 - DNA, 22 bp, Artificial Sequence
  chemically synthesized
aggcaggagaattgcttgaacc

SEQ ID NO: 147006 - DNA, 22 bp, Artificial Sequence
  chemically synthesized
cttgaacccaggaggcagaggt

SEQ ID NO: 147007 - DNA, 22 bp, Artificial Sequence
  chemically synthesized
gaacccaggaggcagaggttgc

SEQ ID NO: 147008 - DNA, 22 bp, Artificial Sequence
  chemically synthesized
aacccaggaggcagaggttgcg

SEQ ID NO: 147009 - DNA, 22 bp, Artificial Sequence
  chemically synthesized
cggtgagcctagattgcaccat

SEQ ID NO: 147010 - DNA, 22 bp, Artificial Sequence
  chemically synthesized
gattgcaccattgcactctagc

SEQ ID NO: 147011 - DNA, 22 bp, Artificial Sequence
  chemically synthesized
caccattgcactctagcttggg

SEQ ID NO: 147012 - DNA, 22 bp, Artificial Sequence
  chemically synthesized
cactctagcttgggcaataggg

SEQ ID NO: 147013 - DNA, 22 bp, Artificial Sequence
  chemically synthesized
tagcttgggcaatagggatgaa

SEQ ID NO: 147014 - DNA, 22 bp, Artificial Sequence
  chemically synthesized
gcttgggcaatagggatgaaac

SEQ ID NO: 147015 - DNA, 22 bp, Artificial Sequence
  chemically synthesized
gggcaatagggatgaaactcca

SEQ ID NO: 147016 - DNA, 22 bp, Artificial Sequence
  chemically synthesized
ggcaatagggatgaaactccat

SEQ ID NO: 147017 - DNA, 22 bp, Artificial Sequence
  chemically synthesized
catctcagaagagaaaagaaaa

SEQ ID NO: 147018 - DNA, 22 bp, Artificial Sequence
  chemically synthesized
agaagagaaaagaaaaaaagac

SEQ ID NO: 147019 - DNA, 22 bp, Artificial Sequence
  chemically synthesized
attctgttatacaaatcctctc

SEQ ID NO: 147020 - DNA, 22 bp, Artificial Sequence
  chemically synthesized
ttctgttatacaaatcctctca

SEQ ID NO: 147021 - DNA, 22 bp, Artificial Sequence
  chemically synthesized
tgttatacaaatcctctcaatg

SEQ ID NO: 147022 - DNA, 22 bp, Artificial Sequence
  chemically synthesized
ttatacaaatcctctcaatgca

SEQ ID NO: 147023 - DNA, 22 bp, Artificial Sequence
  chemically synthesized
tacaaatcctctcaatgcaatc

SEQ ID NO: 147024 - DNA, 22 bp, Artificial Sequence
  chemically synthesized
tcaatgcaatccatatagaata

SEQ ID NO: 147025 - DNA, 22 bp, Artificial Sequence
  chemically synthesized
aatgcaatccatatagaataaa

SEQ ID NO: 147026 - DNA, 22 bp, Artificial Sequence
  chemically synthesized
ccaatgtgtaaaatcatttcag

SEQ ID NO: 147027 - DNA, 22 bp, Artificial Sequence
  chemically synthesized
caggtagaacagaattaaagtg

SEQ ID NO: 147028 - DNA, 22 bp, Artificial Sequence
  chemically synthesized
aggtagaacagaattaaagtga

SEQ ID NO: 147029 - DNA, 22 bp, Artificial Sequence
  chemically synthesized
aagtgaaaagccaagtctttgg

SEQ ID NO: 147030 - DNA, 22 bp, Artificial Sequence
  chemically synthesized
tggaattaacagacaaagatca

SEQ ID NO: 147031 - DNA, 22 bp, Artificial Sequence
  chemically synthesized
ggaattaacagacaaagatcaa

SEQ ID NO: 147032 - DNA, 22 bp, Artificial Sequence
  chemically synthesized
gaattaacagacaaagatcaaa

SEQ ID NO: 147033 - DNA, 22 bp, Artificial Sequence
  chemically synthesized
acagacaaagatcaaataacag

SEQ ID NO: 147034 - DNA, 22 bp, Artificial Sequence
  chemically synthesized
atggccttaagaatttacctaa

SEQ ID NO: 147035 - DNA, 22 bp, Artificial Sequence
  chemically synthesized
aagaatttacctaacatttttt

SEQ ID NO: 147036 - DNA, 22 bp, Artificial Sequence
  chemically synthesized
agaatttacctaacattttttt

SEQ ID NO: 147037 - DNA, 22 bp, Artificial Sequence
  chemically synthesized
acctaacattttttttagaatc

SEQ ID NO: 147038 - DNA, 22 bp, Artificial Sequence
  chemically synthesized
cctaacattttttttagaatca

SEQ ID NO: 147039 - DNA, 22 bp, Artificial Sequence
  chemically synthesized
acattttttttagaatcaattt

SEQ ID NO: 147040 - DNA, 22 bp, Artificial Sequence
  chemically synthesized
tttttagaatcaattttcttat

SEQ ID NO: 147041 - DNA, 22 bp, Artificial Sequence
  chemically synthesized
ttttagaatcaattttcttata

SEQ ID NO: 147042 - DNA, 22 bp, Artificial Sequence
  chemically synthesized
tttagaatcaattttcttatat

SEQ ID NO: 147043 - DNA, 22 bp, Artificial Sequence
  chemically synthesized
ttagaatcaattttcttatata

SEQ ID NO: 147044 - DNA, 22 bp, Artificial Sequence
  chemically synthesized
tagaatcaattttcttatatat

SEQ ID NO: 147045 - DNA, 22 bp, Artificial Sequence
  chemically synthesized
agaatcaattttcttatatatg

SEQ ID NO: 147046 - DNA, 22 bp, Artificial Sequence
  chemically synthesized
gaatcaattttcttatatatga

SEQ ID NO: 147047 - DNA, 22 bp, Artificial Sequence
  chemically synthesized
tcttatatatgaattggaaaca

SEQ ID NO: 147048 - DNA, 22 bp, Artificial Sequence
  chemically synthesized
cttatatatgaattggaaacat

SEQ ID NO: 147049 - DNA, 22 bp, Artificial Sequence
  chemically synthesized
ttatatatgaattggaaacata

SEQ ID NO: 147050 - DNA, 22 bp, Artificial Sequence
  chemically synthesized
atatatgaattggaaacataat

SEQ ID NO: 147051 - DNA, 22 bp, Artificial Sequence
  chemically synthesized
tatatgaattggaaacataatt

SEQ ID NO: 147052 - DNA, 22 bp, Artificial Sequence
  chemically synthesized
gaaacataattcctccctcaca

SEQ ID NO: 147053 - DNA, 22 bp, Artificial Sequence
  chemically synthesized
ctccctcacaaacacattctaa

SEQ ID NO: 147054 - DNA, 22 bp, Artificial Sequence
  chemically synthesized
cctcacaaacacattctaagat

SEQ ID NO: 147055 - DNA, 22 bp, Artificial Sequence
  chemically synthesized
acaaacacattctaagatttta

SEQ ID NO: 147056 - DNA, 22 bp, Artificial Sequence
  chemically synthesized
taagattttaaggagatattga

SEQ ID NO: 147057 - DNA, 22 bp, Artificial Sequence
  chemically synthesized
agattttaaggagatattgatg

SEQ ID NO: 147058 - DNA, 22 bp, Artificial Sequence
  chemically synthesized
taaggagatattgatgaagtac

SEQ ID NO: 147059 - DNA, 22 bp, Artificial Sequence
  chemically synthesized
aaggagatattgatgaagtaca

SEQ ID NO: 147060 - DNA, 22 bp, Artificial Sequence
  chemically synthesized
aggagatattgatgaagtacat

SEQ ID NO: 147061 - DNA, 22 bp, Artificial Sequence
  chemically synthesized
atgaagtacatcatctgtcatt

SEQ ID NO: 147062 - DNA, 22 bp, Artificial Sequence
  chemically synthesized
tcatttttaacaggtagtggta

SEQ ID NO: 147063 - DNA, 22 bp, Artificial Sequence
  chemically synthesized
ttaacaggtagtggtagtgatt

SEQ ID NO: 147064 - DNA, 22 bp, Artificial Sequence
  chemically synthesized
taacaggtagtggtagtgattc

SEQ ID NO: 147065 - DNA, 22 bp, Artificial Sequence
  chemically synthesized
aacaggtagtggtagtgattca

SEQ ID NO: 147066 - DNA, 22 bp, Artificial Sequence
  chemically synthesized
acaggtagtggtagtgattcac

SEQ ID NO: 147067 - DNA, 22 bp, Artificial Sequence
  chemically synthesized
acacagcacattatgatctgtt

SEQ ID NO: 147068 - DNA, 22 bp, Artificial Sequence
  chemically synthesized
tgatctgttcttgtatgttctg

SEQ ID NO: 147069 - DNA, 22 bp, Artificial Sequence
  chemically synthesized
ttcttgtatgttctgttccatt

SEQ ID NO: 147070 - DNA, 22 bp, Artificial Sequence
  chemically synthesized
ttgtatgttctgttccattctg

SEQ ID NO: 147071 - DNA, 22 bp, Artificial Sequence
  chemically synthesized
gtatgttctgttccattctgta

SEQ ID NO: 147072 - DNA, 22 bp, Artificial Sequence
  chemically synthesized
tatgttctgttccattctgtat

SEQ ID NO: 147073 - DNA, 22 bp, Artificial Sequence
  chemically synthesized
tgttccattctgtattcttgac

SEQ ID NO: 147074 - DNA, 22 bp, Artificial Sequence
  chemically synthesized
ttccattctgtattcttgacct

SEQ ID NO: 147075 - DNA, 22 bp, Artificial Sequence
  chemically synthesized
cattctgtattcttgacctggt

SEQ ID NO: 147076 - DNA, 22 bp, Artificial Sequence
  chemically synthesized
tgtattcttgacctggttgtat

SEQ ID NO: 147077 - DNA, 22 bp, Artificial Sequence
  chemically synthesized
tattcttgacctggttgtattc

SEQ ID NO: 147078 - DNA, 22 bp, Artificial Sequence
  chemically synthesized
ttgacctggttgtattctttct

SEQ ID NO: 147079 - DNA, 22 bp, Artificial Sequence
  chemically synthesized
gacctggttgtattctttctga

SEQ ID NO: 147080 - DNA, 22 bp, Artificial Sequence
  chemically synthesized
acctggttgtattctttctgag

SEQ ID NO: 147081 - DNA, 22 bp, Artificial Sequence
  chemically synthesized
gttgtattctttctgagctcca

SEQ ID NO: 147082 - DNA, 22 bp, Artificial Sequence
  chemically synthesized
tattctttctgagctccagatc

SEQ ID NO: 147083 - DNA, 22 bp, Artificial Sequence
  chemically synthesized
tttctgagctccagatccacat

SEQ ID NO: 147084 - DNA, 22 bp, Artificial Sequence
  chemically synthesized
tctgagctccagatccacatat

SEQ ID NO: 147085 - DNA, 22 bp, Artificial Sequence
  chemically synthesized
ctgagctccagatccacatatc

SEQ ID NO: 147086 - DNA, 22 bp, Artificial Sequence
  chemically synthesized
tgagctccagatccacatatct

SEQ ID NO: 147087 - DNA, 22 bp, Artificial Sequence
  chemically synthesized
agctccagatccacatatctaa

SEQ ID NO: 147088 - DNA, 22 bp, Artificial Sequence
  chemically synthesized
cagatccacatatctaagtaca

SEQ ID NO: 147089 - DNA, 22 bp, Artificial Sequence
  chemically synthesized
agtacatctttttgcattttac

SEQ ID NO: 147090 - DNA, 22 bp, Artificial Sequence
  chemically synthesized
tttgcattttacaagagtgcat

SEQ ID NO: 147091 - DNA, 22 bp, Artificial Sequence
  chemically synthesized
ttgcattttacaagagtgcata

SEQ ID NO: 147092 - DNA, 22 bp, Artificial Sequence
  chemically synthesized
tgcattttacaagagtgcatac

SEQ ID NO: 147093 - DNA, 22 bp, Artificial Sequence
  chemically synthesized
gcattttacaagagtgcataca

SEQ ID NO: 147094 - DNA, 22 bp, Artificial Sequence
  chemically synthesized
cattttacaagagtgcatacaa

SEQ ID NO: 147095 - DNA, 22 bp, Artificial Sequence
  chemically synthesized
tacaagagtgcatacaatacaa

SEQ ID NO: 147096 - DNA, 22 bp, Artificial Sequence
  chemically synthesized
acaagagtgcatacaatacaat

SEQ ID NO: 147097 - DNA, 22 bp, Artificial Sequence
  chemically synthesized
caagagtgcatacaatacaatg

SEQ ID NO: 147098 - DNA, 22 bp, Artificial Sequence
  chemically synthesized
tatttctgattttatcgtacca

SEQ ID NO: 147099 - DNA, 22 bp, Artificial Sequence
  chemically synthesized
ctgattttatcgtaccactaaa

SEQ ID NO: 147100 - DNA, 22 bp, Artificial Sequence
  chemically synthesized
tgattttatcgtaccactaaac

SEQ ID NO: 147101 - DNA, 22 bp, Artificial Sequence
  chemically synthesized
attttatcgtaccactaaactc

SEQ ID NO: 147102 - DNA, 22 bp, Artificial Sequence
  chemically synthesized
tatcgtaccactaaactcacaa

SEQ ID NO: 147103 - DNA, 22 bp, Artificial Sequence
  chemically synthesized
atcgtaccactaaactcacaaa

SEQ ID NO: 147104 - DNA, 22 bp, Artificial Sequence
  chemically synthesized
tcgtaccactaaactcacaaat

SEQ ID NO: 147105 - DNA, 22 bp, Artificial Sequence
  chemically synthesized
aactcacaaatgtggccctatt

SEQ ID NO: 147106 - DNA, 22 bp, Artificial Sequence
  chemically synthesized
acaaatgtggccctattcttgt

SEQ ID NO: 147107 - DNA, 22 bp, Artificial Sequence
  chemically synthesized
ttcttgtgttcacgactgacat

SEQ ID NO: 147108 - DNA, 22 bp, Artificial Sequence
  chemically synthesized
ttgtgttcacgactgacatcac

SEQ ID NO: 147109 - DNA, 22 bp, Artificial Sequence
  chemically synthesized
gtgttcacgactgacatcaccg

SEQ ID NO: 147110 - DNA, 22 bp, Artificial Sequence
  chemically synthesized
tgttcacgactgacatcaccgt

SEQ ID NO: 147111 - DNA, 22 bp, Artificial Sequence
  chemically synthesized
acgactgacatcaccgtcatgg

SEQ ID NO: 147112 - DNA, 22 bp, Artificial Sequence
  chemically synthesized
acatcaccgtcatggtccaagt

SEQ ID NO: 147113 - DNA, 22 bp, Artificial Sequence
  chemically synthesized
ataatagaaatggcattgtcac

SEQ ID NO: 147114 - DNA, 22 bp, Artificial Sequence
  chemically synthesized
tcactttcttccctactgcaac

SEQ ID NO: 147115 - DNA, 22 bp, Artificial Sequence
  chemically synthesized
tcttccctactgcaacagaagc

SEQ ID NO: 147116 - DNA, 22 bp, Artificial Sequence
  chemically synthesized
cttccctactgcaacagaagcc

SEQ ID NO: 147117 - DNA, 22 bp, Artificial Sequence
  chemically synthesized
ttccctactgcaacagaagccc

SEQ ID NO: 147118 - DNA, 22 bp, Artificial Sequence
  chemically synthesized
ccctactgcaacagaagcccag

SEQ ID NO: 147119 - DNA, 22 bp, Artificial Sequence
  chemically synthesized
cctactgcaacagaagcccagc

SEQ ID NO: 147120 - DNA, 22 bp, Artificial Sequence
  chemically synthesized
ctgcaacagaagcccagctatt

SEQ ID NO: 147121 - DNA, 22 bp, Artificial Sequence
  chemically synthesized
caacagaagcccagctatttgt

SEQ ID NO: 147122 - DNA, 22 bp, Artificial Sequence
  chemically synthesized
tttgtctcccattttctctact

SEQ ID NO: 147123 - DNA, 22 bp, Artificial Sequence
  chemically synthesized
gtctcccattttctctacttct

SEQ ID NO: 147124 - DNA, 22 bp, Artificial Sequence
  chemically synthesized
tctcccattttctctacttcta

SEQ ID NO: 147125 - DNA, 22 bp, Artificial Sequence
  chemically synthesized
ccattttctctacttctaaaat

SEQ ID NO: 147126 - DNA, 22 bp, Artificial Sequence
  chemically synthesized
tctctacttctaaaatacattt

SEQ ID NO: 147127 - DNA, 22 bp, Artificial Sequence
  chemically synthesized
ctctacttctaaaatacatttc

SEQ ID NO: 147128 - DNA, 22 bp, Artificial Sequence
  chemically synthesized
tctacttctaaaatacatttct

SEQ ID NO: 147129 - DNA, 22 bp, Artificial Sequence
  chemically synthesized
tacttctaaaatacatttcttc

SEQ ID NO: 147130 - DNA, 22 bp, Artificial Sequence
  chemically synthesized
cttctaaaatacatttcttcac

SEQ ID NO: 147131 - DNA, 22 bp, Artificial Sequence
  chemically synthesized
ctaaaatacatttcttcactaa

SEQ ID NO: 147132 - DNA, 22 bp, Artificial Sequence
  chemically synthesized
taaaatacatttcttcactaag

SEQ ID NO: 147133 - DNA, 22 bp, Artificial Sequence
  chemically synthesized
aaatacatttcttcactaagtg

SEQ ID NO: 147134 - DNA, 22 bp, Artificial Sequence
  chemically synthesized
cttcactaagtgagaataatct

SEQ ID NO: 147135 - DNA, 22 bp, Artificial Sequence
  chemically synthesized
ttcactaagtgagaataatctt

SEQ ID NO: 147136 - DNA, 22 bp, Artificial Sequence
  chemically synthesized
cactaagtgagaataatctttt

SEQ ID NO: 147137 - DNA, 22 bp, Artificial Sequence
  chemically synthesized
actaagtgagaataatctttta

SEQ ID NO: 147138 - DNA, 22 bp, Artificial Sequence
  chemically synthesized
agtgagaataatcttttaaaga

SEQ ID NO: 147139 - DNA, 22 bp, Artificial Sequence
  chemically synthesized
ttaaagacacaaatcaaaccat

SEQ ID NO: 147140 - DNA, 22 bp, Artificial Sequence
  chemically synthesized
taaagacacaaatcaaaccatg

SEQ ID NO: 147141 - DNA, 22 bp, Artificial Sequence
  chemically synthesized
aaagacacaaatcaaaccatgc

SEQ ID NO: 147142 - DNA, 22 bp, Artificial Sequence
  chemically synthesized
aagacacaaatcaaaccatgcc

SEQ ID NO: 147143 - DNA, 22 bp, Artificial Sequence
  chemically synthesized
tcttgaattattcaatatcttt

SEQ ID NO: 147144 - DNA, 22 bp, Artificial Sequence
  chemically synthesized
cttgaattattcaatatctttc

SEQ ID NO: 147145 - DNA, 22 bp, Artificial Sequence
  chemically synthesized
ttgaattattcaatatctttcg

SEQ ID NO: 147146 - DNA, 22 bp, Artificial Sequence
  chemically synthesized
gaattattcaatatctttcgtt

SEQ ID NO: 147147 - DNA, 22 bp, Artificial Sequence
  chemically synthesized
aattattcaatatctttcgttg

SEQ ID NO: 147148 - DNA, 22 bp, Artificial Sequence
  chemically synthesized
ttcaatatctttcgttggcttc

SEQ ID NO: 147149 - DNA, 22 bp, Artificial Sequence
  chemically synthesized
aatatctttcgttggcttccag

SEQ ID NO: 147150 - DNA, 22 bp, Artificial Sequence
  chemically synthesized
tcgttggcttccaggttacaga

SEQ ID NO: 147151 - DNA, 22 bp, Artificial Sequence
  chemically synthesized
cgttggcttccaggttacagaa

SEQ ID NO: 147152 - DNA, 22 bp, Artificial Sequence
  chemically synthesized
gttggcttccaggttacagaaa

SEQ ID NO: 147153 - DNA, 22 bp, Artificial Sequence
  chemically synthesized
gcttccaggttacagaaaaata

SEQ ID NO: 147154 - DNA, 22 bp, Artificial Sequence
  chemically synthesized
ccaggttacagaaaaataactt

SEQ ID NO: 147155 - DNA, 22 bp, Artificial Sequence
  chemically synthesized
caggttacagaaaaataacttg

SEQ ID NO: 147156 - DNA, 22 bp, Artificial Sequence
  chemically synthesized
cagaaaaataacttgtaacaaa

SEQ ID NO: 147157 - DNA, 22 bp, Artificial Sequence
  chemically synthesized
gtaacaaagtttaaaggtcatt

SEQ ID NO: 147158 - DNA, 22 bp, Artificial Sequence
  chemically synthesized
taacaaagtttaaaggtcattc

SEQ ID NO: 147159 - DNA, 22 bp, Artificial Sequence
  chemically synthesized
aaaggtcattcatggctcctct

SEQ ID NO: 147160 - DNA, 22 bp, Artificial Sequence
  chemically synthesized
aaggtcattcatggctcctctc

SEQ ID NO: 147161 - DNA, 22 bp, Artificial Sequence
  chemically synthesized
atggctcctctctaccctattt

SEQ ID NO: 147162 - DNA, 22 bp, Artificial Sequence
  chemically synthesized
ctctctaccctattttataaca

SEQ ID NO: 147163 - DNA, 22 bp, Artificial Sequence
  chemically synthesized
tctaccctattttataacattt

SEQ ID NO: 147164 - DNA, 22 bp, Artificial Sequence
  chemically synthesized
taccctattttataacatttcc

SEQ ID NO: 147165 - DNA, 22 bp, Artificial Sequence
  chemically synthesized
ccctattttataacatttcccc

SEQ ID NO: 147166 - DNA, 22 bp, Artificial Sequence
  chemically synthesized
ttttataacatttccccttgtg

SEQ ID NO: 147167 - DNA, 22 bp, Artificial Sequence
  chemically synthesized
tataacatttccccttgtgatc

SEQ ID NO: 147168 - DNA, 22 bp, Artificial Sequence
  chemically synthesized
ataacatttccccttgtgatca

SEQ ID NO: 147169 - DNA, 22 bp, Artificial Sequence
  chemically synthesized
taacatttccccttgtgatcag

SEQ ID NO: 147170 - DNA, 22 bp, Artificial Sequence
  chemically synthesized
ccccttgtgatcagaatctcag

SEQ ID NO: 147171 - DNA, 22 bp, Artificial Sequence
  chemically synthesized
cccttgtgatcagaatctcagg

SEQ ID NO: 147172 - DNA, 22 bp, Artificial Sequence
  chemically synthesized
gtgatcagaatctcaggcacat

SEQ ID NO: 147173 - DNA, 22 bp, Artificial Sequence
  chemically synthesized
tgatcagaatctcaggcacatc

SEQ ID NO: 147174 - DNA, 22 bp, Artificial Sequence
  chemically synthesized
aggcacatcatccatctttcta

SEQ ID NO: 147175 - DNA, 22 bp, Artificial Sequence
  chemically synthesized
tctatatacaaataaagtcata

SEQ ID NO: 147176 - DNA, 22 bp, Artificial Sequence
  chemically synthesized
ctatatacaaataaagtcatat

SEQ ID NO: 147177 - DNA, 22 bp, Artificial Sequence
  chemically synthesized
tatatacaaataaagtcatata

SEQ ID NO: 147178 - DNA, 22 bp, Artificial Sequence
  chemically synthesized
tatacaaataaagtcatatagt

SEQ ID NO: 147179 - DNA, 22 bp, Artificial Sequence
  chemically synthesized
gaactcacctctggttactttt

SEQ ID NO: 147180 - DNA, 22 bp, Artificial Sequence
  chemically synthesized
aactcacctctggttactttta

SEQ ID NO: 147181 - DNA, 22 bp, Artificial Sequence
  chemically synthesized
acctctggttacttttaatcaa

SEQ ID NO: 147182 - DNA, 22 bp, Artificial Sequence
  chemically synthesized
tggttacttttaatcaaccaaa

SEQ ID NO: 147183 - DNA, 22 bp, Artificial Sequence
  chemically synthesized
gttacttttaatcaaccaaatg

SEQ ID NO: 147184 - DNA, 22 bp, Artificial Sequence
  chemically synthesized
cttttaatcaaccaaatgctgt

SEQ ID NO: 147185 - DNA, 22 bp, Artificial Sequence
  chemically synthesized
ttaatcaaccaaatgctgtaaa

SEQ ID NO: 147186 - DNA, 22 bp, Artificial Sequence
  chemically synthesized
taatcaaccaaatgctgtaaaa

SEQ ID NO: 147187 - DNA, 22 bp, Artificial Sequence
  chemically synthesized
aatcaaccaaatgctgtaaaat

SEQ ID NO: 147188 - DNA, 22 bp, Artificial Sequence
  chemically synthesized
atcaaccaaatgctgtaaaatg

SEQ ID NO: 147189 - DNA, 22 bp, Artificial Sequence
  chemically synthesized
taaaatgcatttgtatcgctac

SEQ ID NO: 147190 - DNA, 22 bp, Artificial Sequence
  chemically synthesized
gtatcgctacgtgttaagcagt

SEQ ID NO: 147191 - DNA, 22 bp, Artificial Sequence
  chemically synthesized
tatcgctacgtgttaagcagta

SEQ ID NO: 147192 - DNA, 22 bp, Artificial Sequence
  chemically synthesized
cgtgttaagcagtagttgattc

SEQ ID NO: 147193 - DNA, 22 bp, Artificial Sequence
  chemically synthesized
agcagtagttgattcttttcat

SEQ ID NO: 147194 - DNA, 22 bp, Artificial Sequence
  chemically synthesized
attcttttcatttctgtgtaat

SEQ ID NO: 147195 - DNA, 22 bp, Artificial Sequence
  chemically synthesized
ttttcatttctgtgtaatattc

SEQ ID NO: 147196 - DNA, 22 bp, Artificial Sequence
  chemically synthesized
ttcatttctgtgtaatattcta

SEQ ID NO: 147197 - DNA, 22 bp, Artificial Sequence
  chemically synthesized
tcatttctgtgtaatattctat

SEQ ID NO: 147198 - DNA, 22 bp, Artificial Sequence
  chemically synthesized
catttctgtgtaatattctatt

SEQ ID NO: 147199 - DNA, 22 bp, Artificial Sequence
  chemically synthesized
atttctgtgtaatattctattc

SEQ ID NO: 147200 - DNA, 22 bp, Artificial Sequence
  chemically synthesized
ctgtgtaatattctattctttg

SEQ ID NO: 147201 - DNA, 22 bp, Artificial Sequence
  chemically synthesized
tgtgtaatattctattctttga

SEQ ID NO: 147202 - DNA, 22 bp, Artificial Sequence
  chemically synthesized
tgtaatattctattctttgact

SEQ ID NO: 147203 - DNA, 22 bp, Artificial Sequence
  chemically synthesized
tattctttgactataccgtaat

SEQ ID NO: 147204 - DNA, 22 bp, Artificial Sequence
  chemically synthesized
ttctttgactataccgtaattt

SEQ ID NO: 147205 - DNA, 22 bp, Artificial Sequence
  chemically synthesized
tttgactataccgtaatttatc

SEQ ID NO: 147206 - DNA, 22 bp, Artificial Sequence
  chemically synthesized
tgactataccgtaatttatcaa

SEQ ID NO: 147207 - DNA, 22 bp, Artificial Sequence
  chemically synthesized
gactataccgtaatttatcaat

SEQ ID NO: 147208 - DNA, 22 bp, Artificial Sequence
  chemically synthesized
actataccgtaatttatcaatt

SEQ ID NO: 147209 - DNA, 22 bp, Artificial Sequence
  chemically synthesized
taccgtaatttatcaattctac

SEQ ID NO: 147210 - DNA, 22 bp, Artificial Sequence
  chemically synthesized
atcaattctactgttggtaagc

SEQ ID NO: 147211 - DNA, 22 bp, Artificial Sequence
  chemically synthesized
tcaattctactgttggtaagca

SEQ ID NO: 147212 - DNA, 22 bp, Artificial Sequence
  chemically synthesized
tactgttggtaagcatttaagt

SEQ ID NO: 147213 - DNA, 22 bp, Artificial Sequence
  chemically synthesized
ctgttggtaagcatttaagtgg

SEQ ID NO: 147214 - DNA, 22 bp, Artificial Sequence
  chemically synthesized
ttggtaagcatttaagtggcta

SEQ ID NO: 147215 - DNA, 22 bp, Artificial Sequence
  chemically synthesized
gtaagcatttaagtggctaccg

SEQ ID NO: 147216 - DNA, 22 bp, Artificial Sequence
  chemically synthesized
aagtggctaccggtttgaggtt

SEQ ID NO: 147217 - DNA, 22 bp, Artificial Sequence
  chemically synthesized
agtggctaccggtttgaggttt

SEQ ID NO: 147218 - DNA, 22 bp, Artificial Sequence
  chemically synthesized
ccggtttgaggtttttatgatt

SEQ ID NO: 147219 - DNA, 22 bp, Artificial Sequence
  chemically synthesized
gaggtttttatgattattgctg

SEQ ID NO: 147220 - DNA, 22 bp, Artificial Sequence
  chemically synthesized
aggtttttatgattattgctgt

SEQ ID NO: 147221 - DNA, 22 bp, Artificial Sequence
  chemically synthesized
ttatgattattgctgtcataag

SEQ ID NO: 147222 - DNA, 22 bp, Artificial Sequence
  chemically synthesized
tatgattattgctgtcataagc

SEQ ID NO: 147223 - DNA, 22 bp, Artificial Sequence
  chemically synthesized
atgattattgctgtcataagca

SEQ ID NO: 147224 - DNA, 22 bp, Artificial Sequence
  chemically synthesized
tgattattgctgtcataagcat

SEQ ID NO: 147225 - DNA, 22 bp, Artificial Sequence
  chemically synthesized
ttgctgtcataagcatttctat

SEQ ID NO: 147226 - DNA, 22 bp, Artificial Sequence
  chemically synthesized
ctgtcataagcatttctataca

SEQ ID NO: 147227 - DNA, 22 bp, Artificial Sequence
  chemically synthesized
tcataagcatttctatacatgt

SEQ ID NO: 147228 - DNA, 22 bp, Artificial Sequence
  chemically synthesized
ctatacatgtctttggatacac

SEQ ID NO: 147229 - DNA, 22 bp, Artificial Sequence
  chemically synthesized
tatacatgtctttggatacaca

SEQ ID NO: 147230 - DNA, 22 bp, Artificial Sequence
  chemically synthesized
tacatgtctttggatacacaca

SEQ ID NO: 147231 - DNA, 22 bp, Artificial Sequence
  chemically synthesized
tggatacacacatgcatgtgtt

SEQ ID NO: 147232 - DNA, 22 bp, Artificial Sequence
  chemically synthesized
ggatacacacatgcatgtgttt

SEQ ID NO: 147233 - DNA, 22 bp, Artificial Sequence
  chemically synthesized
gatacacacatgcatgtgtttc

SEQ ID NO: 147234 - DNA, 22 bp, Artificial Sequence
  chemically synthesized
ctgaatatctaaaaatgtaatt

SEQ ID NO: 147235 - DNA, 22 bp, Artificial Sequence
  chemically synthesized
tgaatatctaaaaatgtaattg

SEQ ID NO: 147236 - DNA, 22 bp, Artificial Sequence
  chemically synthesized
aatatctaaaaatgtaattgct

SEQ ID NO: 147237 - DNA, 22 bp, Artificial Sequence
  chemically synthesized
aaaatgtaattgctaggtaata

SEQ ID NO: 147238 - DNA, 22 bp, Artificial Sequence
  chemically synthesized
ctaggtaatagacttatcaagc

SEQ ID NO: 147239 - DNA, 22 bp, Artificial Sequence
  chemically synthesized
ggtaatagacttatcaagcatc

SEQ ID NO: 147240 - DNA, 22 bp, Artificial Sequence
  chemically synthesized
atcaagcatccagcatttgtgg

SEQ ID NO: 147241 - DNA, 22 bp, Artificial Sequence
  chemically synthesized
tcaagcatccagcatttgtgga

SEQ ID NO: 147242 - DNA, 22 bp, Artificial Sequence
  chemically synthesized
gtggatactattaaaggttttc

SEQ ID NO: 147243 - DNA, 22 bp, Artificial Sequence
  chemically synthesized
tggatactattaaaggttttcc

SEQ ID NO: 147244 - DNA, 22 bp, Artificial Sequence
  chemically synthesized
ttaaaggttttccaaaggggtt

SEQ ID NO: 147245 - DNA, 22 bp, Artificial Sequence
  chemically synthesized
aaggttttccaaaggggttata

SEQ ID NO: 147246 - DNA, 22 bp, Artificial Sequence
  chemically synthesized
tccaaaggggttatactattgt

SEQ ID NO: 147247 - DNA, 22 bp, Artificial Sequence
  chemically synthesized
ccaaaggggttatactattgta

SEQ ID NO: 147248 - DNA, 22 bp, Artificial Sequence
  chemically synthesized
caaaggggttatactattgtac

SEQ ID NO: 147249 - DNA, 22 bp, Artificial Sequence
  chemically synthesized
tactattgtacagtgtcaccaa

SEQ ID NO: 147250 - DNA, 22 bp, Artificial Sequence
  chemically synthesized
ttgtacagtgtcaccaacagag

SEQ ID NO: 147251 - DNA, 22 bp, Artificial Sequence
  chemically synthesized
tacagtgtcaccaacagagttt

SEQ ID NO: 147252 - DNA, 22 bp, Artificial Sequence
  chemically synthesized
gagtttctattgatccatatca

SEQ ID NO: 147253 - DNA, 22 bp, Artificial Sequence
  chemically synthesized
agtttctattgatccatatcac

SEQ ID NO: 147254 - DNA, 22 bp, Artificial Sequence
  chemically synthesized
ctattgatccatatcaccacca

SEQ ID NO: 147255 - DNA, 22 bp, Artificial Sequence
  chemically synthesized
tattgatccatatcaccaccaa

SEQ ID NO: 147256 - DNA, 22 bp, Artificial Sequence
  chemically synthesized
ttgatccatatcaccaccaaaa

SEQ ID NO: 147257 - DNA, 22 bp, Artificial Sequence
  chemically synthesized
atccatatcaccaccaaaattt

SEQ ID NO: 147258 - DNA, 22 bp, Artificial Sequence
  chemically synthesized
gaactgtcagtcttatctcttc

SEQ ID NO: 147259 - DNA, 22 bp, Artificial Sequence
  chemically synthesized
aactgtcagtcttatctcttct

SEQ ID NO: 147260 - DNA, 22 bp, Artificial Sequence
  chemically synthesized
tcagtcttatctcttctcttgt

SEQ ID NO: 147261 - DNA, 22 bp, Artificial Sequence
  chemically synthesized
atctcttctcttgtctcttttt

SEQ ID NO: 147262 - DNA, 22 bp, Artificial Sequence
  chemically synthesized
tctcttctcttgtctctttttt

SEQ ID NO: 147263 - DNA, 22 bp, Artificial Sequence
  chemically synthesized
ttctcttgtctcttttttcctc

SEQ ID NO: 147264 - DNA, 22 bp, Artificial Sequence
  chemically synthesized
ctcttgtctcttttttcctctt

SEQ ID NO: 147265 - DNA, 22 bp, Artificial Sequence
  chemically synthesized
tcttgtctcttttttcctcttt

SEQ ID NO: 147266 - DNA, 22 bp, Artificial Sequence
  chemically synthesized
ttgtctcttttttcctcttttt

SEQ ID NO: 147267 - DNA, 22 bp, Artificial Sequence
  chemically synthesized
gtctcttttttcctcttttttt

SEQ ID NO: 147268 - DNA, 22 bp, Artificial Sequence
  chemically synthesized
tctcttttttcctctttttttt

SEQ ID NO: 147269 - DNA, 22 bp, Artificial Sequence
  chemically synthesized
ttttttcctcttttttttcctt

SEQ ID NO: 147270 - DNA, 22 bp, Artificial Sequence
  chemically synthesized
ttttcctcttttttttccttcc

SEQ ID NO: 147271 - DNA, 22 bp, Artificial Sequence
  chemically synthesized
tttcctcttttttttccttccc

SEQ ID NO: 147272 - DNA, 22 bp, Artificial Sequence
  chemically synthesized
ttcctcttttttttccttccct

SEQ ID NO: 147273 - DNA, 22 bp, Artificial Sequence
  chemically synthesized
tcctcttttttttccttccctt

SEQ ID NO: 147274 - DNA, 22 bp, Artificial Sequence
  chemically synthesized
cctcttttttttccttcccttc

SEQ ID NO: 147275 - DNA, 22 bp, Artificial Sequence
  chemically synthesized
ctcttttttttccttcccttcc

SEQ ID NO: 147276 - DNA, 22 bp, Artificial Sequence
  chemically synthesized
ttttttttccttcccttcccct

SEQ ID NO: 147277 - DNA, 22 bp, Artificial Sequence
  chemically synthesized
ttttttccttcccttcccctct

SEQ ID NO: 147278 - DNA, 22 bp, Artificial Sequence
  chemically synthesized
tttttccttcccttcccctctc

SEQ ID NO: 147279 - DNA, 22 bp, Artificial Sequence
  chemically synthesized
ttttccttcccttcccctctct

SEQ ID NO: 147280 - DNA, 22 bp, Artificial Sequence
  chemically synthesized
tttccttcccttcccctctctt

SEQ ID NO: 147281 - DNA, 22 bp, Artificial Sequence
  chemically synthesized
ttccttcccttcccctctcttc

SEQ ID NO: 147282 - DNA, 22 bp, Artificial Sequence
  chemically synthesized
tccttcccttcccctctcttcg

SEQ ID NO: 147283 - DNA, 22 bp, Artificial Sequence
  chemically synthesized
ccttcccttcccctctcttcgt

SEQ ID NO: 147284 - DNA, 22 bp, Artificial Sequence
  chemically synthesized
cttcccttcccctctcttcgtt

SEQ ID NO: 147285 - DNA, 22 bp, Artificial Sequence
  chemically synthesized
cccttcccctctcttcgtttct

SEQ ID NO: 147286 - DNA, 22 bp, Artificial Sequence
  chemically synthesized
ccttcccctctcttcgtttctt

SEQ ID NO: 147287 - DNA, 22 bp, Artificial Sequence
  chemically synthesized
cccctctcttcgtttcttttct

SEQ ID NO: 147288 - DNA, 22 bp, Artificial Sequence
  chemically synthesized
ccctctcttcgtttcttttctc

SEQ ID NO: 147289 - DNA, 22 bp, Artificial Sequence
  chemically synthesized
tcttcgtttcttttctctcctc

SEQ ID NO: 147290 - DNA, 22 bp, Artificial Sequence
  chemically synthesized
ttcgtttcttttctctcctctt

SEQ ID NO: 147291 - DNA, 22 bp, Artificial Sequence
  chemically synthesized
cgtttcttttctctcctcttct

SEQ ID NO: 147292 - DNA, 22 bp, Artificial Sequence
  chemically synthesized
gtttcttttctctcctcttctc

SEQ ID NO: 147293 - DNA, 22 bp, Artificial Sequence
  chemically synthesized
cttttctctcctcttctcttct

SEQ ID NO: 147294 - DNA, 22 bp, Artificial Sequence
  chemically synthesized
ttttctctcctcttctcttctt

SEQ ID NO: 147295 - DNA, 22 bp, Artificial Sequence
  chemically synthesized
ttctctcctcttctcttctttc

SEQ ID NO: 147296 - DNA, 22 bp, Artificial Sequence
  chemically synthesized
tctctcctcttctcttctttcc

SEQ ID NO: 147297 - DNA, 22 bp, Artificial Sequence
  chemically synthesized
ctctcctcttctcttctttcct

SEQ ID NO: 147298 - DNA, 22 bp, Artificial Sequence
  chemically synthesized
tctcctcttctcttctttcctc

SEQ ID NO: 147299 - DNA, 22 bp, Artificial Sequence
  chemically synthesized
tcctcttctcttctttcctctc

SEQ ID NO: 147300 - DNA, 22 bp, Artificial Sequence
  chemically synthesized
ctcttctcttctttcctctctt

SEQ ID NO: 147301 - DNA, 22 bp, Artificial Sequence
  chemically synthesized
ttctcttctttcctctcttccc

SEQ ID NO: 147302 - DNA, 22 bp, Artificial Sequence
  chemically synthesized
ctcttctttcctctcttccctt

SEQ ID NO: 147303 - DNA, 22 bp, Artificial Sequence
  chemically synthesized
tcttctttcctctcttcccttc

SEQ ID NO: 147304 - DNA, 22 bp, Artificial Sequence
  chemically synthesized
ttctttcctctcttcccttccc

SEQ ID NO: 147305 - DNA, 22 bp, Artificial Sequence
  chemically synthesized
ctttcctctcttcccttccctt

SEQ ID NO: 147306 - DNA, 22 bp, Artificial Sequence
  chemically synthesized
tttcctctcttcccttcccttt

SEQ ID NO: 147307 - DNA, 22 bp, Artificial Sequence
  chemically synthesized
tcctctcttcccttccctttct

SEQ ID NO: 147308 - DNA, 22 bp, Artificial Sequence
  chemically synthesized
cctctcttcccttccctttctc

SEQ ID NO: 147309 - DNA, 22 bp, Artificial Sequence
  chemically synthesized
ctctcttcccttccctttctct

SEQ ID NO: 147310 - DNA, 22 bp, Artificial Sequence
  chemically synthesized
tcttcccttccctttctctttc

SEQ ID NO: 147311 - DNA, 22 bp, Artificial Sequence
  chemically synthesized
ttcccttccctttctctttctc

SEQ ID NO: 147312 - DNA, 22 bp, Artificial Sequence
  chemically synthesized
cccttccctttctctttctctt

SEQ ID NO: 147313 - DNA, 22 bp, Artificial Sequence
  chemically synthesized
ccttccctttctctttctcttc

SEQ ID NO: 147314 - DNA, 22 bp, Artificial Sequence
  chemically synthesized
ccctttctctttctcttcccta

SEQ ID NO: 147315 - DNA, 22 bp, Artificial Sequence
  chemically synthesized
cctttctctttctcttccctat

SEQ ID NO: 147316 - DNA, 22 bp, Artificial Sequence
  chemically synthesized
tctctttctcttccctatccct

SEQ ID NO: 147317 - DNA, 22 bp, Artificial Sequence
  chemically synthesized
ctctttctcttccctatccctt

SEQ ID NO: 147318 - DNA, 22 bp, Artificial Sequence
  chemically synthesized
tctttctcttccctatcccttc

SEQ ID NO: 147319 - DNA, 22 bp, Artificial Sequence
  chemically synthesized
tttctcttccctatcccttctc

SEQ ID NO: 147320 - DNA, 22 bp, Artificial Sequence
  chemically synthesized
tctcttccctatcccttctcct

SEQ ID NO: 147321 - DNA, 22 bp, Artificial Sequence
  chemically synthesized
ctcttccctatcccttctcctc

SEQ ID NO: 147322 - DNA, 22 bp, Artificial Sequence
  chemically synthesized
tcttccctatcccttctcctct

SEQ ID NO: 147323 - DNA, 22 bp, Artificial Sequence
  chemically synthesized
ttccctatcccttctcctctcc

SEQ ID NO: 147324 - DNA, 22 bp, Artificial Sequence
  chemically synthesized
ccctatcccttctcctctcctc

SEQ ID NO: 147325 - DNA, 22 bp, Artificial Sequence
  chemically synthesized
cctatcccttctcctctcctct

SEQ ID NO: 147326 - DNA, 22 bp, Artificial Sequence
  chemically synthesized
tcccttctcctctcctctcccc

SEQ ID NO: 147327 - DNA, 22 bp, Artificial Sequence
  chemically synthesized
ctcctctcctctcccctccttt

SEQ ID NO: 147328 - DNA, 22 bp, Artificial Sequence
  chemically synthesized
tcctctcctctcccctcctttt

SEQ ID NO: 147329 - DNA, 22 bp, Artificial Sequence
  chemically synthesized
ctctcctctcccctcctttttt

SEQ ID NO: 147330 - DNA, 22 bp, Artificial Sequence
  chemically synthesized
tcctctcccctccttttttctc

SEQ ID NO: 147331 - DNA, 22 bp, Artificial Sequence
  chemically synthesized
ctctcccctccttttttctcct

SEQ ID NO: 147332 - DNA, 22 bp, Artificial Sequence
  chemically synthesized
tcccctccttttttctcctctc

SEQ ID NO: 147333 - DNA, 22 bp, Artificial Sequence
  chemically synthesized
ccctccttttttctcctctcct

SEQ ID NO: 147334 - DNA, 22 bp, Artificial Sequence
  chemically synthesized
cttttttctcctctcctctcca

SEQ ID NO: 147335 - DNA, 22 bp, Artificial Sequence
  chemically synthesized
ttttctcctctcctctccatta

SEQ ID NO: 147336 - DNA, 22 bp, Artificial Sequence
  chemically synthesized
tttctcctctcctctccattat

SEQ ID NO: 147337 - DNA, 22 bp, Artificial Sequence
  chemically synthesized
ttctcctctcctctccattatt

SEQ ID NO: 147338 - DNA, 22 bp, Artificial Sequence
  chemically synthesized
tctcctctcctctccattattt

SEQ ID NO: 147339 - DNA, 22 bp, Artificial Sequence
  chemically synthesized
ctcctctcctctccattattta

SEQ ID NO: 147340 - DNA, 22 bp, Artificial Sequence
  chemically synthesized
tcctctcctctccattatttat

SEQ ID NO: 147341 - DNA, 22 bp, Artificial Sequence
  chemically synthesized
ctctcctctccattatttattt

SEQ ID NO: 147342 - DNA, 22 bp, Artificial Sequence
  chemically synthesized
tcctctccattatttatttttc

SEQ ID NO: 147343 - DNA, 22 bp, Artificial Sequence
  chemically synthesized
ctctccattatttatttttcct

SEQ ID NO: 147344 - DNA, 22 bp, Artificial Sequence
  chemically synthesized
tccattatttatttttccttct

SEQ ID NO: 147345 - DNA, 22 bp, Artificial Sequence
  chemically synthesized
cattatttatttttccttcttc

SEQ ID NO: 147346 - DNA, 22 bp, Artificial Sequence
  chemically synthesized
tttatttttccttcttctcctc

SEQ ID NO: 147347 - DNA, 22 bp, Artificial Sequence
  chemically synthesized
atttttccttcttctcctccat

SEQ ID NO: 147348 - DNA, 22 bp, Artificial Sequence
  chemically synthesized
tttttccttcttctcctccatc

SEQ ID NO: 147349 - DNA, 22 bp, Artificial Sequence
  chemically synthesized
ttccttcttctcctccatccct

SEQ ID NO: 147350 - DNA, 22 bp, Artificial Sequence
  chemically synthesized
tccttcttctcctccatccctt

SEQ ID NO: 147351 - DNA, 22 bp, Artificial Sequence
  chemically synthesized
ccttcttctcctccatcccttc

SEQ ID NO: 147352 - DNA, 22 bp, Artificial Sequence
  chemically synthesized
cttcttctcctccatcccttcc

SEQ ID NO: 147353 - DNA, 22 bp, Artificial Sequence
  chemically synthesized
cttctcctccatcccttccatc

SEQ ID NO: 147354 - DNA, 22 bp, Artificial Sequence
  chemically synthesized
ttctcctccatcccttccatcc

SEQ ID NO: 147355 - DNA, 22 bp, Artificial Sequence
  chemically synthesized
ctcctccatcccttccatcctc

SEQ ID NO: 147356 - DNA, 22 bp, Artificial Sequence
  chemically synthesized
tcctccatcccttccatcctct

SEQ ID NO: 147357 - DNA, 22 bp, Artificial Sequence
  chemically synthesized
ctccatcccttccatcctctct

SEQ ID NO: 147358 - DNA, 22 bp, Artificial Sequence
  chemically synthesized
catcccttccatcctctctctt

SEQ ID NO: 147359 - DNA, 22 bp, Artificial Sequence
  chemically synthesized
ccatcctctctcttcccctctt

SEQ ID NO: 147360 - DNA, 22 bp, Artificial Sequence
  chemically synthesized
catcctctctcttcccctcttc

SEQ ID NO: 147361 - DNA, 22 bp, Artificial Sequence
  chemically synthesized
tctcttcccctcttccttcctt

SEQ ID NO: 147362 - DNA, 22 bp, Artificial Sequence
  chemically synthesized
tcttcccctcttccttccttcc

SEQ ID NO: 147363 - DNA, 22 bp, Artificial Sequence
  chemically synthesized
ttcccctcttccttccttcctt

SEQ ID NO: 147364 - DNA, 22 bp, Artificial Sequence
  chemically synthesized
cccctcttccttccttcctttc

SEQ ID NO: 147365 - DNA, 22 bp, Artificial Sequence
  chemically synthesized
ccctcttccttccttcctttct

SEQ ID NO: 147366 - DNA, 22 bp, Artificial Sequence
  chemically synthesized
ttccttccttcctttctccatt

SEQ ID NO: 147367 - DNA, 22 bp, Artificial Sequence
  chemically synthesized
ccttccttcctttctccatttc

SEQ ID NO: 147368 - DNA, 22 bp, Artificial Sequence
  chemically synthesized
cttccttcctttctccatttct

SEQ ID NO: 147369 - DNA, 22 bp, Artificial Sequence
  chemically synthesized
ccttcctttctccatttcttcc

SEQ ID NO: 147370 - DNA, 22 bp, Artificial Sequence
  chemically synthesized
cttcctttctccatttcttcct

SEQ ID NO: 147371 - DNA, 22 bp, Artificial Sequence
  chemically synthesized
cctttctccatttcttcctcct

SEQ ID NO: 147372 - DNA, 22 bp, Artificial Sequence
  chemically synthesized
ctttctccatttcttcctcctc

SEQ ID NO: 147373 - DNA, 22 bp, Artificial Sequence
  chemically synthesized
tctccatttcttcctcctcttt

SEQ ID NO: 147374 - DNA, 22 bp, Artificial Sequence
  chemically synthesized
ctccatttcttcctcctctttc

SEQ ID NO: 147375 - DNA, 22 bp, Artificial Sequence
  chemically synthesized
tccatttcttcctcctctttcc

SEQ ID NO: 147376 - DNA, 22 bp, Artificial Sequence
  chemically synthesized
catttcttcctcctctttcctt

SEQ ID NO: 147377 - DNA, 22 bp, Artificial Sequence
  chemically synthesized
cttcctcctctttccttcaatc

SEQ ID NO: 147378 - DNA, 22 bp, Artificial Sequence
  chemically synthesized
ttcctcctctttccttcaatcc

SEQ ID NO: 147379 - DNA, 22 bp, Artificial Sequence
  chemically synthesized
cctcctctttccttcaatcctt

SEQ ID NO: 147380 - DNA, 22 bp, Artificial Sequence
  chemically synthesized
ctcctctttccttcaatccttc

SEQ ID NO: 147381 - DNA, 22 bp, Artificial Sequence
  chemically synthesized
ctctttccttcaatccttcctt

SEQ ID NO: 147382 - DNA, 22 bp, Artificial Sequence
  chemically synthesized
tttccttcaatccttccttttg

SEQ ID NO: 147383 - DNA, 22 bp, Artificial Sequence
  chemically synthesized
tccttcaatccttccttttgga

SEQ ID NO: 147384 - DNA, 22 bp, Artificial Sequence
  chemically synthesized
ccttcaatccttccttttggat

SEQ ID NO: 147385 - DNA, 22 bp, Artificial Sequence
  chemically synthesized
cttcaatccttccttttggata

SEQ ID NO: 147386 - DNA, 22 bp, Artificial Sequence
  chemically synthesized
caatccttccttttggatatgc

SEQ ID NO: 147387 - DNA, 22 bp, Artificial Sequence
  chemically synthesized
aatccttccttttggatatgct

SEQ ID NO: 147388 - DNA, 22 bp, Artificial Sequence
  chemically synthesized
ccttttggatatgctcatgggt

SEQ ID NO: 147389 - DNA, 22 bp, Artificial Sequence
  chemically synthesized
cttttggatatgctcatgggtg

SEQ ID NO: 147390 - DNA, 22 bp, Artificial Sequence
  chemically synthesized
ttggatatgctcatgggtgtgt

SEQ ID NO: 147391 - DNA, 22 bp, Artificial Sequence
  chemically synthesized
tggatatgctcatgggtgtgta

SEQ ID NO: 147392 - DNA, 22 bp, Artificial Sequence
  chemically synthesized
ggatatgctcatgggtgtgtat

SEQ ID NO: 147393 - DNA, 22 bp, Artificial Sequence
  chemically synthesized
gatatgctcatgggtgtgtatt

SEQ ID NO: 147394 - DNA, 22 bp, Artificial Sequence
  chemically synthesized
atgggtgtgtatttgtctgcca

SEQ ID NO: 147395 - DNA, 22 bp, Artificial Sequence
  chemically synthesized
gtctgccattgtggcattattt

SEQ ID NO: 147396 - DNA, 22 bp, Artificial Sequence
  chemically synthesized
tctgccattgtggcattatttg

SEQ ID NO: 147397 - DNA, 22 bp, Artificial Sequence
  chemically synthesized
ccattgtggcattatttgaatt

SEQ ID NO: 147398 - DNA, 22 bp, Artificial Sequence
  chemically synthesized
tggcattatttgaattcagaaa

SEQ ID NO: 147399 - DNA, 22 bp, Artificial Sequence
  chemically synthesized
tttgaattcagaaaagagtgaa

SEQ ID NO: 147400 - DNA, 22 bp, Artificial Sequence
  chemically synthesized
gaattcagaaaagagtgaaaaa

SEQ ID NO: 147401 - DNA, 22 bp, Artificial Sequence
  chemically synthesized
aattcagaaaagagtgaaaaac

SEQ ID NO: 147402 - DNA, 22 bp, Artificial Sequence
  chemically synthesized
agaaaagagtgaaaaactactg

SEQ ID NO: 147403 - DNA, 22 bp, Artificial Sequence
  chemically synthesized
ctgggatcttcattcctgggtc

SEQ ID NO: 147404 - DNA, 22 bp, Artificial Sequence
  chemically synthesized
ggatcttcattcctgggtctaa

SEQ ID NO: 147405 - DNA, 22 bp, Artificial Sequence
  chemically synthesized
cattcctgggtctaattccaca

SEQ ID NO: 147406 - DNA, 22 bp, Artificial Sequence
  chemically synthesized
attcctgggtctaattccacat

SEQ ID NO: 147407 - DNA, 22 bp, Artificial Sequence
  chemically synthesized
ctgggtctaattccacattttt

SEQ ID NO: 147408 - DNA, 22 bp, Artificial Sequence
  chemically synthesized
ggtctaattccacatttttttt

SEQ ID NO: 147409 - DNA, 22 bp, Artificial Sequence
  chemically synthesized
attccacatttttttttaagaa

SEQ ID NO: 147410 - DNA, 22 bp, Artificial Sequence
  chemically synthesized
cacatttttttttaagaacaca

SEQ ID NO: 147411 - DNA, 22 bp, Artificial Sequence
  chemically synthesized
ttttttaagaacacatctgtaa

SEQ ID NO: 147412 - DNA, 22 bp, Artificial Sequence
  chemically synthesized
tttttaagaacacatctgtaaa

SEQ ID NO: 147413 - DNA, 22 bp, Artificial Sequence
  chemically synthesized
ttttaagaacacatctgtaaaa

SEQ ID NO: 147414 - DNA, 22 bp, Artificial Sequence
  chemically synthesized
tttaagaacacatctgtaaaaa

SEQ ID NO: 147415 - DNA, 22 bp, Artificial Sequence
  chemically synthesized
ttaagaacacatctgtaaaaat

SEQ ID NO: 147416 - DNA, 22 bp, Artificial Sequence
  chemically synthesized
taagaacacatctgtaaaaatg

SEQ ID NO: 147417 - DNA, 22 bp, Artificial Sequence
  chemically synthesized
aagaacacatctgtaaaaatgt

SEQ ID NO: 147418 - DNA, 22 bp, Artificial Sequence
  chemically synthesized
agaacacatctgtaaaaatgtt

SEQ ID NO: 147419 - DNA, 22 bp, Artificial Sequence
  chemically synthesized
taaaaatgttctgtactagcat

SEQ ID NO: 147420 - DNA, 22 bp, Artificial Sequence
  chemically synthesized
tgtactagcatattcccaggaa

SEQ ID NO: 147421 - DNA, 22 bp, Artificial Sequence
  chemically synthesized
tactagcatattcccaggaact

SEQ ID NO: 147422 - DNA, 22 bp, Artificial Sequence
  chemically synthesized
gcatattcccaggaacttcgtt

SEQ ID NO: 147423 - DNA, 22 bp, Artificial Sequence
  chemically synthesized
ccaggaacttcgttaaatttaa

SEQ ID NO: 147424 - DNA, 22 bp, Artificial Sequence
  chemically synthesized
cgttaaatttaatctggctgaa

SEQ ID NO: 147425 - DNA, 22 bp, Artificial Sequence
  chemically synthesized
gttaaatttaatctggctgaat

SEQ ID NO: 147426 - DNA, 22 bp, Artificial Sequence
  chemically synthesized
aatttaatctggctgaatatgg

SEQ ID NO: 147427 - DNA, 22 bp, Artificial Sequence
  chemically synthesized
aatctggctgaatatggtaaat

SEQ ID NO: 147428 - DNA, 22 bp, Artificial Sequence
  chemically synthesized
atctggctgaatatggtaaatc

SEQ ID NO: 147429 - DNA, 22 bp, Artificial Sequence
  chemically synthesized
gctgaatatggtaaatctactt

SEQ ID NO: 147430 - DNA, 22 bp, Artificial Sequence
  chemically synthesized
aatatggtaaatctacttttca

SEQ ID NO: 147431 - DNA, 22 bp, Artificial Sequence
  chemically synthesized
cttttcactttgcattctttct

SEQ ID NO: 147432 - DNA, 22 bp, Artificial Sequence
  chemically synthesized
ttcactttgcattctttcttta

SEQ ID NO: 147433 - DNA, 22 bp, Artificial Sequence
  chemically synthesized
tcactttgcattctttctttag

SEQ ID NO: 147434 - DNA, 22 bp, Artificial Sequence
  chemically synthesized
cactttgcattctttctttagt

SEQ ID NO: 147435 - DNA, 22 bp, Artificial Sequence
  chemically synthesized
actttgcattctttctttagtc

SEQ ID NO: 147436 - DNA, 22 bp, Artificial Sequence
  chemically synthesized
tgcattctttctttagtcatac

SEQ ID NO: 147437 - DNA, 22 bp, Artificial Sequence
  chemically synthesized
gcattctttctttagtcatacc

SEQ ID NO: 147438 - DNA, 22 bp, Artificial Sequence
  chemically synthesized
cattctttctttagtcatacca

SEQ ID NO: 147439 - DNA, 22 bp, Artificial Sequence
  chemically synthesized
tttctttagtcataccataatt

SEQ ID NO: 147440 - DNA, 22 bp, Artificial Sequence
  chemically synthesized
tctttagtcataccataatttt

SEQ ID NO: 147441 - DNA, 22 bp, Artificial Sequence
  chemically synthesized
ctttagtcataccataatttta

SEQ ID NO: 147442 - DNA, 22 bp, Artificial Sequence
  chemically synthesized
tttagtcataccataattttaa

SEQ ID NO: 147443 - DNA, 22 bp, Artificial Sequence
  chemically synthesized
tagtcataccataattttaaac

SEQ ID NO: 147444 - DNA, 22 bp, Artificial Sequence
  chemically synthesized
agtcataccataattttaaaca

SEQ ID NO: 147445 - DNA, 22 bp, Artificial Sequence
  chemically synthesized
gtcataccataattttaaacat

SEQ ID NO: 147446 - DNA, 22 bp, Artificial Sequence
  chemically synthesized
taaacattcaaaatatttgtat

SEQ ID NO: 147447 - DNA, 22 bp, Artificial Sequence
  chemically synthesized
aaacattcaaaatatttgtata

SEQ ID NO: 147448 - DNA, 22 bp, Artificial Sequence
  chemically synthesized
aacattcaaaatatttgtatat

SEQ ID NO: 147449 - DNA, 22 bp, Artificial Sequence
  chemically synthesized
aaaatatttgtatataatattt

SEQ ID NO: 147450 - DNA, 22 bp, Artificial Sequence
  chemically synthesized
gtatataatatttgattttatc

SEQ ID NO: 147451 - DNA, 22 bp, Artificial Sequence
  chemically synthesized
tatataatatttgattttatct

SEQ ID NO: 147452 - DNA, 22 bp, Artificial Sequence
  chemically synthesized
gattttatctgtcattaaaatg

SEQ ID NO: 147453 - DNA, 22 bp, Artificial Sequence
  chemically synthesized
attttatctgtcattaaaatgt

SEQ ID NO: 147454 - DNA, 22 bp, Artificial Sequence
  chemically synthesized
tatctgtcattaaaatgttaac

SEQ ID NO: 147455 - DNA, 22 bp, Artificial Sequence
  chemically synthesized
atctgtcattaaaatgttaacc

SEQ ID NO: 147456 - DNA, 22 bp, Artificial Sequence
  chemically synthesized
tctgtcattaaaatgttaacct

SEQ ID NO: 147457 - DNA, 22 bp, Artificial Sequence
  chemically synthesized
tcattaaaatgttaaccttaaa

SEQ ID NO: 147458 - DNA, 22 bp, Artificial Sequence
  chemically synthesized
aaatgttaaccttaaaattcat

SEQ ID NO: 147459 - DNA, 22 bp, Artificial Sequence
  chemically synthesized
accttaaaattcatgtttccag

SEQ ID NO: 147460 - DNA, 22 bp, Artificial Sequence
  chemically synthesized
aaaattcatgtttccagaacct

SEQ ID NO: 147461 - DNA, 22 bp, Artificial Sequence
  chemically synthesized
aaattcatgtttccagaaccta

SEQ ID NO: 147462 - DNA, 22 bp, Artificial Sequence
  chemically synthesized
atgtttccagaacctatttcaa

SEQ ID NO: 147463 - DNA, 22 bp, Artificial Sequence
  chemically synthesized
ccagaacctatttcaataactg

SEQ ID NO: 147464 - DNA, 22 bp, Artificial Sequence
  chemically synthesized
cagaacctatttcaataactgg

SEQ ID NO: 147465 - DNA, 22 bp, Artificial Sequence
  chemically synthesized
tttcaataactggtaaataaac

SEQ ID NO: 147466 - DNA, 22 bp, Artificial Sequence
  chemically synthesized
caataactggtaaataaacact

SEQ ID NO: 147467 - DNA, 22 bp, Artificial Sequence
  chemically synthesized
aataactggtaaataaacacta

SEQ ID NO: 147468 - DNA, 22 bp, Artificial Sequence
  chemically synthesized
gtaaataaacactattcatttt

SEQ ID NO: 147469 - DNA, 22 bp, Artificial Sequence
  chemically synthesized
ttcattttttaaatattctttt

SEQ ID NO: 147470 - DNA, 22 bp, Artificial Sequence
  chemically synthesized
attttttaaatattcttttaat

SEQ ID NO: 147471 - DNA, 22 bp, Artificial Sequence
  chemically synthesized
tttaaatattcttttaatggat

SEQ ID NO: 147472 - DNA, 22 bp, Artificial Sequence
  chemically synthesized
ttaaatattcttttaatggata

SEQ ID NO: 147473 - DNA, 22 bp, Artificial Sequence
  chemically synthesized
taaatattcttttaatggatat

SEQ ID NO: 147474 - DNA, 22 bp, Artificial Sequence
  chemically synthesized
aaatattcttttaatggatatt

SEQ ID NO: 147475 - DNA, 22 bp, Artificial Sequence
  chemically synthesized
aatattcttttaatggatattt

SEQ ID NO: 147476 - DNA, 22 bp, Artificial Sequence
  chemically synthesized
ttttaatggatatttatttcaa

SEQ ID NO: 147477 - DNA, 22 bp, Artificial Sequence
  chemically synthesized
ttaatggatatttatttcaata

SEQ ID NO: 147478 - DNA, 22 bp, Artificial Sequence
  chemically synthesized
taatggatatttatttcaatat

SEQ ID NO: 147479 - DNA, 22 bp, Artificial Sequence
  chemically synthesized
aatggatatttatttcaatata

SEQ ID NO: 147480 - DNA, 22 bp, Artificial Sequence
  chemically synthesized
atggatatttatttcaatataa

SEQ ID NO: 147481 - DNA, 22 bp, Artificial Sequence
  chemically synthesized
atttcaatataataaaaaatta

SEQ ID NO: 147482 - DNA, 22 bp, Artificial Sequence
  chemically synthesized
tttcaatataataaaaaattag

SEQ ID NO: 147483 - DNA, 22 bp, Artificial Sequence
  chemically synthesized
caatataataaaaaattagagt

SEQ ID NO: 147484 - DNA, 22 bp, Artificial Sequence
  chemically synthesized
aatataataaaaaattagagtt

SEQ ID NO: 147485 - DNA, 22 bp, Artificial Sequence
  chemically synthesized
gagttttattataggaagaatt

SEQ ID NO: 147486 - DNA, 22 bp, Artificial Sequence
  chemically synthesized
tattataggaagaatttaccaa

SEQ ID NO: 147487 - DNA, 22 bp, Artificial Sequence
  chemically synthesized
attataggaagaatttaccaaa

SEQ ID NO: 147488 - DNA, 22 bp, Artificial Sequence
  chemically synthesized
ttataggaagaatttaccaaaa

SEQ ID NO: 147489 - DNA, 22 bp, Artificial Sequence
  chemically synthesized
taggaagaatttaccaaaagaa

SEQ ID NO: 147490 - DNA, 22 bp, Artificial Sequence
  chemically synthesized
accaaaagaaggaggaagcaag

SEQ ID NO: 147491 - DNA, 22 bp, Artificial Sequence
  chemically synthesized
ccaaaagaaggaggaagcaagc

SEQ ID NO: 147492 - DNA, 22 bp, Artificial Sequence
  chemically synthesized
aaactgcagcaatagatttgtc

SEQ ID NO: 147493 - DNA, 22 bp, Artificial Sequence
  chemically synthesized
aactgcagcaatagatttgtcc

SEQ ID NO: 147494 - DNA, 22 bp, Artificial Sequence
  chemically synthesized
cagcaatagatttgtccattcc

SEQ ID NO: 147495 - DNA, 22 bp, Artificial Sequence
  chemically synthesized
gtccattccaacctctcaaaat

SEQ ID NO: 147496 - DNA, 22 bp, Artificial Sequence
  chemically synthesized
tccattccaacctctcaaaatt

SEQ ID NO: 147497 - DNA, 22 bp, Artificial Sequence
  chemically synthesized
caacctctcaaaattcccttgg

SEQ ID NO: 147498 - DNA, 22 bp, Artificial Sequence
  chemically synthesized
tcaaaattcccttggagacaaa

SEQ ID NO: 147499 - DNA, 22 bp, Artificial Sequence
  chemically synthesized
aaaattcccttggagacaaaaa

SEQ ID NO: 147500 - DNA, 22 bp, Artificial Sequence
  chemically synthesized
ccttggagacaaaaatctctag

SEQ ID NO: 147501 - DNA, 22 bp, Artificial Sequence
  chemically synthesized
ggagacaaaaatctctagaggc

SEQ ID NO: 147502 - DNA, 22 bp, Artificial Sequence
  chemically synthesized
gagacaaaaatctctagaggca

SEQ ID NO: 147503 - DNA, 22 bp, Artificial Sequence
  chemically synthesized
tagaggcaaagaagaactttat

SEQ ID NO: 147504 - DNA, 22 bp, Artificial Sequence
  chemically synthesized
gaggcaaagaagaactttatat

SEQ ID NO: 147505 - DNA, 22 bp, Artificial Sequence
  chemically synthesized
tatattgagtcaacttgttaaa

SEQ ID NO: 147506 - DNA, 22 bp, Artificial Sequence
  chemically synthesized
atattgagtcaacttgttaaaa

SEQ ID NO: 147507 - DNA, 22 bp, Artificial Sequence
  chemically synthesized
tattgagtcaacttgttaaaac

SEQ ID NO: 147508 - DNA, 22 bp, Artificial Sequence
  chemically synthesized
agtcaacttgttaaaacatctg

SEQ ID NO: 147509 - DNA, 22 bp, Artificial Sequence
  chemically synthesized
gttaaaacatctgcttttagat

SEQ ID NO: 147510 - DNA, 22 bp, Artificial Sequence
  chemically synthesized
ttaaaacatctgcttttagata

SEQ ID NO: 147511 - DNA, 22 bp, Artificial Sequence
  chemically synthesized
aaacatctgcttttagataagt

SEQ ID NO: 147512 - DNA, 22 bp, Artificial Sequence
  chemically synthesized
cttttagataagttttcttagt

SEQ ID NO: 147513 - DNA, 22 bp, Artificial Sequence
  chemically synthesized
ttagataagttttcttagtata

SEQ ID NO: 147514 - DNA, 22 bp, Artificial Sequence
  chemically synthesized
tagataagttttcttagtataa

SEQ ID NO: 147515 - DNA, 22 bp, Artificial Sequence
  chemically synthesized
agataagttttcttagtataaa

SEQ ID NO: 147516 - DNA, 22 bp, Artificial Sequence
  chemically synthesized
gataagttttcttagtataaag

SEQ ID NO: 147517 - DNA, 22 bp, Artificial Sequence
  chemically synthesized
tcttagtataaagtgacagaaa

SEQ ID NO: 147518 - DNA, 22 bp, Artificial Sequence
  chemically synthesized
cttagtataaagtgacagaaac

SEQ ID NO: 147519 - DNA, 22 bp, Artificial Sequence
  chemically synthesized
ttagtataaagtgacagaaaca

SEQ ID NO: 147520 - DNA, 22 bp, Artificial Sequence
  chemically synthesized
agtataaagtgacagaaacaaa

SEQ ID NO: 147521 - DNA, 22 bp, Artificial Sequence
  chemically synthesized
gtataaagtgacagaaacaaat

SEQ ID NO: 147522 - DNA, 22 bp, Artificial Sequence
  chemically synthesized
aactctaagatacattccacta

SEQ ID NO: 147523 - DNA, 22 bp, Artificial Sequence
  chemically synthesized
taagatacattccactatatta

SEQ ID NO: 147524 - DNA, 22 bp, Artificial Sequence
  chemically synthesized
agatacattccactatattagc

SEQ ID NO: 147525 - DNA, 22 bp, Artificial Sequence
  chemically synthesized
cactatattagcctaaaacact

SEQ ID NO: 147526 - DNA, 22 bp, Artificial Sequence
  chemically synthesized
tattagcctaaaacacttctgc

SEQ ID NO: 147527 - DNA, 22 bp, Artificial Sequence
  chemically synthesized
gcctaaaacacttctgcaaaaa

SEQ ID NO: 147528 - DNA, 22 bp, Artificial Sequence
  chemically synthesized
aaacacttctgcaaaaatgaaa

SEQ ID NO: 147529 - DNA, 22 bp, Artificial Sequence
  chemically synthesized
ctgcaaaaatgaaactaggagg

SEQ ID NO: 147530 - DNA, 22 bp, Artificial Sequence
  chemically synthesized
tgcaaaaatgaaactaggagga

SEQ ID NO: 147531 - DNA, 22 bp, Artificial Sequence
  chemically synthesized
caaaaatgaaactaggaggata

SEQ ID NO: 147532 - DNA, 22 bp, Artificial Sequence
  chemically synthesized
ggaggatatttttagaaacaac

SEQ ID NO: 147533 - DNA, 22 bp, Artificial Sequence
  chemically synthesized
ttagaaacaactgctgaaagag

SEQ ID NO: 147534 - DNA, 22 bp, Artificial Sequence
  chemically synthesized
tagaaacaactgctgaaagaga

SEQ ID NO: 147535 - DNA, 22 bp, Artificial Sequence
  chemically synthesized
agaaacaactgctgaaagagat

SEQ ID NO: 147536 - DNA, 22 bp, Artificial Sequence
  chemically synthesized
gaaacaactgctgaaagagatg

SEQ ID NO: 147537 - DNA, 22 bp, Artificial Sequence
  chemically synthesized
ctgaaagagatgcggtggggag

SEQ ID NO: 147538 - DNA, 22 bp, Artificial Sequence
  chemically synthesized
aaagagatgcggtggggagata

SEQ ID NO: 147539 - DNA, 22 bp, Artificial Sequence
  chemically synthesized
ctgagtcaagacacacatgaca

SEQ ID NO: 147540 - DNA, 22 bp, Artificial Sequence
  chemically synthesized
tgagtcaagacacacatgacag

SEQ ID NO: 147541 - DNA, 22 bp, Artificial Sequence
  chemically synthesized
agtcaagacacacatgacagaa

SEQ ID NO: 147542 - DNA, 22 bp, Artificial Sequence
  chemically synthesized
agggcaagttaagggaatagtg

SEQ ID NO: 147543 - DNA, 22 bp, Artificial Sequence
  chemically synthesized
agggaatagtggaatgaaggtt

SEQ ID NO: 147544 - DNA, 22 bp, Artificial Sequence
  chemically synthesized
atttttcattctcacaaactaa

SEQ ID NO: 147545 - DNA, 22 bp, Artificial Sequence
  chemically synthesized
ttcattctcacaaactaatgaa

SEQ ID NO: 147546 - DNA, 22 bp, Artificial Sequence
  chemically synthesized
tcattctcacaaactaatgaaa

SEQ ID NO: 147547 - DNA, 22 bp, Artificial Sequence
  chemically synthesized
cattctcacaaactaatgaaac

SEQ ID NO: 147548 - DNA, 22 bp, Artificial Sequence
  chemically synthesized
attctcacaaactaatgaaacc

SEQ ID NO: 147549 - DNA, 22 bp, Artificial Sequence
  chemically synthesized
tcacaaactaatgaaaccctgc

SEQ ID NO: 147550 - DNA, 22 bp, Artificial Sequence
  chemically synthesized
acaaactaatgaaaccctgctt

SEQ ID NO: 147551 - DNA, 22 bp, Artificial Sequence
  chemically synthesized
atgaaaccctgcttatcttaaa

SEQ ID NO: 147552 - DNA, 22 bp, Artificial Sequence
  chemically synthesized
cttatcttaaaccaacctgctc

SEQ ID NO: 147553 - DNA, 22 bp, Artificial Sequence
  chemically synthesized
atcttaaaccaacctgctcact

SEQ ID NO: 147554 - DNA, 22 bp, Artificial Sequence
  chemically synthesized
tcttaaaccaacctgctcactg

SEQ ID NO: 147555 - DNA, 22 bp, Artificial Sequence
  chemically synthesized
aaaccaacctgctcactggagc

SEQ ID NO: 147556 - DNA, 22 bp, Artificial Sequence
  chemically synthesized
aaccaacctgctcactggagca

SEQ ID NO: 147557 - DNA, 22 bp, Artificial Sequence
  chemically synthesized
ctcactggagcagggaggacag

SEQ ID NO: 147558 - DNA, 22 bp, Artificial Sequence
  chemically synthesized
actggagcagggaggacaggac

SEQ ID NO: 147559 - DNA, 22 bp, Artificial Sequence
  chemically synthesized
gagcagggaggacaggaccagc

SEQ ID NO: 147560 - DNA, 22 bp, Artificial Sequence
  chemically synthesized
ttgcttacactttcttctgaca

SEQ ID NO: 147561 - DNA, 22 bp, Artificial Sequence
  chemically synthesized
cttacactttcttctgacataa

SEQ ID NO: 147562 - DNA, 22 bp, Artificial Sequence
  chemically synthesized
acactttcttctgacataacag

SEQ ID NO: 147563 - DNA, 22 bp, Artificial Sequence
  chemically synthesized
cactttcttctgacataacagt

SEQ ID NO: 147564 - DNA, 22 bp, Artificial Sequence
  chemically synthesized
tcttctgacataacagtgttca

SEQ ID NO: 147565 - DNA, 22 bp, Artificial Sequence
  chemically synthesized
cttctgacataacagtgttcac

SEQ ID NO: 147566 - DNA, 22 bp, Artificial Sequence
  chemically synthesized
ttctgacataacagtgttcact

SEQ ID NO: 147567 - DNA, 22 bp, Artificial Sequence
  chemically synthesized
ctgacataacagtgttcactag

SEQ ID NO: 147568 - DNA, 22 bp, Artificial Sequence
  chemically synthesized
tgacataacagtgttcactagc

SEQ ID NO: 147569 - DNA, 22 bp, Artificial Sequence
  chemically synthesized
acataacagtgttcactagcaa

SEQ ID NO: 147570 - DNA, 22 bp, Artificial Sequence
  chemically synthesized
actagcaacctcaaacagacac

SEQ ID NO: 147571 - DNA, 22 bp, Artificial Sequence
  chemically synthesized
gcaacctcaaacagacaccatg

SEQ ID NO: 147572 - DNA, 22 bp, Artificial Sequence
  chemically synthesized
aaacagacaccatggtgcatct

SEQ ID NO: 147573 - DNA, 22 bp, Artificial Sequence
  chemically synthesized
actcctgaggagaagactgctg

SEQ ID NO: 147574 - DNA, 22 bp, Artificial Sequence
  chemically synthesized
ctgaggagaagactgctgtcaa

SEQ ID NO: 147575 - DNA, 22 bp, Artificial Sequence
  chemically synthesized
aggagaagactgctgtcaatgc

SEQ ID NO: 147576 - DNA, 22 bp, Artificial Sequence
  chemically synthesized
ctgtcaatgccctgtggggcaa

SEQ ID NO: 147577 - DNA, 22 bp, Artificial Sequence
  chemically synthesized
tcaatgccctgtggggcaaagt

SEQ ID NO: 147578 - DNA, 22 bp, Artificial Sequence
  chemically synthesized
tggggcaaagtgaacgtggatg

SEQ ID NO: 147579 - DNA, 22 bp, Artificial Sequence
  chemically synthesized
gtggtgaggccctgggcaggtt

SEQ ID NO: 147580 - DNA, 22 bp, Artificial Sequence
  chemically synthesized
ggcaggttggtatcaaggttat

SEQ ID NO: 147581 - DNA, 22 bp, Artificial Sequence
  chemically synthesized
gtatcaaggttataagagaggc

SEQ ID NO: 147582 - DNA, 22 bp, Artificial Sequence
  chemically synthesized
taagagaggctcaaggaggcaa

SEQ ID NO: 147583 - DNA, 22 bp, Artificial Sequence
  chemically synthesized
aaggaggcaaatggaaactggg

SEQ ID NO: 147584 - DNA, 22 bp, Artificial Sequence
  chemically synthesized
ggcatgtgtagacagagaagac

SEQ ID NO: 147585 - DNA, 22 bp, Artificial Sequence
  chemically synthesized
ttgggtttctgataggcactga

SEQ ID NO: 147586 - DNA, 22 bp, Artificial Sequence
  chemically synthesized
gggtttctgataggcactgact

SEQ ID NO: 147587 - DNA, 22 bp, Artificial Sequence
  chemically synthesized
ggtttctgataggcactgactc

SEQ ID NO: 147588 - DNA, 22 bp, Artificial Sequence
  chemically synthesized
ctgataggcactgactctctgt

SEQ ID NO: 147589 - DNA, 22 bp, Artificial Sequence
  chemically synthesized
tgataggcactgactctctgtc

SEQ ID NO: 147590 - DNA, 22 bp, Artificial Sequence
  chemically synthesized
ataggcactgactctctgtccc

SEQ ID NO: 147591 - DNA, 22 bp, Artificial Sequence
  chemically synthesized
actctctgtcccttgggctgtt

SEQ ID NO: 147592 - DNA, 22 bp, Artificial Sequence
  chemically synthesized
tctgtcccttgggctgttttcc

SEQ ID NO: 147593 - DNA, 22 bp, Artificial Sequence
  chemically synthesized
tgtcccttgggctgttttccta

SEQ ID NO: 147594 - DNA, 22 bp, Artificial Sequence
  chemically synthesized
tcccttgggctgttttcctacc

SEQ ID NO: 147595 - DNA, 22 bp, Artificial Sequence
  chemically synthesized
gggctgttttcctaccctcaga

SEQ ID NO: 147596 - DNA, 22 bp, Artificial Sequence
  chemically synthesized
ggctgttttcctaccctcagat

SEQ ID NO: 147597 - DNA, 22 bp, Artificial Sequence
  chemically synthesized
ttttcctaccctcagattactg

SEQ ID NO: 147598 - DNA, 22 bp, Artificial Sequence
  chemically synthesized
tcctaccctcagattactggtg

SEQ ID NO: 147599 - DNA, 22 bp, Artificial Sequence
  chemically synthesized
cctaccctcagattactggtgg

SEQ ID NO: 147600 - DNA, 22 bp, Artificial Sequence
  chemically synthesized
ctaccctcagattactggtggt

SEQ ID NO: 147601 - DNA, 22 bp, Artificial Sequence
  chemically synthesized
ccctcagattactggtggtcta

SEQ ID NO: 147602 - DNA, 22 bp, Artificial Sequence
  chemically synthesized
agattactggtggtctaccctt

SEQ ID NO: 147603 - DNA, 22 bp, Artificial Sequence
  chemically synthesized
ctggtggtctacccttggaccc

SEQ ID NO: 147604 - DNA, 22 bp, Artificial Sequence
  chemically synthesized
gtggtctacccttggacccaga

SEQ ID NO: 147605 - DNA, 22 bp, Artificial Sequence
  chemically synthesized
cccttggacccagaggttcttt

SEQ ID NO: 147606 - DNA, 22 bp, Artificial Sequence
  chemically synthesized
ggacccagaggttctttgagtc

SEQ ID NO: 147607 - DNA, 22 bp, Artificial Sequence
  chemically synthesized
gacccagaggttctttgagtcc

SEQ ID NO: 147608 - DNA, 22 bp, Artificial Sequence
  chemically synthesized
tttgagtcctttggggatctgt

SEQ ID NO: 147609 - DNA, 22 bp, Artificial Sequence
  chemically synthesized
tgagtcctttggggatctgtcc

SEQ ID NO: 147610 - DNA, 22 bp, Artificial Sequence
  chemically synthesized
gagtcctttggggatctgtcct

SEQ ID NO: 147611 - DNA, 22 bp, Artificial Sequence
  chemically synthesized
agtcctttggggatctgtcctc

SEQ ID NO: 147612 - DNA, 22 bp, Artificial Sequence
  chemically synthesized
tggggatctgtcctctcctgat

SEQ ID NO: 147613 - DNA, 22 bp, Artificial Sequence
  chemically synthesized
ggggatctgtcctctcctgatg

SEQ ID NO: 147614 - DNA, 22 bp, Artificial Sequence
  chemically synthesized
gggatctgtcctctcctgatgc

SEQ ID NO: 147615 - DNA, 22 bp, Artificial Sequence
  chemically synthesized
tcctctcctgatgctgttatgg

SEQ ID NO: 147616 - DNA, 22 bp, Artificial Sequence
  chemically synthesized
tcctgatgctgttatgggcaac

SEQ ID NO: 147617 - DNA, 22 bp, Artificial Sequence
  chemically synthesized
ctgatgctgttatgggcaaccc

SEQ ID NO: 147618 - DNA, 22 bp, Artificial Sequence
  chemically synthesized
atgctgttatgggcaaccctaa

SEQ ID NO: 147619 - DNA, 22 bp, Artificial Sequence
  chemically synthesized
ttatgggcaaccctaaggtgaa

SEQ ID NO: 147620 - DNA, 22 bp, Artificial Sequence
  chemically synthesized
tgggcaaccctaaggtgaaggc

SEQ ID NO: 147621 - DNA, 22 bp, Artificial Sequence
  chemically synthesized
aggtgaaggctcatggcaagaa

SEQ ID NO: 147622 - DNA, 22 bp, Artificial Sequence
  chemically synthesized
atggcaagaaggtgctaggtgc

SEQ ID NO: 147623 - DNA, 22 bp, Artificial Sequence
  chemically synthesized
ggtgcctttagtgatggcctgg

SEQ ID NO: 147624 - DNA, 22 bp, Artificial Sequence
  chemically synthesized
tagtgatggcctggctcacctg

SEQ ID NO: 147625 - DNA, 22 bp, Artificial Sequence
  chemically synthesized
agtgatggcctggctcacctgg

SEQ ID NO: 147626 - DNA, 22 bp, Artificial Sequence
  chemically synthesized
gtgatggcctggctcacctgga

SEQ ID NO: 147627 - DNA, 22 bp, Artificial Sequence
  chemically synthesized
gctcacctggacaacctcaagg

SEQ ID NO: 147628 - DNA, 22 bp, Artificial Sequence
  chemically synthesized
acctggacaacctcaagggcac

SEQ ID NO: 147629 - DNA, 22 bp, Artificial Sequence
  chemically synthesized
gacaacctcaagggcacttttt

SEQ ID NO: 147630 - DNA, 22 bp, Artificial Sequence
  chemically synthesized
aagggcactttttctcagctga

SEQ ID NO: 147631 - DNA, 22 bp, Artificial Sequence
  chemically synthesized
tttctcagctgagtgagctgca

SEQ ID NO: 147632 - DNA, 22 bp, Artificial Sequence
  chemically synthesized
ttctcagctgagtgagctgcac

SEQ ID NO: 147633 - DNA, 22 bp, Artificial Sequence
  chemically synthesized
tctcagctgagtgagctgcact

SEQ ID NO: 147634 - DNA, 22 bp, Artificial Sequence
  chemically synthesized
ctcagctgagtgagctgcactg

SEQ ID NO: 147635 - DNA, 22 bp, Artificial Sequence
  chemically synthesized
tcagctgagtgagctgcactgt

SEQ ID NO: 147636 - DNA, 22 bp, Artificial Sequence
  chemically synthesized
agctgagtgagctgcactgtga

SEQ ID NO: 147637 - DNA, 22 bp, Artificial Sequence
  chemically synthesized
agtgagctgcactgtgacaagc

SEQ ID NO: 147638 - DNA, 22 bp, Artificial Sequence
  chemically synthesized
cactgtgacaagctgcacgtgg

SEQ ID NO: 147639 - DNA, 22 bp, Artificial Sequence
  chemically synthesized
tgacaagctgcacgtggatcct

SEQ ID NO: 147640 - DNA, 22 bp, Artificial Sequence
  chemically synthesized
cacgtggatcctgagaacttca

SEQ ID NO: 147641 - DNA, 22 bp, Artificial Sequence
  chemically synthesized
agaacttcagggtgagtccagg

SEQ ID NO: 147642 - DNA, 22 bp, Artificial Sequence
  chemically synthesized
cagggtgagtccaggagatgct

SEQ ID NO: 147643 - DNA, 22 bp, Artificial Sequence
  chemically synthesized
agggtgagtccaggagatgctt

SEQ ID NO: 147644 - DNA, 22 bp, Artificial Sequence
  chemically synthesized
cacttttctctttttactttct

SEQ ID NO: 147645 - DNA, 22 bp, Artificial Sequence
  chemically synthesized
acttttctctttttactttcta

SEQ ID NO: 147646 - DNA, 22 bp, Artificial Sequence
  chemically synthesized
ttctctttttactttctaatct

SEQ ID NO: 147647 - DNA, 22 bp, Artificial Sequence
  chemically synthesized
tctctttttactttctaatctt

SEQ ID NO: 147648 - DNA, 22 bp, Artificial Sequence
  chemically synthesized
ctctttttactttctaatctta

SEQ ID NO: 147649 - DNA, 22 bp, Artificial Sequence
  chemically synthesized
tctttttactttctaatcttac

SEQ ID NO: 147650 - DNA, 22 bp, Artificial Sequence
  chemically synthesized
tttttactttctaatcttacat

SEQ ID NO: 147651 - DNA, 22 bp, Artificial Sequence
  chemically synthesized
tttactttctaatcttacattt

SEQ ID NO: 147652 - DNA, 22 bp, Artificial Sequence
  chemically synthesized
ttactttctaatcttacatttt

SEQ ID NO: 147653 - DNA, 22 bp, Artificial Sequence
  chemically synthesized
tactttctaatcttacattttg

SEQ ID NO: 147654 - DNA, 22 bp, Artificial Sequence
  chemically synthesized
actttctaatcttacattttgg

SEQ ID NO: 147655 - DNA, 22 bp, Artificial Sequence
  chemically synthesized
ctttctaatcttacattttggt

SEQ ID NO: 147656 - DNA, 22 bp, Artificial Sequence
  chemically synthesized
tctaatcttacattttggttct

SEQ ID NO: 147657 - DNA, 22 bp, Artificial Sequence
  chemically synthesized
ctaatcttacattttggttctt

SEQ ID NO: 147658 - DNA, 22 bp, Artificial Sequence
  chemically synthesized
taatcttacattttggttcttt

SEQ ID NO: 147659 - DNA, 22 bp, Artificial Sequence
  chemically synthesized
atcttacattttggttctttta

SEQ ID NO: 147660 - DNA, 22 bp, Artificial Sequence
  chemically synthesized
acattttggttcttttacctac

SEQ ID NO: 147661 - DNA, 22 bp, Artificial Sequence
  chemically synthesized
cattttggttcttttacctacc

SEQ ID NO: 147662 - DNA, 22 bp, Artificial Sequence
  chemically synthesized
tggttcttttacctacctgctc

SEQ ID NO: 147663 - DNA, 22 bp, Artificial Sequence
  chemically synthesized
ggttcttttacctacctgctct

SEQ ID NO: 147664 - DNA, 22 bp, Artificial Sequence
  chemically synthesized
gttcttttacctacctgctctt

SEQ ID NO: 147665 - DNA, 22 bp, Artificial Sequence
  chemically synthesized
ttttacctacctgctcttctcc

SEQ ID NO: 147666 - DNA, 22 bp, Artificial Sequence
  chemically synthesized
ttacctacctgctcttctccca

SEQ ID NO: 147667 - DNA, 22 bp, Artificial Sequence
  chemically synthesized
tacctacctgctcttctcccac

SEQ ID NO: 147668 - DNA, 22 bp, Artificial Sequence
  chemically synthesized
acctacctgctcttctcccaca

SEQ ID NO: 147669 - DNA, 22 bp, Artificial Sequence
  chemically synthesized
cctacctgctcttctcccacat

SEQ ID NO: 147670 - DNA, 22 bp, Artificial Sequence
  chemically synthesized
cctgctcttctcccacattttt

SEQ ID NO: 147671 - DNA, 22 bp, Artificial Sequence
  chemically synthesized
ctcttctcccacatttttgtca

SEQ ID NO: 147672 - DNA, 22 bp, Artificial Sequence
  chemically synthesized
ttctcccacatttttgtcattt

SEQ ID NO: 147673 - DNA, 22 bp, Artificial Sequence
  chemically synthesized
ctcccacatttttgtcatttta

SEQ ID NO: 147674 - DNA, 22 bp, Artificial Sequence
  chemically synthesized
tcccacatttttgtcattttac

SEQ ID NO: 147675 - DNA, 22 bp, Artificial Sequence
  chemically synthesized
ccacatttttgtcattttacta

SEQ ID NO: 147676 - DNA, 22 bp, Artificial Sequence
  chemically synthesized
ttgtcattttactatattttat

SEQ ID NO: 147677 - DNA, 22 bp, Artificial Sequence
  chemically synthesized
tgtcattttactatattttatc

SEQ ID NO: 147678 - DNA, 22 bp, Artificial Sequence
  chemically synthesized
gtcattttactatattttatca

SEQ ID NO: 147679 - DNA, 22 bp, Artificial Sequence
  chemically synthesized
tcattttactatattttatcat

SEQ ID NO: 147680 - DNA, 22 bp, Artificial Sequence
  chemically synthesized
tactatattttatcatttaatg

SEQ ID NO: 147681 - DNA, 22 bp, Artificial Sequence
  chemically synthesized
actatattttatcatttaatgc

SEQ ID NO: 147682 - DNA, 22 bp, Artificial Sequence
  chemically synthesized
ctatattttatcatttaatgct

SEQ ID NO: 147683 - DNA, 22 bp, Artificial Sequence
  chemically synthesized
tattttatcatttaatgcttct

SEQ ID NO: 147684 - DNA, 22 bp, Artificial Sequence
  chemically synthesized
tatcatttaatgcttctaaaat

SEQ ID NO: 147685 - DNA, 22 bp, Artificial Sequence
  chemically synthesized
atcatttaatgcttctaaaatt

SEQ ID NO: 147686 - DNA, 22 bp, Artificial Sequence
  chemically synthesized
tcatttaatgcttctaaaattt

SEQ ID NO: 147687 - DNA, 22 bp, Artificial Sequence
  chemically synthesized
aatgcttctaaaattttgttaa

SEQ ID NO: 147688 - DNA, 22 bp, Artificial Sequence
  chemically synthesized
atgcttctaaaattttgttaat

SEQ ID NO: 147689 - DNA, 22 bp, Artificial Sequence
  chemically synthesized
ctaaaattttgttaatttttta

SEQ ID NO: 147690 - DNA, 22 bp, Artificial Sequence
  chemically synthesized
taaaattttgttaattttttat

SEQ ID NO: 147691 - DNA, 22 bp, Artificial Sequence
  chemically synthesized
aaattttgttaattttttattt

SEQ ID NO: 147692 - DNA, 22 bp, Artificial Sequence
  chemically synthesized
tgttaattttttatttaaatat

SEQ ID NO: 147693 - DNA, 22 bp, Artificial Sequence
  chemically synthesized
gttaattttttatttaaatatt

SEQ ID NO: 147694 - DNA, 22 bp, Artificial Sequence
  chemically synthesized
ttaattttttatttaaatattc

SEQ ID NO: 147695 - DNA, 22 bp, Artificial Sequence
  chemically synthesized
attttttatttaaatattctgc

SEQ ID NO: 147696 - DNA, 22 bp, Artificial Sequence
  chemically synthesized
tttatttaaatattctgcattt

SEQ ID NO: 147697 - DNA, 22 bp, Artificial Sequence
  chemically synthesized
ttatttaaatattctgcatttt

SEQ ID NO: 147698 - DNA, 22 bp, Artificial Sequence
  chemically synthesized
tatttaaatattctgcattttt

SEQ ID NO: 147699 - DNA, 22 bp, Artificial Sequence
  chemically synthesized
atttaaatattctgcatttttt

SEQ ID NO: 147700 - DNA, 22 bp, Artificial Sequence
  chemically synthesized
tttaaatattctgcattttttc

SEQ ID NO: 147701 - DNA, 22 bp, Artificial Sequence
  chemically synthesized
aaatattctgcattttttcctt

SEQ ID NO: 147702 - DNA, 22 bp, Artificial Sequence
  chemically synthesized
aatattctgcattttttccttc

SEQ ID NO: 147703 - DNA, 22 bp, Artificial Sequence
  chemically synthesized
tgcattttttccttcctcacaa

SEQ ID NO: 147704 - DNA, 22 bp, Artificial Sequence
  chemically synthesized
cattttttccttcctcacaatc

SEQ ID NO: 147705 - DNA, 22 bp, Artificial Sequence
  chemically synthesized
tttccttcctcacaatcttgct

SEQ ID NO: 147706 - DNA, 22 bp, Artificial Sequence
  chemically synthesized
ttccttcctcacaatcttgcta

SEQ ID NO: 147707 - DNA, 22 bp, Artificial Sequence
  chemically synthesized
tccttcctcacaatcttgctat

SEQ ID NO: 147708 - DNA, 22 bp, Artificial Sequence
  chemically synthesized
ccttcctcacaatcttgctatt

SEQ ID NO: 147709 - DNA, 22 bp, Artificial Sequence
  chemically synthesized
cttcctcacaatcttgctattt

SEQ ID NO: 147710 - DNA, 22 bp, Artificial Sequence
  chemically synthesized
cctcacaatcttgctattttaa

SEQ ID NO: 147711 - DNA, 22 bp, Artificial Sequence
  chemically synthesized
ctcacaatcttgctattttaaa

SEQ ID NO: 147712 - DNA, 22 bp, Artificial Sequence
  chemically synthesized
acaatcttgctattttaaatta

SEQ ID NO: 147713 - DNA, 22 bp, Artificial Sequence
  chemically synthesized
gctattttaaattatttaatat

SEQ ID NO: 147714 - DNA, 22 bp, Artificial Sequence
  chemically synthesized
ctattttaaattatttaatatc

SEQ ID NO: 147715 - DNA, 22 bp, Artificial Sequence
  chemically synthesized
ttttaaattatttaatatcctg

SEQ ID NO: 147716 - DNA, 22 bp, Artificial Sequence
  chemically synthesized
taaattatttaatatcctgtct

SEQ ID NO: 147717 - DNA, 22 bp, Artificial Sequence
  chemically synthesized
aaattatttaatatcctgtctt

SEQ ID NO: 147718 - DNA, 22 bp, Artificial Sequence
  chemically synthesized
aattatttaatatcctgtcttt

SEQ ID NO: 147719 - DNA, 22 bp, Artificial Sequence
  chemically synthesized
tttaatatcctgtctttctctc

SEQ ID NO: 147720 - DNA, 22 bp, Artificial Sequence
  chemically synthesized
aatatcctgtctttctctccca

SEQ ID NO: 147721 - DNA, 22 bp, Artificial Sequence
  chemically synthesized
atatcctgtctttctctcccaa

SEQ ID NO: 147722 - DNA, 22 bp, Artificial Sequence
  chemically synthesized
tctttctctcccaaccccctcc

SEQ ID NO: 147723 - DNA, 22 bp, Artificial Sequence
  chemically synthesized
tctctcccaaccccctcccttc

SEQ ID NO: 147724 - DNA, 22 bp, Artificial Sequence
  chemically synthesized
ctctcccaaccccctcccttca

SEQ ID NO: 147725 - DNA, 22 bp, Artificial Sequence
  chemically synthesized
tctcccaaccccctcccttcat

SEQ ID NO: 147726 - DNA, 22 bp, Artificial Sequence
  chemically synthesized
tcccaaccccctcccttcattt

SEQ ID NO: 147727 - DNA, 22 bp, Artificial Sequence
  chemically synthesized
ccaaccccctcccttcattttt

SEQ ID NO: 147728 - DNA, 22 bp, Artificial Sequence
  chemically synthesized
ccttcatttttccttctctaac

SEQ ID NO: 147729 - DNA, 22 bp, Artificial Sequence
  chemically synthesized
catttttccttctctaacaaca

SEQ ID NO: 147730 - DNA, 22 bp, Artificial Sequence
  chemically synthesized
atttttccttctctaacaacaa

SEQ ID NO: 147731 - DNA, 22 bp, Artificial Sequence
  chemically synthesized
ttccttctctaacaacaactca

SEQ ID NO: 147732 - DNA, 22 bp, Artificial Sequence
  chemically synthesized
tccttctctaacaacaactcaa

SEQ ID NO: 147733 - DNA, 22 bp, Artificial Sequence
  chemically synthesized
ccttctctaacaacaactcaaa

SEQ ID NO: 147734 - DNA, 22 bp, Artificial Sequence
  chemically synthesized
cttctctaacaacaactcaaat

SEQ ID NO: 147735 - DNA, 22 bp, Artificial Sequence
  chemically synthesized
ctctaacaacaactcaaattat

SEQ ID NO: 147736 - DNA, 22 bp, Artificial Sequence
  chemically synthesized
tctaacaacaactcaaattatg

SEQ ID NO: 147737 - DNA, 22 bp, Artificial Sequence
  chemically synthesized
taacaacaactcaaattatgca

SEQ ID NO: 147738 - DNA, 22 bp, Artificial Sequence
  chemically synthesized
acaacaactcaaattatgcata

SEQ ID NO: 147739 - DNA, 22 bp, Artificial Sequence
  chemically synthesized
aaattatgcataccagctctca

SEQ ID NO: 147740 - DNA, 22 bp, Artificial Sequence
  chemically synthesized
tgcataccagctctcacctgct

SEQ ID NO: 147741 - DNA, 22 bp, Artificial Sequence
  chemically synthesized
tcacctgctaattctgcactta

SEQ ID NO: 147742 - DNA, 22 bp, Artificial Sequence
  chemically synthesized
acctgctaattctgcacttaga

SEQ ID NO: 147743 - DNA, 22 bp, Artificial Sequence
  chemically synthesized
ctaattctgcacttagaataat

SEQ ID NO: 147744 - DNA, 22 bp, Artificial Sequence
  chemically synthesized
attctgcacttagaataatcct

SEQ ID NO: 147745 - DNA, 22 bp, Artificial Sequence
  chemically synthesized
tgcacttagaataatccttttg

SEQ ID NO: 147746 - DNA, 22 bp, Artificial Sequence
  chemically synthesized
cacttagaataatccttttgtc

SEQ ID NO: 147747 - DNA, 22 bp, Artificial Sequence
  chemically synthesized
agaataatccttttgtctctcc

SEQ ID NO: 147748 - DNA, 22 bp, Artificial Sequence
  chemically synthesized
gaataatccttttgtctctcca

SEQ ID NO: 147749 - DNA, 22 bp, Artificial Sequence
  chemically synthesized
ttgtctctccacatgggtatgg

SEQ ID NO: 147750 - DNA, 22 bp, Artificial Sequence
  chemically synthesized
tgtctctccacatgggtatggg

SEQ ID NO: 147751 - DNA, 22 bp, Artificial Sequence
  chemically synthesized
gtctctccacatgggtatggga

SEQ ID NO: 147752 - DNA, 22 bp, Artificial Sequence
  chemically synthesized
tctctccacatgggtatgggag

SEQ ID NO: 147753 - DNA, 22 bp, Artificial Sequence
  chemically synthesized
tccacatgggtatgggagaggc

SEQ ID NO: 147754 - DNA, 22 bp, Artificial Sequence
  chemically synthesized
cacatgggtatgggagaggctc

SEQ ID NO: 147755 - DNA, 22 bp, Artificial Sequence
  chemically synthesized
caactcaaagatgagaggcata

SEQ ID NO: 147756 - DNA, 22 bp, Artificial Sequence
  chemically synthesized
aaagatgagaggcatagaatac

SEQ ID NO: 147757 - DNA, 22 bp, Artificial Sequence
  chemically synthesized
ttttagaggctataaatcattt

SEQ ID NO: 147758 - DNA, 22 bp, Artificial Sequence
  chemically synthesized
tagaggctataaatcattttac

SEQ ID NO: 147759 - DNA, 22 bp, Artificial Sequence
  chemically synthesized
agaggctataaatcattttaca

SEQ ID NO: 147760 - DNA, 22 bp, Artificial Sequence
  chemically synthesized
gaggctataaatcattttacaa

SEQ ID NO: 147761 - DNA, 22 bp, Artificial Sequence
  chemically synthesized
taaatcattttacaataaggaa

SEQ ID NO: 147762 - DNA, 22 bp, Artificial Sequence
  chemically synthesized
tacaataaggaataattggaat

SEQ ID NO: 147763 - DNA, 22 bp, Artificial Sequence
  chemically synthesized
acaataaggaataattggaatt

SEQ ID NO: 147764 - DNA, 22 bp, Artificial Sequence
  chemically synthesized
caataaggaataattggaattt

SEQ ID NO: 147765 - DNA, 22 bp, Artificial Sequence
  chemically synthesized
gaattttataaattctgtagta

SEQ ID NO: 147766 - DNA, 22 bp, Artificial Sequence
  chemically synthesized
tataaattctgtagtaaatgga

SEQ ID NO: 147767 - DNA, 22 bp, Artificial Sequence
  chemically synthesized
ataaattctgtagtaaatggaa

SEQ ID NO: 147768 - DNA, 22 bp, Artificial Sequence
  chemically synthesized
taaattctgtagtaaatggaat

SEQ ID NO: 147769 - DNA, 22 bp, Artificial Sequence
  chemically synthesized
tgtagtaaatggaatggaaagg

SEQ ID NO: 147770 - DNA, 22 bp, Artificial Sequence
  chemically synthesized
tagtaaatggaatggaaaggaa

SEQ ID NO: 147771 - DNA, 22 bp, Artificial Sequence
  chemically synthesized
gattatgaaagactaggcagtt

SEQ ID NO: 147772 - DNA, 22 bp, Artificial Sequence
  chemically synthesized
attatgaaagactaggcagtta

SEQ ID NO: 147773 - DNA, 22 bp, Artificial Sequence
  chemically synthesized
tgaaagactaggcagttacact

SEQ ID NO: 147774 - DNA, 22 bp, Artificial Sequence
  chemically synthesized
ggcagttacactggaggtgggg

SEQ ID NO: 147775 - DNA, 22 bp, Artificial Sequence
  chemically synthesized
cactggaggtggggcagaagtc

SEQ ID NO: 147776 - DNA, 22 bp, Artificial Sequence
  chemically synthesized
gaggtggggcagaagtcgttgc

SEQ ID NO: 147777 - DNA, 22 bp, Artificial Sequence
  chemically synthesized
ctaggagacagcccatcatcac

SEQ ID NO: 147778 - DNA, 22 bp, Artificial Sequence
  chemically synthesized
ggagacagcccatcatcacact

SEQ ID NO: 147779 - DNA, 22 bp, Artificial Sequence
  chemically synthesized
attaatcaattaatttgtatct

SEQ ID NO: 147780 - DNA, 22 bp, Artificial Sequence
  chemically synthesized
atcaattaatttgtatctatta

SEQ ID NO: 147781 - DNA, 22 bp, Artificial Sequence
  chemically synthesized
atttgtatctattaatctgttt

SEQ ID NO: 147782 - DNA, 22 bp, Artificial Sequence
  chemically synthesized
gtatctattaatctgtttatag

SEQ ID NO: 147783 - DNA, 22 bp, Artificial Sequence
  chemically synthesized
tatctattaatctgtttatagt

SEQ ID NO: 147784 - DNA, 22 bp, Artificial Sequence
  chemically synthesized
ttaatctgtttatagtaattaa

SEQ ID NO: 147785 - DNA, 22 bp, Artificial Sequence
  chemically synthesized
atctgtttatagtaattaattt

SEQ ID NO: 147786 - DNA, 22 bp, Artificial Sequence
  chemically synthesized
tttatagtaattaatttgtata

SEQ ID NO: 147787 - DNA, 22 bp, Artificial Sequence
  chemically synthesized
atagtaattaatttgtatatgc

SEQ ID NO: 147788 - DNA, 22 bp, Artificial Sequence
  chemically synthesized
tagtaattaatttgtatatgct

SEQ ID NO: 147789 - DNA, 22 bp, Artificial Sequence
  chemically synthesized
atttgtatatgctatatacaca

SEQ ID NO: 147790 - DNA, 22 bp, Artificial Sequence
  chemically synthesized
gtatatgctatatacacataca

SEQ ID NO: 147791 - DNA, 22 bp, Artificial Sequence
  chemically synthesized
tatatgctatatacacatacaa

SEQ ID NO: 147792 - DNA, 22 bp, Artificial Sequence
  chemically synthesized
tatacacatacaaaattaaaac

SEQ ID NO: 147793 - DNA, 22 bp, Artificial Sequence
  chemically synthesized
aaactaatttggaattaatttg

SEQ ID NO: 147794 - DNA, 22 bp, Artificial Sequence
  chemically synthesized
atttggaattaatttgtatata

SEQ ID NO: 147795 - DNA, 22 bp, Artificial Sequence
  chemically synthesized
ggaattaatttgtatatagtat

SEQ ID NO: 147796 - DNA, 22 bp, Artificial Sequence
  chemically synthesized
gaattaatttgtatatagtatt

SEQ ID NO: 147797 - DNA, 22 bp, Artificial Sequence
  chemically synthesized
atttgtatatagtattatacag

SEQ ID NO: 147798 - DNA, 22 bp, Artificial Sequence
  chemically synthesized
gtatatagtattatacagcata

SEQ ID NO: 147799 - DNA, 22 bp, Artificial Sequence
  chemically synthesized
tatatagtattatacagcatat

SEQ ID NO: 147800 - DNA, 22 bp, Artificial Sequence
  chemically synthesized
tacagcatatatagcatatatg

SEQ ID NO: 147801 - DNA, 22 bp, Artificial Sequence
  chemically synthesized
catgctagttaagtacatagag

SEQ ID NO: 147802 - DNA, 22 bp, Artificial Sequence
  chemically synthesized
gttaagtacatagaggatgtgt

SEQ ID NO: 147803 - DNA, 22 bp, Artificial Sequence
  chemically synthesized
agtacatagaggatgtgtgtgt

SEQ ID NO: 147804 - DNA, 22 bp, Artificial Sequence
  chemically synthesized
tatgtatgcattcatatatgta

SEQ ID NO: 147805 - DNA, 22 bp, Artificial Sequence
  chemically synthesized
atatatgtacttatttatgctg

SEQ ID NO: 147806 - DNA, 22 bp, Artificial Sequence
  chemically synthesized
atttatgctgatgggaataacc

SEQ ID NO: 147807 - DNA, 22 bp, Artificial Sequence
  chemically synthesized
tttatgctgatgggaataacct

SEQ ID NO: 147808 - DNA, 22 bp, Artificial Sequence
  chemically synthesized
atgctgatgggaataacctggg

SEQ ID NO: 147809 - DNA, 22 bp, Artificial Sequence
  chemically synthesized
tgctgatgggaataacctgggg

SEQ ID NO: 147810 - DNA, 22 bp, Artificial Sequence
  chemically synthesized
atgggaataacctggggatcag

SEQ ID NO: 147811 - DNA, 22 bp, Artificial Sequence
  chemically synthesized
gggatcagttttgtctaagatt

SEQ ID NO: 147812 - DNA, 22 bp, Artificial Sequence
  chemically synthesized
tgtctaagatttgggcagaaaa

SEQ ID NO: 147813 - DNA, 22 bp, Artificial Sequence
  chemically synthesized
gtctaagatttgggcagaaaaa

SEQ ID NO: 147814 - DNA, 22 bp, Artificial Sequence
  chemically synthesized
tctaagatttgggcagaaaaaa

SEQ ID NO: 147815 - DNA, 22 bp, Artificial Sequence
  chemically synthesized
agatttgggcagaaaaaaatgg

SEQ ID NO: 147816 - DNA, 22 bp, Artificial Sequence
  chemically synthesized
gggcagaaaaaaatgggtgttg

SEQ ID NO: 147817 - DNA, 22 bp, Artificial Sequence
  chemically synthesized
ggcagaaaaaaatgggtgttgg

SEQ ID NO: 147818 - DNA, 22 bp, Artificial Sequence
  chemically synthesized
gctcagtttctcagaagccagt

SEQ ID NO: 147819 - DNA, 22 bp, Artificial Sequence
  chemically synthesized
agtttctcagaagccagtcttt

SEQ ID NO: 147820 - DNA, 22 bp, Artificial Sequence
  chemically synthesized
ctcagaagccagtctttatttc

SEQ ID NO: 147821 - DNA, 22 bp, Artificial Sequence
  chemically synthesized
tcagaagccagtctttatttct

SEQ ID NO: 147822 - DNA, 22 bp, Artificial Sequence
  chemically synthesized
agaagccagtctttatttctct

SEQ ID NO: 147823 - DNA, 22 bp, Artificial Sequence
  chemically synthesized
tatttctctgttaaccatatgc

SEQ ID NO: 147824 - DNA, 22 bp, Artificial Sequence
  chemically synthesized
atttctctgttaaccatatgca

SEQ ID NO: 147825 - DNA, 22 bp, Artificial Sequence
  chemically synthesized
tttctctgttaaccatatgcat

SEQ ID NO: 147826 - DNA, 22 bp, Artificial Sequence
  chemically synthesized
ctctgttaaccatatgcatgta

SEQ ID NO: 147827 - DNA, 22 bp, Artificial Sequence
  chemically synthesized
tctgttaaccatatgcatgtat

SEQ ID NO: 147828 - DNA, 22 bp, Artificial Sequence
  chemically synthesized
tgttaaccatatgcatgtatct

SEQ ID NO: 147829 - DNA, 22 bp, Artificial Sequence
  chemically synthesized
ttaaccatatgcatgtatctgc

SEQ ID NO: 147830 - DNA, 22 bp, Artificial Sequence
  chemically synthesized
accatatgcatgtatctgccta

SEQ ID NO: 147831 - DNA, 22 bp, Artificial Sequence
  chemically synthesized
cctacctcttctccgcagctct

SEQ ID NO: 147832 - DNA, 22 bp, Artificial Sequence
  chemically synthesized
cctcttctccgcagctcttggg

SEQ ID NO: 147833 - DNA, 22 bp, Artificial Sequence
  chemically synthesized
ttctccgcagctcttgggcaat

SEQ ID NO: 147834 - DNA, 22 bp, Artificial Sequence
  chemically synthesized
ctccgcagctcttgggcaatgt

SEQ ID NO: 147835 - DNA, 22 bp, Artificial Sequence
  chemically synthesized
tccgcagctcttgggcaatgtg

SEQ ID NO: 147836 - DNA, 22 bp, Artificial Sequence
  chemically synthesized
cgcagctcttgggcaatgtgct

SEQ ID NO: 147837 - DNA, 22 bp, Artificial Sequence
  chemically synthesized
ttgggcaatgtgctggtgtgtg

SEQ ID NO: 147838 - DNA, 22 bp, Artificial Sequence
  chemically synthesized
gggcaatgtgctggtgtgtgtg

SEQ ID NO: 147839 - DNA, 22 bp, Artificial Sequence
  chemically synthesized
ggcaatgtgctggtgtgtgtgc

SEQ ID NO: 147840 - DNA, 22 bp, Artificial Sequence
  chemically synthesized
gtgtgtgtgctggcccgcaact

SEQ ID NO: 147841 - DNA, 22 bp, Artificial Sequence
  chemically synthesized
gcccgcaactttggcaaggaat

SEQ ID NO: 147842 - DNA, 22 bp, Artificial Sequence
  chemically synthesized
tggcaaggaattcaccccacaa

SEQ ID NO: 147843 - DNA, 22 bp, Artificial Sequence
  chemically synthesized
ggcaaggaattcaccccacaaa

SEQ ID NO: 147844 - DNA, 22 bp, Artificial Sequence
  chemically synthesized
gcaaggaattcaccccacaaat

SEQ ID NO: 147845 - DNA, 22 bp, Artificial Sequence
  chemically synthesized
accccacaaatgcaggctgcct

SEQ ID NO: 147846 - DNA, 22 bp, Artificial Sequence
  chemically synthesized
cctatcagaaggtggtggctgg

SEQ ID NO: 147847 - DNA, 22 bp, Artificial Sequence
  chemically synthesized
tcagaaggtggtggctggtgtg

SEQ ID NO: 147848 - DNA, 22 bp, Artificial Sequence
  chemically synthesized
gtgtggctaatgccctggctca

SEQ ID NO: 147849 - DNA, 22 bp, Artificial Sequence
  chemically synthesized
atgccctggctcacaagtacca

SEQ ID NO: 147850 - DNA, 22 bp, Artificial Sequence
  chemically synthesized
gctcacaagtaccattgagatc

SEQ ID NO: 147851 - DNA, 22 bp, Artificial Sequence
  chemically synthesized
acaagtaccattgagatcctgg

SEQ ID NO: 147852 - DNA, 22 bp, Artificial Sequence
  chemically synthesized
agatcctggactgtttcctgat

SEQ ID NO: 147853 - DNA, 22 bp, Artificial Sequence
  chemically synthesized
gactgtttcctgataaccataa

SEQ ID NO: 147854 - DNA, 22 bp, Artificial Sequence
  chemically synthesized
tttcctgataaccataagaaga

SEQ ID NO: 147855 - DNA, 22 bp, Artificial Sequence
  chemically synthesized
cctgataaccataagaagaccc

SEQ ID NO: 147856 - DNA, 22 bp, Artificial Sequence
  chemically synthesized
ctgataaccataagaagaccct

SEQ ID NO: 147857 - DNA, 22 bp, Artificial Sequence
  chemically synthesized
ataaccataagaagaccctatt

SEQ ID NO: 147858 - DNA, 22 bp, Artificial Sequence
  chemically synthesized
tttccctagattctattttctg

SEQ ID NO: 147859 - DNA, 22 bp, Artificial Sequence
  chemically synthesized
ccctagattctattttctgaac

SEQ ID NO: 147860 - DNA, 22 bp, Artificial Sequence
  chemically synthesized
cctagattctattttctgaact

SEQ ID NO: 147861 - DNA, 22 bp, Artificial Sequence
  chemically synthesized
gattctattttctgaacttggg

SEQ ID NO: 147862 - DNA, 22 bp, Artificial Sequence
  chemically synthesized
tattttctgaacttgggaacac

SEQ ID NO: 147863 - DNA, 22 bp, Artificial Sequence
  chemically synthesized
ttttctgaacttgggaacacaa

SEQ ID NO: 147864 - DNA, 22 bp, Artificial Sequence
  chemically synthesized
tctgaacttgggaacacaatgc

SEQ ID NO: 147865 - DNA, 22 bp, Artificial Sequence
  chemically synthesized
ctgaacttgggaacacaatgcc

SEQ ID NO: 147866 - DNA, 22 bp, Artificial Sequence
  chemically synthesized
tgaacttgggaacacaatgcct

SEQ ID NO: 147867 - DNA, 22 bp, Artificial Sequence
  chemically synthesized
aacttgggaacacaatgcctac

SEQ ID NO: 147868 - DNA, 22 bp, Artificial Sequence
  chemically synthesized
gggaacacaatgcctacttcaa

SEQ ID NO: 147869 - DNA, 22 bp, Artificial Sequence
  chemically synthesized
ggaacacaatgcctacttcaag

SEQ ID NO: 147870 - DNA, 22 bp, Artificial Sequence
  chemically synthesized
cttcaagggtatggcttctgcc

SEQ ID NO: 147871 - DNA, 22 bp, Artificial Sequence
  chemically synthesized
caagggtatggcttctgcctaa

SEQ ID NO: 147872 - DNA, 22 bp, Artificial Sequence
  chemically synthesized
aagggtatggcttctgcctaat

SEQ ID NO: 147873 - DNA, 22 bp, Artificial Sequence
  chemically synthesized
ctgcctaataaagaatgttcag

SEQ ID NO: 147874 - DNA, 22 bp, Artificial Sequence
  chemically synthesized
tgcctaataaagaatgttcagc

SEQ ID NO: 147875 - DNA, 22 bp, Artificial Sequence
  chemically synthesized
cctaataaagaatgttcagctc

SEQ ID NO: 147876 - DNA, 22 bp, Artificial Sequence
  chemically synthesized
ataaagaatgttcagctcaact

SEQ ID NO: 147877 - DNA, 22 bp, Artificial Sequence
  chemically synthesized
agctcaacttcctgattaattt

SEQ ID NO: 147878 - DNA, 22 bp, Artificial Sequence
  chemically synthesized
aacttcctgattaatttcactt

SEQ ID NO: 147879 - DNA, 22 bp, Artificial Sequence
  chemically synthesized
cctgattaatttcacttatttc

SEQ ID NO: 147880 - DNA, 22 bp, Artificial Sequence
  chemically synthesized
ctgattaatttcacttatttca

SEQ ID NO: 147881 - DNA, 22 bp, Artificial Sequence
  chemically synthesized
attaatttcacttatttcattt

SEQ ID NO: 147882 - DNA, 22 bp, Artificial Sequence
  chemically synthesized
atttcacttatttcattttttt

SEQ ID NO: 147883 - DNA, 22 bp, Artificial Sequence
  chemically synthesized
cacttatttcatttttttgtcc

SEQ ID NO: 147884 - DNA, 22 bp, Artificial Sequence
  chemically synthesized
acttatttcatttttttgtcca

SEQ ID NO: 147885 - DNA, 22 bp, Artificial Sequence
  chemically synthesized
atttcatttttttgtccaggtg

SEQ ID NO: 147886 - DNA, 22 bp, Artificial Sequence
  chemically synthesized
tttcatttttttgtccaggtgt

SEQ ID NO: 147887 - DNA, 22 bp, Artificial Sequence
  chemically synthesized
catttttttgtccaggtgtgta

SEQ ID NO: 147888 - DNA, 22 bp, Artificial Sequence
  chemically synthesized
atttttttgtccaggtgtgtaa

SEQ ID NO: 147889 - DNA, 22 bp, Artificial Sequence
  chemically synthesized
ttttgtccaggtgtgtaagaag

SEQ ID NO: 147890 - DNA, 22 bp, Artificial Sequence
  chemically synthesized
tttgtccaggtgtgtaagaagg

SEQ ID NO: 147891 - DNA, 22 bp, Artificial Sequence
  chemically synthesized
ttgtccaggtgtgtaagaaggt

SEQ ID NO: 147892 - DNA, 22 bp, Artificial Sequence
  chemically synthesized
tgtccaggtgtgtaagaaggtt

SEQ ID NO: 147893 - DNA, 22 bp, Artificial Sequence
  chemically synthesized
gtccaggtgtgtaagaaggttc

SEQ ID NO: 147894 - DNA, 22 bp, Artificial Sequence
  chemically synthesized
tccaggtgtgtaagaaggttcc

SEQ ID NO: 147895 - DNA, 22 bp, Artificial Sequence
  chemically synthesized
ctgaggctctacagatagggag

SEQ ID NO: 147896 - DNA, 22 bp, Artificial Sequence
  chemically synthesized
aggctctacagatagggagcac

SEQ ID NO: 147897 - DNA, 22 bp, Artificial Sequence
  chemically synthesized
tacagatagggagcacttgttt

SEQ ID NO: 147898 - DNA, 22 bp, Artificial Sequence
  chemically synthesized
cagatagggagcacttgtttat

SEQ ID NO: 147899 - DNA, 22 bp, Artificial Sequence
  chemically synthesized
gtttattttacaaagagtacat

SEQ ID NO: 147900 - DNA, 22 bp, Artificial Sequence
  chemically synthesized
tttattttacaaagagtacatg

SEQ ID NO: 147901 - DNA, 22 bp, Artificial Sequence
  chemically synthesized
attttacaaagagtacatggga

SEQ ID NO: 147902 - DNA, 22 bp, Artificial Sequence
  chemically synthesized
ttttacaaagagtacatgggaa

SEQ ID NO: 147903 - DNA, 22 bp, Artificial Sequence
  chemically synthesized
tacaaagagtacatgggaaaag

SEQ ID NO: 147904 - DNA, 22 bp, Artificial Sequence
  chemically synthesized
acaaagagtacatgggaaaaga

SEQ ID NO: 147905 - DNA, 22 bp, Artificial Sequence
  chemically synthesized
caaagagtacatgggaaaagag

SEQ ID NO: 147906 - DNA, 22 bp, Artificial Sequence
  chemically synthesized
atgggtgacacttctacctcca

SEQ ID NO: 147907 - DNA, 22 bp, Artificial Sequence
  chemically synthesized
ctacctccaaagagcagaaatt

SEQ ID NO: 147908 - DNA, 22 bp, Artificial Sequence
  chemically synthesized
tacctccaaagagcagaaatta

SEQ ID NO: 147909 - DNA, 22 bp, Artificial Sequence
  chemically synthesized
cctccaaagagcagaaattatc

SEQ ID NO: 147910 - DNA, 22 bp, Artificial Sequence
  chemically synthesized
caaagagcagaaattatcaaga

SEQ ID NO: 147911 - DNA, 22 bp, Artificial Sequence
  chemically synthesized
tcaagaactcttgatacaaaga

SEQ ID NO: 147912 - DNA, 22 bp, Artificial Sequence
  chemically synthesized
ttgatacaaagataatactggc

SEQ ID NO: 147913 - DNA, 22 bp, Artificial Sequence
  chemically synthesized
gatacaaagataatactggcac

SEQ ID NO: 147914 - DNA, 22 bp, Artificial Sequence
  chemically synthesized
atacaaagataatactggcact

SEQ ID NO: 147915 - DNA, 22 bp, Artificial Sequence
  chemically synthesized
gcactgcagaggttctagggaa

SEQ ID NO: 147916 - DNA, 22 bp, Artificial Sequence
  chemically synthesized
cagaggttctagggaagacctc

SEQ ID NO: 147917 - DNA, 22 bp, Artificial Sequence
  chemically synthesized
tagggaagacctcaaccctaag

SEQ ID NO: 147918 - DNA, 22 bp, Artificial Sequence
  chemically synthesized
gggaagacctcaaccctaagac

SEQ ID NO: 147919 - DNA, 22 bp, Artificial Sequence
  chemically synthesized
aaccctaagacatagcctcaag

SEQ ID NO: 147920 - DNA, 22 bp, Artificial Sequence
  chemically synthesized
agacatagcctcaagggtaatg

SEQ ID NO: 147921 - DNA, 22 bp, Artificial Sequence
  chemically synthesized
aagggtaatgctacgattaaac

SEQ ID NO: 147922 - DNA, 22 bp, Artificial Sequence
  chemically synthesized
cgattaaactccaacaattact

SEQ ID NO: 147923 - DNA, 22 bp, Artificial Sequence
  chemically synthesized
aactccaacaattactgagaaa

SEQ ID NO: 147924 - DNA, 22 bp, Artificial Sequence
  chemically synthesized
caacaattactgagaaaataat

SEQ ID NO: 147925 - DNA, 22 bp, Artificial Sequence
  chemically synthesized
ctgagaaaataatgtgctcaat

SEQ ID NO: 147926 - DNA, 22 bp, Artificial Sequence
  chemically synthesized
agaaaataatgtgctcaattaa

SEQ ID NO: 147927 - DNA, 22 bp, Artificial Sequence
  chemically synthesized
aattaaaggcataatgattact

SEQ ID NO: 147928 - DNA, 22 bp, Artificial Sequence
  chemically synthesized
aaggcataatgattactcaaga

SEQ ID NO: 147929 - DNA, 22 bp, Artificial Sequence
  chemically synthesized
ctcaagacaatgttatgttgtc

SEQ ID NO: 147930 - DNA, 22 bp, Artificial Sequence
  chemically synthesized
aagacaatgttatgttgtcttt

SEQ ID NO: 147931 - DNA, 22 bp, Artificial Sequence
  chemically synthesized
tgttgtctttcttcctccttcc

SEQ ID NO: 147932 - DNA, 22 bp, Artificial Sequence
  chemically synthesized
tctttcttcctccttcctttgc

SEQ ID NO: 147933 - DNA, 22 bp, Artificial Sequence
  chemically synthesized
tcttcctccttcctttgcctgc

SEQ ID NO: 147934 - DNA, 22 bp, Artificial Sequence
  chemically synthesized
cttcctccttcctttgcctgca

SEQ ID NO: 147935 - DNA, 22 bp, Artificial Sequence
  chemically synthesized
ttcctccttcctttgcctgcac

SEQ ID NO: 147936 - DNA, 22 bp, Artificial Sequence
  chemically synthesized
cctccttcctttgcctgcacat

SEQ ID NO: 147937 - DNA, 22 bp, Artificial Sequence
  chemically synthesized
ctccttcctttgcctgcacatt

SEQ ID NO: 147938 - DNA, 22 bp, Artificial Sequence
  chemically synthesized
cttcctttgcctgcacattgta

SEQ ID NO: 147939 - DNA, 22 bp, Artificial Sequence
  chemically synthesized
cctttgcctgcacattgtagcc

SEQ ID NO: 147940 - DNA, 22 bp, Artificial Sequence
  chemically synthesized
ctttgcctgcacattgtagccc

SEQ ID NO: 147941 - DNA, 22 bp, Artificial Sequence
  chemically synthesized
tgcctgcacattgtagcccata

SEQ ID NO: 147942 - DNA, 22 bp, Artificial Sequence
  chemically synthesized
gcctgcacattgtagcccataa

SEQ ID NO: 147943 - DNA, 22 bp, Artificial Sequence
  chemically synthesized
cctgcacattgtagcccataat

SEQ ID NO: 147944 - DNA, 22 bp, Artificial Sequence
  chemically synthesized
cacattgtagcccataatacta

SEQ ID NO: 147945 - DNA, 22 bp, Artificial Sequence
  chemically synthesized
tagcccataatactatacccca

SEQ ID NO: 147946 - DNA, 22 bp, Artificial Sequence
  chemically synthesized
taccccatcaagtgttcctgct

SEQ ID NO: 147947 - DNA, 22 bp, Artificial Sequence
  chemically synthesized
ctgctccaagaaatagcttcct

SEQ ID NO: 147948 - DNA, 22 bp, Artificial Sequence
  chemically synthesized
ctccaagaaatagcttcctcct

SEQ ID NO: 147949 - DNA, 22 bp, Artificial Sequence
  chemically synthesized
caagaaatagcttcctcctctt

SEQ ID NO: 147950 - DNA, 22 bp, Artificial Sequence
  chemically synthesized
cctcctcttacttgccccagaa

SEQ ID NO: 147951 - DNA, 22 bp, Artificial Sequence
  chemically synthesized
ctcctcttacttgccccagaac

SEQ ID NO: 147952 - DNA, 22 bp, Artificial Sequence
  chemically synthesized
ctcttacttgccccagaacatc

SEQ ID NO: 147953 - DNA, 22 bp, Artificial Sequence
  chemically synthesized
ttacttgccccagaacatctct

SEQ ID NO: 147954 - DNA, 22 bp, Artificial Sequence
  chemically synthesized
acttgccccagaacatctctgt

SEQ ID NO: 147955 - DNA, 22 bp, Artificial Sequence
  chemically synthesized
cttgccccagaacatctctgta

SEQ ID NO: 147956 - DNA, 22 bp, Artificial Sequence
  chemically synthesized
gccccagaacatctctgtaaag

SEQ ID NO: 147957 - DNA, 22 bp, Artificial Sequence
  chemically synthesized
ccccagaacatctctgtaaaga

SEQ ID NO: 147958 - DNA, 22 bp, Artificial Sequence
  chemically synthesized
tgtaaagaatttcctcttatct

SEQ ID NO: 147959 - DNA, 22 bp, Artificial Sequence
  chemically synthesized
taaagaatttcctcttatcttc

SEQ ID NO: 147960 - DNA, 22 bp, Artificial Sequence
  chemically synthesized
cctcttatcttcccatatttca

SEQ ID NO: 147961 - DNA, 22 bp, Artificial Sequence
  chemically synthesized
ctcttatcttcccatatttcag

SEQ ID NO: 147962 - DNA, 22 bp, Artificial Sequence
  chemically synthesized
ttatcttcccatatttcagtca

SEQ ID NO: 147963 - DNA, 22 bp, Artificial Sequence
  chemically synthesized
atcttcccatatttcagtcaag

SEQ ID NO: 147964 - DNA, 22 bp, Artificial Sequence
  chemically synthesized
tcttcccatatttcagtcaaga

SEQ ID NO: 147965 - DNA, 22 bp, Artificial Sequence
  chemically synthesized
cccatatttcagtcaagattca

SEQ ID NO: 147966 - DNA, 22 bp, Artificial Sequence
  chemically synthesized
ccatatttcagtcaagattcat

SEQ ID NO: 147967 - DNA, 22 bp, Artificial Sequence
  chemically synthesized
cagtcaagattcattgctcacg

SEQ ID NO: 147968 - DNA, 22 bp, Artificial Sequence
  chemically synthesized
agtcaagattcattgctcacgt

SEQ ID NO: 147969 - DNA, 22 bp, Artificial Sequence
  chemically synthesized
attgctcacgtattacttgtga

SEQ ID NO: 147970 - DNA, 22 bp, Artificial Sequence
  chemically synthesized
ctcacgtattacttgtgacctc

SEQ ID NO: 147971 - DNA, 22 bp, Artificial Sequence
  chemically synthesized
acgtattacttgtgacctctct

SEQ ID NO: 147972 - DNA, 22 bp, Artificial Sequence
  chemically synthesized
cttgtgacctctcttgacccca

SEQ ID NO: 147973 - DNA, 22 bp, Artificial Sequence
  chemically synthesized
gtgacctctcttgaccccagcc

SEQ ID NO: 147974 - DNA, 22 bp, Artificial Sequence
  chemically synthesized
tgacctctcttgaccccagcca

SEQ ID NO: 147975 - DNA, 22 bp, Artificial Sequence
  chemically synthesized
tcttgaccccagccacaataaa

SEQ ID NO: 147976 - DNA, 22 bp, Artificial Sequence
  chemically synthesized
ttgaccccagccacaataaact

SEQ ID NO: 147977 - DNA, 22 bp, Artificial Sequence
  chemically synthesized
gaccccagccacaataaacttc

SEQ ID NO: 147978 - DNA, 22 bp, Artificial Sequence
  chemically synthesized
accccagccacaataaacttct

SEQ ID NO: 147979 - DNA, 22 bp, Artificial Sequence
  chemically synthesized
ctctatactacccaaaaaatct

SEQ ID NO: 147980 - DNA, 22 bp, Artificial Sequence
  chemically synthesized
tctatactacccaaaaaatctt

SEQ ID NO: 147981 - DNA, 22 bp, Artificial Sequence
  chemically synthesized
tatactacccaaaaaatctttc

SEQ ID NO: 147982 - DNA, 22 bp, Artificial Sequence
  chemically synthesized
tactacccaaaaaatctttcca

SEQ ID NO: 147983 - DNA, 22 bp, Artificial Sequence
  chemically synthesized
cccaaaaaatctttccaaaccc

SEQ ID NO: 147984 - DNA, 22 bp, Artificial Sequence
  chemically synthesized
tccaaaccctcccccacaccat

SEQ ID NO: 147985 - DNA, 22 bp, Artificial Sequence
  chemically synthesized
ccaaaccctcccccacaccatt

SEQ ID NO: 147986 - DNA, 22 bp, Artificial Sequence
  chemically synthesized
caaaccctcccccacaccattt

SEQ ID NO: 147987 - DNA, 22 bp, Artificial Sequence
  chemically synthesized
ccccacaccattttttatattt

SEQ ID NO: 147988 - DNA, 22 bp, Artificial Sequence
  chemically synthesized
tttatatttttatatttttctt

SEQ ID NO: 147989 - DNA, 22 bp, Artificial Sequence
  chemically synthesized
ttatatttttatatttttctta

SEQ ID NO: 147990 - DNA, 22 bp, Artificial Sequence
  chemically synthesized
tatatttttatatttttcttat

SEQ ID NO: 147991 - DNA, 22 bp, Artificial Sequence
  chemically synthesized
atatttttatatttttcttatt

SEQ ID NO: 147992 - DNA, 22 bp, Artificial Sequence
  chemically synthesized
tatttttatatttttcttattt

SEQ ID NO: 147993 - DNA, 22 bp, Artificial Sequence
  chemically synthesized
ttatatttttcttatttatttc

SEQ ID NO: 147994 - DNA, 22 bp, Artificial Sequence
  chemically synthesized
tatatttttcttatttatttca

SEQ ID NO: 147995 - DNA, 22 bp, Artificial Sequence
  chemically synthesized
atatttttcttatttatttcat

SEQ ID NO: 147996 - DNA, 22 bp, Artificial Sequence
  chemically synthesized
tatttttcttatttatttcatg

SEQ ID NO: 147997 - DNA, 22 bp, Artificial Sequence
  chemically synthesized
ttcttatttatttcatgcacac

SEQ ID NO: 147998 - DNA, 22 bp, Artificial Sequence
  chemically synthesized
tcttatttatttcatgcacaca

SEQ ID NO: 147999 - DNA, 22 bp, Artificial Sequence
  chemically synthesized
cttatttatttcatgcacacac

SEQ ID NO: 148000 - DNA, 22 bp, Artificial Sequence
  chemically synthesized
ttatttatttcatgcacacaca

SEQ ID NO: 148001 - DNA, 22 bp, Artificial Sequence
  chemically synthesized
atttatttcatgcacacacaca

SEQ ID NO: 148002 - DNA, 22 bp, Artificial Sequence
  chemically synthesized
tttatttcatgcacacacacac

SEQ ID NO: 148003 - DNA, 22 bp, Artificial Sequence
  chemically synthesized
atttcatgcacacacacacact

SEQ ID NO: 148004 - DNA, 22 bp, Artificial Sequence
  chemically synthesized
tttcatgcacacacacacactc

SEQ ID NO: 148005 - DNA, 22 bp, Artificial Sequence
  chemically synthesized
catgcacacacacacactccgt

SEQ ID NO: 148006 - DNA, 22 bp, Artificial Sequence
  chemically synthesized
atgcacacacacacactccgtg

SEQ ID NO: 148007 - DNA, 22 bp, Artificial Sequence
  chemically synthesized
cgtgctttataagcaattctgc

SEQ ID NO: 148008 - DNA, 22 bp, Artificial Sequence
  chemically synthesized
tataagcaattctgcctattct

SEQ ID NO: 148009 - DNA, 22 bp, Artificial Sequence
  chemically synthesized
ataagcaattctgcctattctc

SEQ ID NO: 148010 - DNA, 22 bp, Artificial Sequence
  chemically synthesized
taagcaattctgcctattctct

SEQ ID NO: 148011 - DNA, 22 bp, Artificial Sequence
  chemically synthesized
tgcctattctctaccttcttac

SEQ ID NO: 148012 - DNA, 22 bp, Artificial Sequence
  chemically synthesized
cctattctctaccttcttacat

SEQ ID NO: 148013 - DNA, 22 bp, Artificial Sequence
  chemically synthesized
ttctctaccttcttacatgcct

SEQ ID NO: 148014 - DNA, 22 bp, Artificial Sequence
  chemically synthesized
tctaccttcttacatgcctact

SEQ ID NO: 148015 - DNA, 22 bp, Artificial Sequence
  chemically synthesized
taccttcttacatgcctactgt

SEQ ID NO: 148016 - DNA, 22 bp, Artificial Sequence
  chemically synthesized
ccttcttacatgcctactgtgc

SEQ ID NO: 148017 - DNA, 22 bp, Artificial Sequence
  chemically synthesized
cttacatgcctactgtgcctca

SEQ ID NO: 148018 - DNA, 22 bp, Artificial Sequence
  chemically synthesized
ttacatgcctactgtgcctcat

SEQ ID NO: 148019 - DNA, 22 bp, Artificial Sequence
  chemically synthesized
acatgcctactgtgcctcatat

SEQ ID NO: 148020 - DNA, 22 bp, Artificial Sequence
  chemically synthesized
catgcctactgtgcctcatatt

SEQ ID NO: 148021 - DNA, 22 bp, Artificial Sequence
  chemically synthesized
ctgtgcctcatattaaattcat

SEQ ID NO: 148022 - DNA, 22 bp, Artificial Sequence
  chemically synthesized
tgcctcatattaaattcatcaa

SEQ ID NO: 148023 - DNA, 22 bp, Artificial Sequence
  chemically synthesized
atattaaattcatcaatgggca

SEQ ID NO: 148024 - DNA, 22 bp, Artificial Sequence
  chemically synthesized
aattcatcaatgggcagaaaga

SEQ ID NO: 148025 - DNA, 22 bp, Artificial Sequence
  chemically synthesized
atcaatgggcagaaagaaaata

SEQ ID NO: 148026 - DNA, 22 bp, Artificial Sequence
  chemically synthesized
attcaagaaaacagtgaatgaa

SEQ ID NO: 148027 - DNA, 22 bp, Artificial Sequence
  chemically synthesized
ttcaagaaaacagtgaatgaat

SEQ ID NO: 148028 - DNA, 22 bp, Artificial Sequence
  chemically synthesized
aagaaaacagtgaatgaatgaa

SEQ ID NO: 148029 - DNA, 22 bp, Artificial Sequence
  chemically synthesized
ttccttgctttagaacttctgg

SEQ ID NO: 148030 - DNA, 22 bp, Artificial Sequence
  chemically synthesized
cttgctttagaacttctggaat

SEQ ID NO: 148031 - DNA, 22 bp, Artificial Sequence
  chemically synthesized
gctttagaacttctggaattag

SEQ ID NO: 148032 - DNA, 22 bp, Artificial Sequence
  chemically synthesized
ctttagaacttctggaattaga

SEQ ID NO: 148033 - DNA, 22 bp, Artificial Sequence
  chemically synthesized
tagaacttctggaattagagga

SEQ ID NO: 148034 - DNA, 22 bp, Artificial Sequence
  chemically synthesized
agaacttctggaattagaggac

SEQ ID NO: 148035 - DNA, 22 bp, Artificial Sequence
  chemically synthesized
gaacttctggaattagaggaca

SEQ ID NO: 148036 - DNA, 22 bp, Artificial Sequence
  chemically synthesized
ctggaattagaggacaatatta

SEQ ID NO: 148037 - DNA, 22 bp, Artificial Sequence
  chemically synthesized
tggaattagaggacaatattaa

SEQ ID NO: 148038 - DNA, 22 bp, Artificial Sequence
  chemically synthesized
gaattagaggacaatattaata

SEQ ID NO: 148039 - DNA, 22 bp, Artificial Sequence
  chemically synthesized
gaggacaatattaataatacca

SEQ ID NO: 148040 - DNA, 22 bp, Artificial Sequence
  chemically synthesized
ataataccatcgcacagtgttt

SEQ ID NO: 148041 - DNA, 22 bp, Artificial Sequence
  chemically synthesized
ctttgttgttaatgctacaaca

SEQ ID NO: 148042 - DNA, 22 bp, Artificial Sequence
  chemically synthesized
tttgttgttaatgctacaacat

SEQ ID NO: 148043 - DNA, 22 bp, Artificial Sequence
  chemically synthesized
tgttgttaatgctacaacatac

SEQ ID NO: 148044 - DNA, 22 bp, Artificial Sequence
  chemically synthesized
gttgttaatgctacaacataca

SEQ ID NO: 148045 - DNA, 22 bp, Artificial Sequence
  chemically synthesized
ttgttaatgctacaacatacaa

SEQ ID NO: 148046 - DNA, 22 bp, Artificial Sequence
  chemically synthesized
ttaatgctacaacatacaaaga

SEQ ID NO: 148047 - DNA, 22 bp, Artificial Sequence
  chemically synthesized
atgctacaacatacaaagagga

SEQ ID NO: 148048 - DNA, 22 bp, Artificial Sequence
  chemically synthesized
caacatacaaagaggaagcatg

SEQ ID NO: 148049 - DNA, 22 bp, Artificial Sequence
  chemically synthesized
tttcctttctgatcataggagt

SEQ ID NO: 148050 - DNA, 22 bp, Artificial Sequence
  chemically synthesized
cctttctgatcataggagtaat

SEQ ID NO: 148051 - DNA, 22 bp, Artificial Sequence
  chemically synthesized
ctttctgatcataggagtaata

SEQ ID NO: 148052 - DNA, 22 bp, Artificial Sequence
  chemically synthesized
tctgatcataggagtaatattt

SEQ ID NO: 148053 - DNA, 22 bp, Artificial Sequence
  chemically synthesized
ctgatcataggagtaatatttt

SEQ ID NO: 148054 - DNA, 22 bp, Artificial Sequence
  chemically synthesized
tgatcataggagtaatattttt

SEQ ID NO: 148055 - DNA, 22 bp, Artificial Sequence
  chemically synthesized
atcataggagtaatattttttt

SEQ ID NO: 148056 - DNA, 22 bp, Artificial Sequence
  chemically synthesized
ttttccttgagcaccatttttg

SEQ ID NO: 148057 - DNA, 22 bp, Artificial Sequence
  chemically synthesized
tttccttgagcaccatttttgc

SEQ ID NO: 148058 - DNA, 22 bp, Artificial Sequence
  chemically synthesized
ttccttgagcaccatttttgcc

SEQ ID NO: 148059 - DNA, 22 bp, Artificial Sequence
  chemically synthesized
tccttgagcaccatttttgcca

SEQ ID NO: 148060 - DNA, 22 bp, Artificial Sequence
  chemically synthesized
ccttgagcaccatttttgccat

SEQ ID NO: 148061 - DNA, 22 bp, Artificial Sequence
  chemically synthesized
cttgagcaccatttttgccata

SEQ ID NO: 148062 - DNA, 22 bp, Artificial Sequence
  chemically synthesized
gagcaccatttttgccataggt

SEQ ID NO: 148063 - DNA, 22 bp, Artificial Sequence
  chemically synthesized
agcaccatttttgccataggta

SEQ ID NO: 148064 - DNA, 22 bp, Artificial Sequence
  chemically synthesized
ttgccataggtaaaattagaag

SEQ ID NO: 148065 - DNA, 22 bp, Artificial Sequence
  chemically synthesized
tgccataggtaaaattagaagg

SEQ ID NO: 148066 - DNA, 22 bp, Artificial Sequence
  chemically synthesized
gccataggtaaaattagaagga

SEQ ID NO: 148067 - DNA, 22 bp, Artificial Sequence
  chemically synthesized
ccataggtaaaattagaaggat

SEQ ID NO: 148068 - DNA, 22 bp, Artificial Sequence
  chemically synthesized
gaaggatttttagaactttctc

SEQ ID NO: 148069 - DNA, 22 bp, Artificial Sequence
  chemically synthesized
ttagaactttctcagttgtata

SEQ ID NO: 148070 - DNA, 22 bp, Artificial Sequence
  chemically synthesized
tagaactttctcagttgtatac

SEQ ID NO: 148071 - DNA, 22 bp, Artificial Sequence
  chemically synthesized
agaactttctcagttgtataca

SEQ ID NO: 148072 - DNA, 22 bp, Artificial Sequence
  chemically synthesized
gaactttctcagttgtatacat

SEQ ID NO: 148073 - DNA, 22 bp, Artificial Sequence
  chemically synthesized
tctcagttgtatacatttttaa

SEQ ID NO: 148074 - DNA, 22 bp, Artificial Sequence
  chemically synthesized
ctcagttgtatacatttttaaa

SEQ ID NO: 148075 - DNA, 22 bp, Artificial Sequence
  chemically synthesized
tcagttgtatacatttttaaaa

SEQ ID NO: 148076 - DNA, 22 bp, Artificial Sequence
  chemically synthesized
agttgtatacatttttaaaaat

SEQ ID NO: 148077 - DNA, 22 bp, Artificial Sequence
  chemically synthesized
tatacatttttaaaaatctgta

SEQ ID NO: 148078 - DNA, 22 bp, Artificial Sequence
  chemically synthesized
ttaaaaatctgtattatatgca

SEQ ID NO: 148079 - DNA, 22 bp, Artificial Sequence
  chemically synthesized
taaaaatctgtattatatgcat

SEQ ID NO: 148080 - DNA, 22 bp, Artificial Sequence
  chemically synthesized
aaaaatctgtattatatgcatg

SEQ ID NO: 148081 - DNA, 22 bp, Artificial Sequence
  chemically synthesized
aaaatctgtattatatgcatgt

SEQ ID NO: 148082 - DNA, 22 bp, Artificial Sequence
  chemically synthesized
tattatatgcatgttgattaat

SEQ ID NO: 148083 - DNA, 22 bp, Artificial Sequence
  chemically synthesized
tatgcatgttgattaattttaa

SEQ ID NO: 148084 - DNA, 22 bp, Artificial Sequence
  chemically synthesized
attaattttaaacttacttgaa

SEQ ID NO: 148085 - DNA, 22 bp, Artificial Sequence
  chemically synthesized
attttaaacttacttgaatacc

SEQ ID NO: 148086 - DNA, 22 bp, Artificial Sequence
  chemically synthesized
taaacttacttgaatacctaaa

SEQ ID NO: 148087 - DNA, 22 bp, Artificial Sequence
  chemically synthesized
aaacttacttgaatacctaaac

SEQ ID NO: 148088 - DNA, 22 bp, Artificial Sequence
  chemically synthesized
aacttacttgaatacctaaaca

SEQ ID NO: 148089 - DNA, 22 bp, Artificial Sequence
  chemically synthesized
acttgaatacctaaacagaatc

SEQ ID NO: 148090 - DNA, 22 bp, Artificial Sequence
  chemically synthesized
cttgaatacctaaacagaatct

SEQ ID NO: 148091 - DNA, 22 bp, Artificial Sequence
  chemically synthesized
gaatacctaaacagaatctgtt

SEQ ID NO: 148092 - DNA, 22 bp, Artificial Sequence
  chemically synthesized
aatacctaaacagaatctgttg

SEQ ID NO: 148093 - DNA, 22 bp, Artificial Sequence
  chemically synthesized
aacagaatctgttgtttccttg

SEQ ID NO: 148094 - DNA, 22 bp, Artificial Sequence
  chemically synthesized
ttgtttccttgtgtttgaaagt

SEQ ID NO: 148095 - DNA, 22 bp, Artificial Sequence
  chemically synthesized
tttccttgtgtttgaaagtgct

SEQ ID NO: 148096 - DNA, 22 bp, Artificial Sequence
  chemically synthesized
ccttgtgtttgaaagtgctttc

SEQ ID NO: 148097 - DNA, 22 bp, Artificial Sequence
  chemically synthesized
cttgtgtttgaaagtgctttca

SEQ ID NO: 148098 - DNA, 22 bp, Artificial Sequence
  chemically synthesized
gtgtttgaaagtgctttcacag

SEQ ID NO: 148099 - DNA, 22 bp, Artificial Sequence
  chemically synthesized
tgtttgaaagtgctttcacagt

SEQ ID NO: 148100 - DNA, 22 bp, Artificial Sequence
  chemically synthesized
gaaagtgctttcacagtaactc

SEQ ID NO: 148101 - DNA, 22 bp, Artificial Sequence
  chemically synthesized
aaagtgctttcacagtaactct

SEQ ID NO: 148102 - DNA, 22 bp, Artificial Sequence
  chemically synthesized
tcacagtaactctgtctgtact

SEQ ID NO: 148103 - DNA, 22 bp, Artificial Sequence
  chemically synthesized
cacagtaactctgtctgtactg

SEQ ID NO: 148104 - DNA, 22 bp, Artificial Sequence
  chemically synthesized
acagtaactctgtctgtactgc

SEQ ID NO: 148105 - DNA, 22 bp, Artificial Sequence
  chemically synthesized
tgtctgtactgccagaatatac

SEQ ID NO: 148106 - DNA, 22 bp, Artificial Sequence
  chemically synthesized
tctgtactgccagaatatactg

SEQ ID NO: 148107 - DNA, 22 bp, Artificial Sequence
  chemically synthesized
tactgccagaatatactgacaa

SEQ ID NO: 148108 - DNA, 22 bp, Artificial Sequence
  chemically synthesized
ccagaatatactgacaatgtgt

SEQ ID NO: 148109 - DNA, 22 bp, Artificial Sequence
  chemically synthesized
acaatgtgttatagttaactgt

SEQ ID NO: 148110 - DNA, 22 bp, Artificial Sequence
  chemically synthesized
tagttaactgttttgatcacaa

SEQ ID NO: 148111 - DNA, 22 bp, Artificial Sequence
  chemically synthesized
actgttttgatcacaacatttt

SEQ ID NO: 148112 - DNA, 22 bp, Artificial Sequence
  chemically synthesized
ttttgatcacaacattttgaat

SEQ ID NO: 148113 - DNA, 22 bp, Artificial Sequence
  chemically synthesized
tgatcacaacattttgaattga

SEQ ID NO: 148114 - DNA, 22 bp, Artificial Sequence
  chemically synthesized
gatcacaacattttgaattgac

SEQ ID NO: 148115 - DNA, 22 bp, Artificial Sequence
  chemically synthesized
atcacaacattttgaattgact

SEQ ID NO: 148116 - DNA, 22 bp, Artificial Sequence
  chemically synthesized
tgaattgactggcagcagaagc

SEQ ID NO: 148117 - DNA, 22 bp, Artificial Sequence
  chemically synthesized
gaattgactggcagcagaagct

SEQ ID NO: 148118 - DNA, 22 bp, Artificial Sequence
  chemically synthesized
aattgactggcagcagaagctc

SEQ ID NO: 148119 - DNA, 22 bp, Artificial Sequence
  chemically synthesized
actggcagcagaagctctttta

SEQ ID NO: 148120 - DNA, 22 bp, Artificial Sequence
  chemically synthesized
gcagcagaagctcttttatatc

SEQ ID NO: 148121 - DNA, 22 bp, Artificial Sequence
  chemically synthesized
ttttatatccatgtgttttcct

SEQ ID NO: 148122 - DNA, 22 bp, Artificial Sequence
  chemically synthesized
ttatatccatgtgttttcctta

SEQ ID NO: 148123 - DNA, 22 bp, Artificial Sequence
  chemically synthesized
tatatccatgtgttttccttaa

SEQ ID NO: 148124 - DNA, 22 bp, Artificial Sequence
  chemically synthesized
atatccatgtgttttccttaag

SEQ ID NO: 148125 - DNA, 22 bp, Artificial Sequence
  chemically synthesized
tatccatgtgttttccttaagt

SEQ ID NO: 148126 - DNA, 22 bp, Artificial Sequence
  chemically synthesized
tccttaagtcattatacatagt

SEQ ID NO: 148127 - DNA, 22 bp, Artificial Sequence
  chemically synthesized
ccttaagtcattatacatagta

SEQ ID NO: 148128 - DNA, 22 bp, Artificial Sequence
  chemically synthesized
cttaagtcattatacatagtag

SEQ ID NO: 148129 - DNA, 22 bp, Artificial Sequence
  chemically synthesized
aagtcattatacatagtaggca

SEQ ID NO: 148130 - DNA, 22 bp, Artificial Sequence
  chemically synthesized
agtcattatacatagtaggcac

SEQ ID NO: 148131 - DNA, 22 bp, Artificial Sequence
  chemically synthesized
tacatagtaggcactgagaact

SEQ ID NO: 148132 - DNA, 22 bp, Artificial Sequence
  chemically synthesized
agaactctttatatctgaataa

SEQ ID NO: 148133 - DNA, 22 bp, Artificial Sequence
  chemically synthesized
tttatatctgaataagatattt

SEQ ID NO: 148134 - DNA, 22 bp, Artificial Sequence
  chemically synthesized
tatatctgaataagatatttag

SEQ ID NO: 148135 - DNA, 22 bp, Artificial Sequence
  chemically synthesized
atatctgaataagatatttagg

SEQ ID NO: 148136 - DNA, 22 bp, Artificial Sequence
  chemically synthesized
tatctgaataagatatttagga

SEQ ID NO: 148137 - DNA, 22 bp, Artificial Sequence
  chemically synthesized
aataagatatttaggaaccact

SEQ ID NO: 148138 - DNA, 22 bp, Artificial Sequence
  chemically synthesized
aggaaccactggtttacatatc

SEQ ID NO: 148139 - DNA, 22 bp, Artificial Sequence
  chemically synthesized
ggaaccactggtttacatatca

SEQ ID NO: 148140 - DNA, 22 bp, Artificial Sequence
  chemically synthesized
gtttacatatcagaagcagagc

SEQ ID NO: 148141 - DNA, 22 bp, Artificial Sequence
  chemically synthesized
acatatcagaagcagagctact

SEQ ID NO: 148142 - DNA, 22 bp, Artificial Sequence
  chemically synthesized
catatcagaagcagagctactc

SEQ ID NO: 148143 - DNA, 22 bp, Artificial Sequence
  chemically synthesized
ctcagggcattttggggaagat

SEQ ID NO: 148144 - DNA, 22 bp, Artificial Sequence
  chemically synthesized
agggcattttggggaagatcac

SEQ ID NO: 148145 - DNA, 22 bp, Artificial Sequence
  chemically synthesized
tggggaagatcactttcacatt

SEQ ID NO: 148146 - DNA, 22 bp, Artificial Sequence
  chemically synthesized
ggggaagatcactttcacattc

SEQ ID NO: 148147 - DNA, 22 bp, Artificial Sequence
  chemically synthesized
gggaagatcactttcacattcc

SEQ ID NO: 148148 - DNA, 22 bp, Artificial Sequence
  chemically synthesized
tcacattcctgagcatagggaa

SEQ ID NO: 148149 - DNA, 22 bp, Artificial Sequence
  chemically synthesized
cacattcctgagcatagggaag

SEQ ID NO: 148150 - DNA, 22 bp, Artificial Sequence
  chemically synthesized
acattcctgagcatagggaagt

SEQ ID NO: 148151 - DNA, 22 bp, Artificial Sequence
  chemically synthesized
ctgagcatagggaagttctcat

SEQ ID NO: 148152 - DNA, 22 bp, Artificial Sequence
  chemically synthesized
agcatagggaagttctcataag

SEQ ID NO: 148153 - DNA, 22 bp, Artificial Sequence
  chemically synthesized
tcataagagtaagatattaaaa

SEQ ID NO: 148154 - DNA, 22 bp, Artificial Sequence
  chemically synthesized
ataagagtaagatattaaaagg

SEQ ID NO: 148155 - DNA, 22 bp, Artificial Sequence
  chemically synthesized
aaaggagatacttgtgtggtat

SEQ ID NO: 148156 - DNA, 22 bp, Artificial Sequence
  chemically synthesized
gtgtggtattcgaaagacagta

SEQ ID NO: 148157 - DNA, 22 bp, Artificial Sequence
  chemically synthesized
tgtggtattcgaaagacagtaa

SEQ ID NO: 148158 - DNA, 22 bp, Artificial Sequence
  chemically synthesized
gaaagacagtaagagagattgt

SEQ ID NO: 148159 - DNA, 22 bp, Artificial Sequence
  chemically synthesized
tagaccttatgatcttgatagg

SEQ ID NO: 148160 - DNA, 22 bp, Artificial Sequence
  chemically synthesized
atgatcttgatagggaaaacaa

SEQ ID NO: 148161 - DNA, 22 bp, Artificial Sequence
  chemically synthesized
tgatcttgatagggaaaacaaa

SEQ ID NO: 148162 - DNA, 22 bp, Artificial Sequence
  chemically synthesized
gatagggaaaacaaactacatt

SEQ ID NO: 148163 - DNA, 22 bp, Artificial Sequence
  chemically synthesized
atagggaaaacaaactacattc

SEQ ID NO: 148164 - DNA, 22 bp, Artificial Sequence
  chemically synthesized
cattcctttctccaaaagtcaa

SEQ ID NO: 148165 - DNA, 22 bp, Artificial Sequence
  chemically synthesized
ctttctccaaaagtcaaaaaaa

SEQ ID NO: 148166 - DNA, 22 bp, Artificial Sequence
  chemically synthesized
tctccaaaagtcaaaaaaaaag

SEQ ID NO: 148167 - DNA, 22 bp, Artificial Sequence
  chemically synthesized
ctccaaaagtcaaaaaaaaaga

SEQ ID NO: 148168 - DNA, 22 bp, Artificial Sequence
  chemically synthesized
tccaaaagtcaaaaaaaaagag

SEQ ID NO: 148169 - DNA, 22 bp, Artificial Sequence
  chemically synthesized
caaaagtcaaaaaaaaagagca

SEQ ID NO: 148170 - DNA, 22 bp, Artificial Sequence
  chemically synthesized
actataccttctattcctacac

SEQ ID NO: 148171 - DNA, 22 bp, Artificial Sequence
  chemically synthesized
ctataccttctattcctacacc

SEQ ID NO: 148172 - DNA, 22 bp, Artificial Sequence
  chemically synthesized
taccttctattcctacaccatt

SEQ ID NO: 148173 - DNA, 22 bp, Artificial Sequence
  chemically synthesized
ctattcctacaccattagaagt

SEQ ID NO: 148174 - DNA, 22 bp, Artificial Sequence
  chemically synthesized
tattcctacaccattagaagta

SEQ ID NO: 148175 - DNA, 22 bp, Artificial Sequence
  chemically synthesized
ttcctacaccattagaagtagt

SEQ ID NO: 148176 - DNA, 22 bp, Artificial Sequence
  chemically synthesized
ctacaccattagaagtagtcag

SEQ ID NO: 148177 - DNA, 22 bp, Artificial Sequence
  chemically synthesized
caccattagaagtagtcagtga

SEQ ID NO: 148178 - DNA, 22 bp, Artificial Sequence
  chemically synthesized
gaagtagtcagtgagtctaggc

SEQ ID NO: 148179 - DNA, 22 bp, Artificial Sequence
  chemically synthesized
ggcaagatgttggccctaaaaa

SEQ ID NO: 148180 - DNA, 22 bp, Artificial Sequence
  chemically synthesized
gccctaaaaatccaaataccag

SEQ ID NO: 148181 - DNA, 22 bp, Artificial Sequence
  chemically synthesized
aaaatccaaataccagagaatt

SEQ ID NO: 148182 - DNA, 22 bp, Artificial Sequence
  chemically synthesized
atgagaacatcacctggatggg

SEQ ID NO: 148183 - DNA, 22 bp, Artificial Sequence
  chemically synthesized
gatgggacatgtgccgagcaca

SEQ ID NO: 148184 - DNA, 22 bp, Artificial Sequence
  chemically synthesized
ctatatgctaggcattgctatc

SEQ ID NO: 148185 - DNA, 22 bp, Artificial Sequence
  chemically synthesized
tatgctaggcattgctatcttc

SEQ ID NO: 148186 - DNA, 22 bp, Artificial Sequence
  chemically synthesized
ggcattgctatcttcatattga

SEQ ID NO: 148187 - DNA, 22 bp, Artificial Sequence
  chemically synthesized
ctatcttcatattgaagatgag

SEQ ID NO: 148188 - DNA, 22 bp, Artificial Sequence
  chemically synthesized
tcttcatattgaagatgaggag

SEQ ID NO: 148189 - DNA, 22 bp, Artificial Sequence
  chemically synthesized
catattgaagatgaggaggtca

SEQ ID NO: 148190 - DNA, 22 bp, Artificial Sequence
  chemically synthesized
atattgaagatgaggaggtcaa

SEQ ID NO: 148191 - DNA, 22 bp, Artificial Sequence
  chemically synthesized
aagatgaggaggtcaagagatg

SEQ ID NO: 148192 - DNA, 22 bp, Artificial Sequence
  chemically synthesized
ggcaccttgttgttatattaaa

SEQ ID NO: 148193 - DNA, 22 bp, Artificial Sequence
  chemically synthesized
gcaccttgttgttatattaaaa

SEQ ID NO: 148194 - DNA, 22 bp, Artificial Sequence
  chemically synthesized
gttgttatattaaaattatttg

SEQ ID NO: 148195 - DNA, 22 bp, Artificial Sequence
  chemically synthesized
ttgttatattaaaattatttgt

SEQ ID NO: 148196 - DNA, 22 bp, Artificial Sequence
  chemically synthesized
ttatattaaaattatttgttag

SEQ ID NO: 148197 - DNA, 22 bp, Artificial Sequence
  chemically synthesized
tattaaaattatttgttagagt

SEQ ID NO: 148198 - DNA, 22 bp, Artificial Sequence
  chemically synthesized
aaattatttgttagagtagagc

SEQ ID NO: 148199 - DNA, 22 bp, Artificial Sequence
  chemically synthesized
tttgttagagtagagcttttgt

SEQ ID NO: 148200 - DNA, 22 bp, Artificial Sequence
  chemically synthesized
gttagagtagagcttttgtaag

SEQ ID NO: 148201 - DNA, 22 bp, Artificial Sequence
  chemically synthesized
ttagagtagagcttttgtaaga

SEQ ID NO: 148202 - DNA, 22 bp, Artificial Sequence
  chemically synthesized
gagtagagcttttgtaagagtc

SEQ ID NO: 148203 - DNA, 22 bp, Artificial Sequence
  chemically synthesized
ttgtaagagtctaggagtgtgg

SEQ ID NO: 148204 - DNA, 22 bp, Artificial Sequence
  chemically synthesized
tgtaagagtctaggagtgtggg

SEQ ID NO: 148205 - DNA, 22 bp, Artificial Sequence
  chemically synthesized
gtaagagtctaggagtgtggga

SEQ ID NO: 148206 - DNA, 22 bp, Artificial Sequence
  chemically synthesized
taagagtctaggagtgtgggag

SEQ ID NO: 148207 - DNA, 22 bp, Artificial Sequence
  chemically synthesized
ggagtgtgggagctaaatgatg

SEQ ID NO: 148208 - DNA, 22 bp, Artificial Sequence
  chemically synthesized
aatgatgatacacatggacaca

SEQ ID NO: 148209 - DNA, 22 bp, Artificial Sequence
  chemically synthesized
cttgagggttgagggtgggaag

SEQ ID NO: 148210 - DNA, 22 bp, Artificial Sequence
  chemically synthesized
gagggttgagggtgggaagagg

SEQ ID NO: 148211 - DNA, 22 bp, Artificial Sequence
  chemically synthesized
agggttgagggtgggaagaggg

SEQ ID NO: 148212 - DNA, 22 bp, Artificial Sequence
  chemically synthesized
agggtgggaagagggagacgat

SEQ ID NO: 148213 - DNA, 22 bp, Artificial Sequence
  chemically synthesized
ttgggtattaagttcatcactg

SEQ ID NO: 148214 - DNA, 22 bp, Artificial Sequence
  chemically synthesized
ggtattaagttcatcactgagt

SEQ ID NO: 148215 - DNA, 22 bp, Artificial Sequence
  chemically synthesized
agttcatcactgagtgatgaaa

SEQ ID NO: 148216 - DNA, 22 bp, Artificial Sequence
  chemically synthesized
atcactgagtgatgaaataatc

SEQ ID NO: 148217 - DNA, 22 bp, Artificial Sequence
  chemically synthesized
agtgatgaaataatctgtacat

SEQ ID NO: 148218 - DNA, 22 bp, Artificial Sequence
  chemically synthesized
tacatcaagacccagtgatatg

SEQ ID NO: 148219 - DNA, 22 bp, Artificial Sequence
  chemically synthesized
acctatataacttgtacatgta

SEQ ID NO: 148220 - DNA, 22 bp, Artificial Sequence
  chemically synthesized
cctatataacttgtacatgtac

SEQ ID NO: 148221 - DNA, 22 bp, Artificial Sequence
  chemically synthesized
tataacttgtacatgtaccccc

SEQ ID NO: 148222 - DNA, 22 bp, Artificial Sequence
  chemically synthesized
gtacatgtacccccaaatttaa

SEQ ID NO: 148223 - DNA, 22 bp, Artificial Sequence
  chemically synthesized
tacatgtacccccaaatttaaa

SEQ ID NO: 148224 - DNA, 22 bp, Artificial Sequence
  chemically synthesized
aaaatgaaagttaaaacaaagt

SEQ ID NO: 148225 - DNA, 22 bp, Artificial Sequence
  chemically synthesized
aaatgaaagttaaaacaaagta

SEQ ID NO: 148226 - DNA, 22 bp, Artificial Sequence
  chemically synthesized
aaacaaagtataggaatggaat

SEQ ID NO: 148227 - DNA, 22 bp, Artificial Sequence
  chemically synthesized
attcctcaagatttggctttaa

SEQ ID NO: 148228 - DNA, 22 bp, Artificial Sequence
  chemically synthesized
ctcaagatttggctttaatttt

SEQ ID NO: 148229 - DNA, 22 bp, Artificial Sequence
  chemically synthesized
aagatttggctttaattttatt

SEQ ID NO: 148230 - DNA, 22 bp, Artificial Sequence
  chemically synthesized
ggctttaattttatttgataat

SEQ ID NO: 148231 - DNA, 22 bp, Artificial Sequence
  chemically synthesized
gctttaattttatttgataatt

SEQ ID NO: 148232 - DNA, 22 bp, Artificial Sequence
  chemically synthesized
taattttatttgataatttatc

SEQ ID NO: 148233 - DNA, 22 bp, Artificial Sequence
  chemically synthesized
aattttatttgataatttatca

SEQ ID NO: 148234 - DNA, 22 bp, Artificial Sequence
  chemically synthesized
attttatttgataatttatcaa

SEQ ID NO: 148235 - DNA, 22 bp, Artificial Sequence
  chemically synthesized
tatttgataatttatcaaatgg

SEQ ID NO: 148236 - DNA, 22 bp, Artificial Sequence
  chemically synthesized
atttgataatttatcaaatggt

SEQ ID NO: 148237 - DNA, 22 bp, Artificial Sequence
  chemically synthesized
tttgataatttatcaaatggtt

SEQ ID NO: 148238 - DNA, 22 bp, Artificial Sequence
  chemically synthesized
gataatttatcaaatggttgtt

SEQ ID NO: 148239 - DNA, 22 bp, Artificial Sequence
  chemically synthesized
ataatttatcaaatggttgttt

SEQ ID NO: 148240 - DNA, 22 bp, Artificial Sequence
  chemically synthesized
atcaaatggttgtttttctttt

SEQ ID NO: 148241 - DNA, 22 bp, Artificial Sequence
  chemically synthesized
tcaaatggttgtttttcttttc

SEQ ID NO: 148242 - DNA, 22 bp, Artificial Sequence
  chemically synthesized
tttttcttttctcactatggcg

SEQ ID NO: 148243 - DNA, 22 bp, Artificial Sequence
  chemically synthesized
ttcttttctcactatggcgttg

SEQ ID NO: 148244 - DNA, 22 bp, Artificial Sequence
  chemically synthesized
tcttttctcactatggcgttgc

SEQ ID NO: 148245 - DNA, 22 bp, Artificial Sequence
  chemically synthesized
cttttctcactatggcgttgct

SEQ ID NO: 148246 - DNA, 22 bp, Artificial Sequence
  chemically synthesized
ttttctcactatggcgttgctt

SEQ ID NO: 148247 - DNA, 22 bp, Artificial Sequence
  chemically synthesized
ttctcactatggcgttgcttta

SEQ ID NO: 148248 - DNA, 22 bp, Artificial Sequence
  chemically synthesized
tctcactatggcgttgctttat

SEQ ID NO: 148249 - DNA, 22 bp, Artificial Sequence
  chemically synthesized
ctcactatggcgttgctttata

SEQ ID NO: 148250 - DNA, 22 bp, Artificial Sequence
  chemically synthesized
tcactatggcgttgctttataa

SEQ ID NO: 148251 - DNA, 22 bp, Artificial Sequence
  chemically synthesized
actatggcgttgctttataaac

SEQ ID NO: 148252 - DNA, 22 bp, Artificial Sequence
  chemically synthesized
tggcgttgctttataaactatg

SEQ ID NO: 148253 - DNA, 22 bp, Artificial Sequence
  chemically synthesized
ctttataaactatgttcagtat

SEQ ID NO: 148254 - DNA, 22 bp, Artificial Sequence
  chemically synthesized
tataaactatgttcagtatgtc

SEQ ID NO: 148255 - DNA, 22 bp, Artificial Sequence
  chemically synthesized
ataaactatgttcagtatgtct

SEQ ID NO: 148256 - DNA, 22 bp, Artificial Sequence
  chemically synthesized
taaactatgttcagtatgtctg

SEQ ID NO: 148257 - DNA, 22 bp, Artificial Sequence
  chemically synthesized
tgttcagtatgtctgaatgaaa

SEQ ID NO: 148258 - DNA, 22 bp, Artificial Sequence
  chemically synthesized
agtatgtctgaatgaaagggtg

SEQ ID NO: 148259 - DNA, 22 bp, Artificial Sequence
  chemically synthesized
aatgaaagggtgtgtgtgtgtg

SEQ ID NO: 148260 - DNA, 22 bp, Artificial Sequence
  chemically synthesized
gagttcatgaaaatttttcaat

SEQ ID NO: 148261 - DNA, 22 bp, Artificial Sequence
  chemically synthesized
agttcatgaaaatttttcaata

SEQ ID NO: 148262 - DNA, 22 bp, Artificial Sequence
  chemically synthesized
atgaaaatttttcaataaaata

SEQ ID NO: 148263 - DNA, 22 bp, Artificial Sequence
  chemically synthesized
ttcaataaaataatttaatgtc

SEQ ID NO: 148264 - DNA, 22 bp, Artificial Sequence
  chemically synthesized
tcaataaaataatttaatgtca

SEQ ID NO: 148265 - DNA, 22 bp, Artificial Sequence
  chemically synthesized
caataaaataatttaatgtcag

SEQ ID NO: 148266 - DNA, 22 bp, Artificial Sequence
  chemically synthesized
aataaaataatttaatgtcagg

SEQ ID NO: 148267 - DNA, 22 bp, Artificial Sequence
  chemically synthesized
aatgtcaggagaattaagccta

SEQ ID NO: 148268 - DNA, 22 bp, Artificial Sequence
  chemically synthesized
atgtcaggagaattaagcctaa

SEQ ID NO: 148269 - DNA, 22 bp, Artificial Sequence
  chemically synthesized
agcctaatagtctcctaaatca

SEQ ID NO: 148270 - DNA, 22 bp, Artificial Sequence
  chemically synthesized
atagtctcctaaatcatccatc

SEQ ID NO: 148271 - DNA, 22 bp, Artificial Sequence
  chemically synthesized
ctaaatcatccatctcttgagc

SEQ ID NO: 148272 - DNA, 22 bp, Artificial Sequence
  chemically synthesized
aatcatccatctcttgagcttc

SEQ ID NO: 148273 - DNA, 22 bp, Artificial Sequence
  chemically synthesized
ttgagcttcagagcagtcctct

SEQ ID NO: 148274 - DNA, 22 bp, Artificial Sequence
  chemically synthesized
gagcttcagagcagtcctctga

SEQ ID NO: 148275 - DNA, 22 bp, Artificial Sequence
  chemically synthesized
agcttcagagcagtcctctgaa

SEQ ID NO: 148276 - DNA, 22 bp, Artificial Sequence
  chemically synthesized
cagagcagtcctctgaattaat

SEQ ID NO: 148277 - DNA, 22 bp, Artificial Sequence
  chemically synthesized
agagcagtcctctgaattaatg

SEQ ID NO: 148278 - DNA, 22 bp, Artificial Sequence
  chemically synthesized
tgaattaatgcctacatgtttg

SEQ ID NO: 148279 - DNA, 22 bp, Artificial Sequence
  chemically synthesized
aattaatgcctacatgtttgta

SEQ ID NO: 148280 - DNA, 22 bp, Artificial Sequence
  chemically synthesized
atgcctacatgtttgtaaaggg

SEQ ID NO: 148281 - DNA, 22 bp, Artificial Sequence
  chemically synthesized
catgtttgtaaagggtgttcag

SEQ ID NO: 148282 - DNA, 22 bp, Artificial Sequence
  chemically synthesized
gtaaagggtgttcagactgaag

SEQ ID NO: 148283 - DNA, 22 bp, Artificial Sequence
  chemically synthesized
taaagggtgttcagactgaagc

SEQ ID NO: 148284 - DNA, 22 bp, Artificial Sequence
  chemically synthesized
agactgaagccaagattctacc

SEQ ID NO: 148285 - DNA, 22 bp, Artificial Sequence
  chemically synthesized
aagccaagattctacctctaaa

SEQ ID NO: 148286 - DNA, 22 bp, Artificial Sequence
  chemically synthesized
tacctctaaagagatgcaatct

SEQ ID NO: 148287 - DNA, 22 bp, Artificial Sequence
  chemically synthesized
cctctaaagagatgcaatctca

SEQ ID NO: 148288 - DNA, 22 bp, Artificial Sequence
  chemically synthesized
taaagagatgcaatctcaaatt

SEQ ID NO: 148289 - DNA, 22 bp, Artificial Sequence
  chemically synthesized
aagagatgcaatctcaaattta

SEQ ID NO: 148290 - DNA, 22 bp, Artificial Sequence
  chemically synthesized
aaatttatctgaagactgtacc

SEQ ID NO: 148291 - DNA, 22 bp, Artificial Sequence
  chemically synthesized
atctgaagactgtacctctgct

SEQ ID NO: 148292 - DNA, 22 bp, Artificial Sequence
  chemically synthesized
tctgaagactgtacctctgctc

SEQ ID NO: 148293 - DNA, 22 bp, Artificial Sequence
  chemically synthesized
aagactgtacctctgctctcca

SEQ ID NO: 148294 - DNA, 22 bp, Artificial Sequence
  chemically synthesized
tacctctgctctccataaattg

SEQ ID NO: 148295 - DNA, 22 bp, Artificial Sequence
  chemically synthesized
tgctctccataaattgacacca

SEQ ID NO: 148296 - DNA, 22 bp, Artificial Sequence
  chemically synthesized
ctctccataaattgacaccatg

SEQ ID NO: 148297 - DNA, 22 bp, Artificial Sequence
  chemically synthesized
tccataaattgacaccatggcc

SEQ ID NO: 148298 - DNA, 22 bp, Artificial Sequence
  chemically synthesized
cataaattgacaccatggccca

SEQ ID NO: 148299 - DNA, 22 bp, Artificial Sequence
  chemically synthesized
acaccatggcccacttaatgag

SEQ ID NO: 148300 - DNA, 22 bp, Artificial Sequence
  chemically synthesized
aatgaggttaaaaaaaagctaa

SEQ ID NO: 148301 - DNA, 22 bp, Artificial Sequence
  chemically synthesized
atgaggttaaaaaaaagctaat

SEQ ID NO: 148302 - DNA, 22 bp, Artificial Sequence
  chemically synthesized
aaaaaaagctaattctgaatga

SEQ ID NO: 148303 - DNA, 22 bp, Artificial Sequence
  chemically synthesized
attctgaatgaaaatctgagcc

SEQ ID NO: 148304 - DNA, 22 bp, Artificial Sequence
  chemically synthesized
tgaatgaaaatctgagcccagt

SEQ ID NO: 148305 - DNA, 22 bp, Artificial Sequence
  chemically synthesized
aatgaaaatctgagcccagtgg

SEQ ID NO: 148306 - DNA, 22 bp, Artificial Sequence
  chemically synthesized
agcccagtggaggaaatattaa

SEQ ID NO: 148307 - DNA, 22 bp, Artificial Sequence
  chemically synthesized
atgaacaaggtgcagactgaaa

SEQ ID NO: 148308 - DNA, 22 bp, Artificial Sequence
  chemically synthesized
aaatataaatttttctgtaata

SEQ ID NO: 148309 - DNA, 22 bp, Artificial Sequence
  chemically synthesized
ttctgtaataattatgcatata

SEQ ID NO: 148310 - DNA, 22 bp, Artificial Sequence
  chemically synthesized
tctgtaataattatgcatatac

SEQ ID NO: 148311 - DNA, 22 bp, Artificial Sequence
  chemically synthesized
ctgtaataattatgcatatact

SEQ ID NO: 148312 - DNA, 22 bp, Artificial Sequence
  chemically synthesized
tgtaataattatgcatatactt

SEQ ID NO: 148313 - DNA, 22 bp, Artificial Sequence
  chemically synthesized
taataattatgcatatacttta

SEQ ID NO: 148314 - DNA, 22 bp, Artificial Sequence
  chemically synthesized
tgcatatactttagcaaagttc

SEQ ID NO: 148315 - DNA, 22 bp, Artificial Sequence
  chemically synthesized
tagcaaagttctgtctatgttg

SEQ ID NO: 148316 - DNA, 22 bp, Artificial Sequence
  chemically synthesized
agcaaagttctgtctatgttga

SEQ ID NO: 148317 - DNA, 22 bp, Artificial Sequence
  chemically synthesized
gcaaagttctgtctatgttgac

SEQ ID NO: 148318 - DNA, 22 bp, Artificial Sequence
  chemically synthesized
tgtctatgttgactttattgct

SEQ ID NO: 148319 - DNA, 22 bp, Artificial Sequence
  chemically synthesized
tctatgttgactttattgcttt

SEQ ID NO: 148320 - DNA, 22 bp, Artificial Sequence
  chemically synthesized
tgttgactttattgctttttgg

SEQ ID NO: 148321 - DNA, 22 bp, Artificial Sequence
  chemically synthesized
actttattgctttttggtaaga

SEQ ID NO: 148322 - DNA, 22 bp, Artificial Sequence
  chemically synthesized
tattgctttttggtaagaaata

SEQ ID NO: 148323 - DNA, 22 bp, Artificial Sequence
  chemically synthesized
attgctttttggtaagaaatac

SEQ ID NO: 148324 - DNA, 22 bp, Artificial Sequence
  chemically synthesized
ttgctttttggtaagaaataca

SEQ ID NO: 148325 - DNA, 22 bp, Artificial Sequence
  chemically synthesized
ctttttggtaagaaatacaact

SEQ ID NO: 148326 - DNA, 22 bp, Artificial Sequence
  chemically synthesized
tttggtaagaaatacaactttt

SEQ ID NO: 148327 - DNA, 22 bp, Artificial Sequence
  chemically synthesized
ttggtaagaaatacaacttttt

SEQ ID NO: 148328 - DNA, 22 bp, Artificial Sequence
  chemically synthesized
tggtaagaaatacaacttttta

SEQ ID NO: 148329 - DNA, 22 bp, Artificial Sequence
  chemically synthesized
ggtaagaaatacaactttttaa

SEQ ID NO: 148330 - DNA, 22 bp, Artificial Sequence
  chemically synthesized
gtaagaaatacaactttttaaa

SEQ ID NO: 148331 - DNA, 22 bp, Artificial Sequence
  chemically synthesized
tttaaagtgaactaaactatcc

SEQ ID NO: 148332 - DNA, 22 bp, Artificial Sequence
  chemically synthesized
ttaaagtgaactaaactatcct

SEQ ID NO: 148333 - DNA, 22 bp, Artificial Sequence
  chemically synthesized
taaagtgaactaaactatccta

SEQ ID NO: 148334 - DNA, 22 bp, Artificial Sequence
  chemically synthesized
aaagtgaactaaactatcctat

SEQ ID NO: 148335 - DNA, 22 bp, Artificial Sequence
  chemically synthesized
aagtgaactaaactatcctatt

SEQ ID NO: 148336 - DNA, 22 bp, Artificial Sequence
  chemically synthesized
aactatcctatttccaaactat

SEQ ID NO: 148337 - DNA, 22 bp, Artificial Sequence
  chemically synthesized
tcctatttccaaactattttgt

SEQ ID NO: 148338 - DNA, 22 bp, Artificial Sequence
  chemically synthesized
tttccaaactattttgtgtgtg

SEQ ID NO: 148339 - DNA, 22 bp, Artificial Sequence
  chemically synthesized
ccaaactattttgtgtgtgtgc

SEQ ID NO: 148340 - DNA, 22 bp, Artificial Sequence
  chemically synthesized
caaactattttgtgtgtgtgcg

SEQ ID NO: 148341 - DNA, 22 bp, Artificial Sequence
  chemically synthesized
ttttgtgtgtgtgcggtttgtt

SEQ ID NO: 148342 - DNA, 22 bp, Artificial Sequence
  chemically synthesized
tgtgtgtgtgcggtttgtttct

SEQ ID NO: 148343 - DNA, 22 bp, Artificial Sequence
  chemically synthesized
gtgtgtgtgcggtttgtttcta

SEQ ID NO: 148344 - DNA, 22 bp, Artificial Sequence
  chemically synthesized
tgtgtgtgcggtttgtttctat

SEQ ID NO: 148345 - DNA, 22 bp, Artificial Sequence
  chemically synthesized
gtttctatgggttctggttttc

SEQ ID NO: 148346 - DNA, 22 bp, Artificial Sequence
  chemically synthesized
tttctatgggttctggttttct

SEQ ID NO: 148347 - DNA, 22 bp, Artificial Sequence
  chemically synthesized
ctatgggttctggttttcttgg

SEQ ID NO: 148348 - DNA, 22 bp, Artificial Sequence
  chemically synthesized
tatgggttctggttttcttgga

SEQ ID NO: 148349 - DNA, 22 bp, Artificial Sequence
  chemically synthesized
tgggttctggttttcttggagc

SEQ ID NO: 148350 - DNA, 22 bp, Artificial Sequence
  chemically synthesized
tggttttcttggagcattttta

SEQ ID NO: 148351 - DNA, 22 bp, Artificial Sequence
  chemically synthesized
gttttcttggagcatttttatt

SEQ ID NO: 148352 - DNA, 22 bp, Artificial Sequence
  chemically synthesized
tcttggagcatttttatttcat

SEQ ID NO: 148353 - DNA, 22 bp, Artificial Sequence
  chemically synthesized
cttggagcatttttatttcatt

SEQ ID NO: 148354 - DNA, 22 bp, Artificial Sequence
  chemically synthesized
ttggagcatttttatttcattt

SEQ ID NO: 148355 - DNA, 22 bp, Artificial Sequence
  chemically synthesized
ggagcatttttatttcatttta

SEQ ID NO: 148356 - DNA, 22 bp, Artificial Sequence
  chemically synthesized
gagcatttttatttcattttaa

SEQ ID NO: 148357 - DNA, 22 bp, Artificial Sequence
  chemically synthesized
ttatttcattttaattaattaa

SEQ ID NO: 148358 - DNA, 22 bp, Artificial Sequence
  chemically synthesized
tatttcattttaattaattaat

SEQ ID NO: 148359 - DNA, 22 bp, Artificial Sequence
  chemically synthesized
atttcattttaattaattaatt

SEQ ID NO: 148360 - DNA, 22 bp, Artificial Sequence
  chemically synthesized
tttcattttaattaattaattc

SEQ ID NO: 148361 - DNA, 22 bp, Artificial Sequence
  chemically synthesized
cattttaattaattaattctga

SEQ ID NO: 148362 - DNA, 22 bp, Artificial Sequence
  chemically synthesized
attttaattaattaattctgag

SEQ ID NO: 148363 - DNA, 22 bp, Artificial Sequence
  chemically synthesized
taattaattaattctgagagct

SEQ ID NO: 148364 - DNA, 22 bp, Artificial Sequence
  chemically synthesized
aattaattaattctgagagctg

SEQ ID NO: 148365 - DNA, 22 bp, Artificial Sequence
  chemically synthesized
attaattaattctgagagctgc

SEQ ID NO: 148366 - DNA, 22 bp, Artificial Sequence
  chemically synthesized
attaattctgagagctgctgag

SEQ ID NO: 148367 - DNA, 22 bp, Artificial Sequence
  chemically synthesized
attctgagagctgctgagttgt

SEQ ID NO: 148368 - DNA, 22 bp, Artificial Sequence
  chemically synthesized
tgagagctgctgagttgtgttt

SEQ ID NO: 148369 - DNA, 22 bp, Artificial Sequence
  chemically synthesized
agagctgctgagttgtgtttac

SEQ ID NO: 148370 - DNA, 22 bp, Artificial Sequence
  chemically synthesized
ctgagttgtgtttactgagaga

SEQ ID NO: 148371 - DNA, 22 bp, Artificial Sequence
  chemically synthesized
agttgtgtttactgagagattg

SEQ ID NO: 148372 - DNA, 22 bp, Artificial Sequence
  chemically synthesized
tgtttactgagagattgtgtat

SEQ ID NO: 148373 - DNA, 22 bp, Artificial Sequence
  chemically synthesized
actgagagattgtgtatctgcg

SEQ ID NO: 148374 - DNA, 22 bp, Artificial Sequence
  chemically synthesized
ctgagagattgtgtatctgcga

SEQ ID NO: 148375 - DNA, 22 bp, Artificial Sequence
  chemically synthesized
agagattgtgtatctgcgagag

SEQ ID NO: 148376 - DNA, 22 bp, Artificial Sequence
  chemically synthesized
tgtatctgcgagagaagtctgt

SEQ ID NO: 148377 - DNA, 22 bp, Artificial Sequence
  chemically synthesized
cgagagaagtctgtagcaagta

SEQ ID NO: 148378 - DNA, 22 bp, Artificial Sequence
  chemically synthesized
tagcaagtagctagactgtgct

SEQ ID NO: 148379 - DNA, 22 bp, Artificial Sequence
  chemically synthesized
gactgtgcttgacctaggaaca

SEQ ID NO: 148380 - DNA, 22 bp, Artificial Sequence
  chemically synthesized
tgcttgacctaggaacatatac

SEQ ID NO: 148381 - DNA, 22 bp, Artificial Sequence
  chemically synthesized
gacctaggaacatatacagtag

SEQ ID NO: 148382 - DNA, 22 bp, Artificial Sequence
  chemically synthesized
acctaggaacatatacagtaga

SEQ ID NO: 148383 - DNA, 22 bp, Artificial Sequence
  chemically synthesized
ggaacatatacagtagattgct

SEQ ID NO: 148384 - DNA, 22 bp, Artificial Sequence
  chemically synthesized
ctaaaatgtctcacttggggaa

SEQ ID NO: 148385 - DNA, 22 bp, Artificial Sequence
  chemically synthesized
aaatgtctcacttggggaattt

SEQ ID NO: 148386 - DNA, 22 bp, Artificial Sequence
  chemically synthesized
acttggggaattttagactaaa

SEQ ID NO: 148387 - DNA, 22 bp, Artificial Sequence
  chemically synthesized
ggggaattttagactaaacagt

SEQ ID NO: 148388 - DNA, 22 bp, Artificial Sequence
  chemically synthesized
gggaattttagactaaacagta

SEQ ID NO: 148389 - DNA, 22 bp, Artificial Sequence
  chemically synthesized
tagactaaacagtagagcatgt

SEQ ID NO: 148390 - DNA, 22 bp, Artificial Sequence
  chemically synthesized
agactaaacagtagagcatgta

SEQ ID NO: 148391 - DNA, 22 bp, Artificial Sequence
  chemically synthesized
gactaaacagtagagcatgtat

SEQ ID NO: 148392 - DNA, 22 bp, Artificial Sequence
  chemically synthesized
aacagtagagcatgtataaaaa

SEQ ID NO: 148393 - DNA, 22 bp, Artificial Sequence
  chemically synthesized
tagtcaagtgctgcttttgaaa

SEQ ID NO: 148394 - DNA, 22 bp, Artificial Sequence
  chemically synthesized
gtcaagtgctgcttttgaaaca

SEQ ID NO: 148395 - DNA, 22 bp, Artificial Sequence
  chemically synthesized
cttttgaaacaaatgataaaac

SEQ ID NO: 148396 - DNA, 22 bp, Artificial Sequence
  chemically synthesized
ttgaaacaaatgataaaaccac

SEQ ID NO: 148397 - DNA, 22 bp, Artificial Sequence
  chemically synthesized
tgaaacaaatgataaaaccaca

SEQ ID NO: 148398 - DNA, 22 bp, Artificial Sequence
  chemically synthesized
gaaacaaatgataaaaccacac

SEQ ID NO: 148399 - DNA, 22 bp, Artificial Sequence
  chemically synthesized
aaacaaatgataaaaccacact

SEQ ID NO: 148400 - DNA, 22 bp, Artificial Sequence
  chemically synthesized
ccatagatgagtgtcatgattt

SEQ ID NO: 148401 - DNA, 22 bp, Artificial Sequence
  chemically synthesized
tcatggaggaagttaatattca

SEQ ID NO: 148402 - DNA, 22 bp, Artificial Sequence
  chemically synthesized
catggaggaagttaatattcat

SEQ ID NO: 148403 - DNA, 22 bp, Artificial Sequence
  chemically synthesized
atggaggaagttaatattcatc

SEQ ID NO: 148404 - DNA, 22 bp, Artificial Sequence
  chemically synthesized
atattcatcctctaagtatacc

SEQ ID NO: 148405 - DNA, 22 bp, Artificial Sequence
  chemically synthesized
atcctctaagtatacccagact

SEQ ID NO: 148406 - DNA, 22 bp, Artificial Sequence
  chemically synthesized
taagtatacccagactagggcc

SEQ ID NO: 148407 - DNA, 22 bp, Artificial Sequence
  chemically synthesized
agtatacccagactagggccat

SEQ ID NO: 148408 - DNA, 22 bp, Artificial Sequence
  chemically synthesized
gggccattctgatataaaacat

SEQ ID NO: 148409 - DNA, 22 bp, Artificial Sequence
  chemically synthesized
tgatataaaacattaggactta

SEQ ID NO: 148410 - DNA, 22 bp, Artificial Sequence
  chemically synthesized
atataaaacattaggacttaag

SEQ ID NO: 148411 - DNA, 22 bp, Artificial Sequence
  chemically synthesized
ggacttaagaaagattaataga

SEQ ID NO: 148412 - DNA, 22 bp, Artificial Sequence
  chemically synthesized
aagaaagattaatagactggag

SEQ ID NO: 148413 - DNA, 22 bp, Artificial Sequence
  chemically synthesized
agaaagattaatagactggagt

SEQ ID NO: 148414 - DNA, 22 bp, Artificial Sequence
  chemically synthesized
atagactggagtaaaggaaatg

SEQ ID NO: 148415 - DNA, 22 bp, Artificial Sequence
  chemically synthesized
gagtaaaggaaatggacctctg

SEQ ID NO: 148416 - DNA, 22 bp, Artificial Sequence
  chemically synthesized
tgtctctctcgctgtctctttt

SEQ ID NO: 148417 - DNA, 22 bp, Artificial Sequence
  chemically synthesized
tctctctcgctgtctctttttt

SEQ ID NO: 148418 - DNA, 22 bp, Artificial Sequence
  chemically synthesized
tctcgctgtctcttttttgagg

SEQ ID NO: 148419 - DNA, 22 bp, Artificial Sequence
  chemically synthesized
tcgctgtctcttttttgaggac

SEQ ID NO: 148420 - DNA, 22 bp, Artificial Sequence
  chemically synthesized
gctgtctcttttttgaggactt

SEQ ID NO: 148421 - DNA, 22 bp, Artificial Sequence
  chemically synthesized
tctcttttttgaggacttgtgt

SEQ ID NO: 148422 - DNA, 22 bp, Artificial Sequence
  chemically synthesized
ttttttgaggacttgtgtgtgt

SEQ ID NO: 148423 - DNA, 22 bp, Artificial Sequence
  chemically synthesized
ttttgaggacttgtgtgtgtgt

SEQ ID NO: 148424 - DNA, 22 bp, Artificial Sequence
  chemically synthesized
tttgaggacttgtgtgtgtgtg

SEQ ID NO: 148425 - DNA, 22 bp, Artificial Sequence
  chemically synthesized
ttgaggacttgtgtgtgtgtgt

SEQ ID NO: 148426 - DNA, 22 bp, Artificial Sequence
  chemically synthesized
tgaggacttgtgtgtgtgtgtg

SEQ ID NO: 148427 - DNA, 22 bp, Artificial Sequence
  chemically synthesized
gaggacttgtgtgtgtgtgtgt

SEQ ID NO: 148428 - DNA, 22 bp, Artificial Sequence
  chemically synthesized
aggacttgtgtgtgtgtgtgtg

SEQ ID NO: 148429 - DNA, 22 bp, Artificial Sequence
  chemically synthesized
gtgtgtgtgtgtgtgtgtgtgt

SEQ ID NO: 148430 - DNA, 22 bp, Artificial Sequence
  chemically synthesized
tgtgtgtgtgtgtgtgtgtgtg

SEQ ID NO: 148431 - DNA, 22 bp, Artificial Sequence
  chemically synthesized
tggtcagtggggctggaataaa

SEQ ID NO: 148432 - DNA, 22 bp, Artificial Sequence
  chemically synthesized
gaataaaagtagaatagacctg

SEQ ID NO: 148433 - DNA, 22 bp, Artificial Sequence
  chemically synthesized
cacctgctgtggcatccattca

SEQ ID NO: 148434 - DNA, 22 bp, Artificial Sequence
  chemically synthesized
ctgtggcatccattcacagagt

SEQ ID NO: 148435 - DNA, 22 bp, Artificial Sequence
  chemically synthesized
tggcatccattcacagagtaga

SEQ ID NO: 148436 - DNA, 22 bp, Artificial Sequence
  chemically synthesized
acagagtagaagcaagctcaca

SEQ ID NO: 148437 - DNA, 22 bp, Artificial Sequence
  chemically synthesized
acaatagtgaagatgtcagtaa

SEQ ID NO: 148438 - DNA, 22 bp, Artificial Sequence
  chemically synthesized
gaatagtttttcaggaactttg

SEQ ID NO: 148439 - DNA, 22 bp, Artificial Sequence
  chemically synthesized
aatagtttttcaggaactttga

SEQ ID NO: 148440 - DNA, 22 bp, Artificial Sequence
  chemically synthesized
ttcaggaactttgaatgctgat

SEQ ID NO: 148441 - DNA, 22 bp, Artificial Sequence
  chemically synthesized
tcaggaactttgaatgctgatt

SEQ ID NO: 148442 - DNA, 22 bp, Artificial Sequence
  chemically synthesized
caggaactttgaatgctgattt

SEQ ID NO: 148443 - DNA, 22 bp, Artificial Sequence
  chemically synthesized
aggaactttgaatgctgattta

SEQ ID NO: 148444 - DNA, 22 bp, Artificial Sequence
  chemically synthesized
tgaatgctgatttagatttgaa

SEQ ID NO: 148445 - DNA, 22 bp, Artificial Sequence
  chemically synthesized
gaatgctgatttagatttgaaa

SEQ ID NO: 148446 - DNA, 22 bp, Artificial Sequence
  chemically synthesized
aatgctgatttagatttgaaac

SEQ ID NO: 148447 - DNA, 22 bp, Artificial Sequence
  chemically synthesized
atttagatttgaaactgaggct

SEQ ID NO: 148448 - DNA, 22 bp, Artificial Sequence
  chemically synthesized
agatttgaaactgaggctctga

SEQ ID NO: 148449 - DNA, 22 bp, Artificial Sequence
  chemically synthesized
gatttgaaactgaggctctgac

SEQ ID NO: 148450 - DNA, 22 bp, Artificial Sequence
  chemically synthesized
gaaactgaggctctgaccataa

SEQ ID NO: 148451 - DNA, 22 bp, Artificial Sequence
  chemically synthesized
aaactgaggctctgaccataac

SEQ ID NO: 148452 - DNA, 22 bp, Artificial Sequence
  chemically synthesized
aggctctgaccataaccaaatt

SEQ ID NO: 148453 - DNA, 22 bp, Artificial Sequence
  chemically synthesized
tgaccataaccaaatttgcact

SEQ ID NO: 148454 - DNA, 22 bp, Artificial Sequence
  chemically synthesized
accataaccaaatttgcactat

SEQ ID NO: 148455 - DNA, 22 bp, Artificial Sequence
  chemically synthesized
gcactatttattgcttcttgaa

SEQ ID NO: 148456 - DNA, 22 bp, Artificial Sequence
  chemically synthesized
cactatttattgcttcttgaaa

SEQ ID NO: 148457 - DNA, 22 bp, Artificial Sequence
  chemically synthesized
tttattgcttcttgaaacttat

SEQ ID NO: 148458 - DNA, 22 bp, Artificial Sequence
  chemically synthesized
attgcttcttgaaacttatttg

SEQ ID NO: 148459 - DNA, 22 bp, Artificial Sequence
  chemically synthesized
ttgcttcttgaaacttatttgc

SEQ ID NO: 148460 - DNA, 22 bp, Artificial Sequence
  chemically synthesized
cttcttgaaacttatttgcctg

SEQ ID NO: 148461 - DNA, 22 bp, Artificial Sequence
  chemically synthesized
cttgaaacttatttgcctggta

SEQ ID NO: 148462 - DNA, 22 bp, Artificial Sequence
  chemically synthesized
ttgaaacttatttgcctggtat

SEQ ID NO: 148463 - DNA, 22 bp, Artificial Sequence
  chemically synthesized
gaaacttatttgcctggtatgc

SEQ ID NO: 148464 - DNA, 22 bp, Artificial Sequence
  chemically synthesized
aaacttatttgcctggtatgcc

SEQ ID NO: 148465 - DNA, 22 bp, Artificial Sequence
  chemically synthesized
atttgcctggtatgcctgggct

SEQ ID NO: 148466 - DNA, 22 bp, Artificial Sequence
  chemically synthesized
tttgcctggtatgcctgggctt

SEQ ID NO: 148467 - DNA, 22 bp, Artificial Sequence
  chemically synthesized
gcctggtatgcctgggcttttg

SEQ ID NO: 148468 - DNA, 22 bp, Artificial Sequence
  chemically synthesized
cctggtatgcctgggcttttga

SEQ ID NO: 148469 - DNA, 22 bp, Artificial Sequence
  chemically synthesized
gtatgcctgggcttttgatggt

SEQ ID NO: 148470 - DNA, 22 bp, Artificial Sequence
  chemically synthesized
ggcttttgatggtcttagtata

SEQ ID NO: 148471 - DNA, 22 bp, Artificial Sequence
  chemically synthesized
ttgatggtcttagtatagcttg

SEQ ID NO: 148472 - DNA, 22 bp, Artificial Sequence
  chemically synthesized
tgatggtcttagtatagcttgc

SEQ ID NO: 148473 - DNA, 22 bp, Artificial Sequence
  chemically synthesized
gatggtcttagtatagcttgca

SEQ ID NO: 148474 - DNA, 22 bp, Artificial Sequence
  chemically synthesized
atggtcttagtatagcttgcag

SEQ ID NO: 148475 - DNA, 22 bp, Artificial Sequence
  chemically synthesized
agtatagcttgcagccttgtcc

SEQ ID NO: 148476 - DNA, 22 bp, Artificial Sequence
  chemically synthesized
gtatagcttgcagccttgtccc

SEQ ID NO: 148477 - DNA, 22 bp, Artificial Sequence
  chemically synthesized
gcagccttgtccctgcagggta

SEQ ID NO: 148478 - DNA, 22 bp, Artificial Sequence
  chemically synthesized
cagccttgtccctgcagggtat

SEQ ID NO: 148479 - DNA, 22 bp, Artificial Sequence
  chemically synthesized
gtccctgcagggtattatgggt

SEQ ID NO: 148480 - DNA, 22 bp, Artificial Sequence
  chemically synthesized
tccctgcagggtattatgggta

SEQ ID NO: 148481 - DNA, 22 bp, Artificial Sequence
  chemically synthesized
cagggtattatgggtaatagaa

SEQ ID NO: 148482 - DNA, 22 bp, Artificial Sequence
  chemically synthesized
tgggtaatagaaagaaaagtct

SEQ ID NO: 148483 - DNA, 22 bp, Artificial Sequence
  chemically synthesized
cgttacactctagtcacactaa

SEQ ID NO: 148484 - DNA, 22 bp, Artificial Sequence
  chemically synthesized
cactctagtcacactaagtaac

SEQ ID NO: 148485 - DNA, 22 bp, Artificial Sequence
  chemically synthesized
tagtcacactaagtaactacca

SEQ ID NO: 148486 - DNA, 22 bp, Artificial Sequence
  chemically synthesized
gtcacactaagtaactaccatt

SEQ ID NO: 148487 - DNA, 22 bp, Artificial Sequence
  chemically synthesized
agtaactaccattggaaaagca

SEQ ID NO: 148488 - DNA, 22 bp, Artificial Sequence
  chemically synthesized
ccattggaaaagcaacccctgc

SEQ ID NO: 148489 - DNA, 22 bp, Artificial Sequence
  chemically synthesized
gaaaagcaacccctgccttgaa

SEQ ID NO: 148490 - DNA, 22 bp, Artificial Sequence
  chemically synthesized
ccttgaagccaggatgatggta

SEQ ID NO: 148491 - DNA, 22 bp, Artificial Sequence
  chemically synthesized
gaagccaggatgatggtatctg

SEQ ID NO: 148492 - DNA, 22 bp, Artificial Sequence
  chemically synthesized
aagccaggatgatggtatctgc

SEQ ID NO: 148493 - DNA, 22 bp, Artificial Sequence
  chemically synthesized
cagcagttgccaacacaagaga

SEQ ID NO: 148494 - DNA, 22 bp, Artificial Sequence
  chemically synthesized
ccaacacaagagaaggatccat

SEQ ID NO: 148495 - DNA, 22 bp, Artificial Sequence
  chemically synthesized
atcatttaaaaaagaaaacaaa

SEQ ID NO: 148496 - DNA, 22 bp, Artificial Sequence
  chemically synthesized
aaaaaagaaaacaaaatagaaa

SEQ ID NO: 148497 - DNA, 22 bp, Artificial Sequence
  chemically synthesized
aaaaagaaaacaaaatagaaaa

SEQ ID NO: 148498 - DNA, 22 bp, Artificial Sequence
  chemically synthesized
tttctgagcataagaagttgta

SEQ ID NO: 148499 - DNA, 22 bp, Artificial Sequence
  chemically synthesized
ctgagcataagaagttgtaggg

SEQ ID NO: 148500 - DNA, 22 bp, Artificial Sequence
  chemically synthesized
tgagcataagaagttgtagggt

SEQ ID NO: 148501 - DNA, 22 bp, Artificial Sequence
  chemically synthesized
agcataagaagttgtagggtaa

SEQ ID NO: 148502 - DNA, 22 bp, Artificial Sequence
  chemically synthesized
tagggtaagtctttaagaaggt

SEQ ID NO: 148503 - DNA, 22 bp, Artificial Sequence
  chemically synthesized
taagaaggtgacaatttctgcc

SEQ ID NO: 148504 - DNA, 22 bp, Artificial Sequence
  chemically synthesized
aagaaggtgacaatttctgcca

SEQ ID NO: 148505 - DNA, 22 bp, Artificial Sequence
  chemically synthesized
agaaggtgacaatttctgccaa

SEQ ID NO: 148506 - DNA, 22 bp, Artificial Sequence
  chemically synthesized
ctgccaatcaggatttcaaagc

SEQ ID NO: 148507 - DNA, 22 bp, Artificial Sequence
  chemically synthesized
tgccaatcaggatttcaaagct

SEQ ID NO: 148508 - DNA, 22 bp, Artificial Sequence
  chemically synthesized
ccaatcaggatttcaaagctct

SEQ ID NO: 148509 - DNA, 22 bp, Artificial Sequence
  chemically synthesized
caaagctcttgctttgacaatt

SEQ ID NO: 148510 - DNA, 22 bp, Artificial Sequence
  chemically synthesized
aaagctcttgctttgacaattt

SEQ ID NO: 148511 - DNA, 22 bp, Artificial Sequence
  chemically synthesized
ttgctttgacaattttggtctt

SEQ ID NO: 148512 - DNA, 22 bp, Artificial Sequence
  chemically synthesized
gctttgacaattttggtctttc

SEQ ID NO: 148513 - DNA, 22 bp, Artificial Sequence
  chemically synthesized
ctttgacaattttggtctttca

SEQ ID NO: 148514 - DNA, 22 bp, Artificial Sequence
  chemically synthesized
tgacaattttggtctttcagaa

SEQ ID NO: 148515 - DNA, 22 bp, Artificial Sequence
  chemically synthesized
gacaattttggtctttcagaat

SEQ ID NO: 148516 - DNA, 22 bp, Artificial Sequence
  chemically synthesized
acaattttggtctttcagaata

SEQ ID NO: 148517 - DNA, 22 bp, Artificial Sequence
  chemically synthesized
tggtctttcagaatactataaa

SEQ ID NO: 148518 - DNA, 22 bp, Artificial Sequence
  chemically synthesized
ggtctttcagaatactataaat

SEQ ID NO: 148519 - DNA, 22 bp, Artificial Sequence
  chemically synthesized
gtctttcagaatactataaata

SEQ ID NO: 148520 - DNA, 22 bp, Artificial Sequence
  chemically synthesized
tcagaatactataaatataacc

SEQ ID NO: 148521 - DNA, 22 bp, Artificial Sequence
  chemically synthesized
cagaatactataaatataacct

SEQ ID NO: 148522 - DNA, 22 bp, Artificial Sequence
  chemically synthesized
agaatactataaatataaccta

SEQ ID NO: 148523 - DNA, 22 bp, Artificial Sequence
  chemically synthesized
taaatataacctatattataat

SEQ ID NO: 148524 - DNA, 22 bp, Artificial Sequence
  chemically synthesized
tattataatttcataaagtctg

SEQ ID NO: 148525 - DNA, 22 bp, Artificial Sequence
  chemically synthesized
taatttcataaagtctgtgcat

SEQ ID NO: 148526 - DNA, 22 bp, Artificial Sequence
  chemically synthesized
cataaagtctgtgcattttctt

SEQ ID NO: 148527 - DNA, 22 bp, Artificial Sequence
  chemically synthesized
ataaagtctgtgcattttcttt

SEQ ID NO: 148528 - DNA, 22 bp, Artificial Sequence
  chemically synthesized
tgcattttctttgacccaggat

SEQ ID NO: 148529 - DNA, 22 bp, Artificial Sequence
  chemically synthesized
tctttgacccaggatatttgca

SEQ ID NO: 148530 - DNA, 22 bp, Artificial Sequence
  chemically synthesized
ctttgacccaggatatttgcaa

SEQ ID NO: 148531 - DNA, 22 bp, Artificial Sequence
  chemically synthesized
tttgacccaggatatttgcaaa

SEQ ID NO: 148532 - DNA, 22 bp, Artificial Sequence
  chemically synthesized
tgacccaggatatttgcaaaag

SEQ ID NO: 148533 - DNA, 22 bp, Artificial Sequence
  chemically synthesized
gacccaggatatttgcaaaaga

SEQ ID NO: 148534 - DNA, 22 bp, Artificial Sequence
  chemically synthesized
acccaggatatttgcaaaagac

SEQ ID NO: 148535 - DNA, 22 bp, Artificial Sequence
  chemically synthesized
gcaaaagacatattcaaacttc

SEQ ID NO: 148536 - DNA, 22 bp, Artificial Sequence
  chemically synthesized
caaaagacatattcaaacttcc

SEQ ID NO: 148537 - DNA, 22 bp, Artificial Sequence
  chemically synthesized
aaacttccgcagaacactttat

SEQ ID NO: 148538 - DNA, 22 bp, Artificial Sequence
  chemically synthesized
ccgcagaacactttatttcaca

SEQ ID NO: 148539 - DNA, 22 bp, Artificial Sequence
  chemically synthesized
cgcagaacactttatttcacat

SEQ ID NO: 148540 - DNA, 22 bp, Artificial Sequence
  chemically synthesized
tatttcacatatacatgcctct

SEQ ID NO: 148541 - DNA, 22 bp, Artificial Sequence
  chemically synthesized
atttcacatatacatgcctctt

SEQ ID NO: 148542 - DNA, 22 bp, Artificial Sequence
  chemically synthesized
tttcacatatacatgcctctta

SEQ ID NO: 148543 - DNA, 22 bp, Artificial Sequence
  chemically synthesized
cacatatacatgcctcttatat

SEQ ID NO: 148544 - DNA, 22 bp, Artificial Sequence
  chemically synthesized
acatatacatgcctcttatatc

SEQ ID NO: 148545 - DNA, 22 bp, Artificial Sequence
  chemically synthesized
ttatatcagggatgtgaaacag

SEQ ID NO: 148546 - DNA, 22 bp, Artificial Sequence
  chemically synthesized
atatcagggatgtgaaacaggg

SEQ ID NO: 148547 - DNA, 22 bp, Artificial Sequence
  chemically synthesized
tatcagggatgtgaaacagggt

SEQ ID NO: 148548 - DNA, 22 bp, Artificial Sequence
  chemically synthesized
gaaaactgtctaaatctaaaac

SEQ ID NO: 148549 - DNA, 22 bp, Artificial Sequence
  chemically synthesized
aaaactgtctaaatctaaaaca

SEQ ID NO: 148550 - DNA, 22 bp, Artificial Sequence
  chemically synthesized
tctaaatctaaaacaatgctaa

SEQ ID NO: 148551 - DNA, 22 bp, Artificial Sequence
  chemically synthesized
aatctaaaacaatgctaatgca

SEQ ID NO: 148552 - DNA, 22 bp, Artificial Sequence
  chemically synthesized
aaacaatgctaatgcaggttta

SEQ ID NO: 148553 - DNA, 22 bp, Artificial Sequence
  chemically synthesized
atgcaggtttaaatttaataaa

SEQ ID NO: 148554 - DNA, 22 bp, Artificial Sequence
  chemically synthesized
aaatttaataaaataaaatcca

SEQ ID NO: 148555 - DNA, 22 bp, Artificial Sequence
  chemically synthesized
aatttaataaaataaaatccaa

SEQ ID NO: 148556 - DNA, 22 bp, Artificial Sequence
  chemically synthesized
aataaaataaaatccaaaatct

SEQ ID NO: 148557 - DNA, 22 bp, Artificial Sequence
  chemically synthesized
ataaaataaaatccaaaatcta

SEQ ID NO: 148558 - DNA, 22 bp, Artificial Sequence
  chemically synthesized
acagccaagtcaaatctgcatg

SEQ ID NO: 148559 - DNA, 22 bp, Artificial Sequence
  chemically synthesized
catgttttaacatttaaaatat

SEQ ID NO: 148560 - DNA, 22 bp, Artificial Sequence
  chemically synthesized
taacatttaaaatattttaaag

SEQ ID NO: 148561 - DNA, 22 bp, Artificial Sequence
  chemically synthesized
aacatttaaaatattttaaaga

SEQ ID NO: 148562 - DNA, 22 bp, Artificial Sequence
  chemically synthesized
acatttaaaatattttaaagac

SEQ ID NO: 148563 - DNA, 22 bp, Artificial Sequence
  chemically synthesized
aaaatattttaaagacgtcttt

SEQ ID NO: 148564 - DNA, 22 bp, Artificial Sequence
  chemically synthesized
aaatattttaaagacgtctttt

SEQ ID NO: 148565 - DNA, 22 bp, Artificial Sequence
  chemically synthesized
taaagacgtcttttcccaggat

SEQ ID NO: 148566 - DNA, 22 bp, Artificial Sequence
  chemically synthesized
aaagacgtcttttcccaggatt

SEQ ID NO: 148567 - DNA, 22 bp, Artificial Sequence
  chemically synthesized
aagacgtcttttcccaggattc

SEQ ID NO: 148568 - DNA, 22 bp, Artificial Sequence
  chemically synthesized
ttcccaggattcaacatgtgaa

SEQ ID NO: 148569 - DNA, 22 bp, Artificial Sequence
  chemically synthesized
tcccaggattcaacatgtgaaa

SEQ ID NO: 148570 - DNA, 22 bp, Artificial Sequence
  chemically synthesized
cccaggattcaacatgtgaaat

SEQ ID NO: 148571 - DNA, 22 bp, Artificial Sequence
  chemically synthesized
ccaggattcaacatgtgaaatc

SEQ ID NO: 148572 - DNA, 22 bp, Artificial Sequence
  chemically synthesized
aacatgtgaaatcttttctcag

SEQ ID NO: 148573 - DNA, 22 bp, Artificial Sequence
  chemically synthesized
ttctcagggatacacgtgtgcc

SEQ ID NO: 148574 - DNA, 22 bp, Artificial Sequence
  chemically synthesized
tctcagggatacacgtgtgcct

SEQ ID NO: 148575 - DNA, 22 bp, Artificial Sequence
  chemically synthesized
ctcagggatacacgtgtgccta

SEQ ID NO: 148576 - DNA, 22 bp, Artificial Sequence
  chemically synthesized
tcagggatacacgtgtgcctag

SEQ ID NO: 148577 - DNA, 22 bp, Artificial Sequence
  chemically synthesized
agggatacacgtgtgcctagat

SEQ ID NO: 148578 - DNA, 22 bp, Artificial Sequence
  chemically synthesized
gatcctcattgctttagttttt

SEQ ID NO: 148579 - DNA, 22 bp, Artificial Sequence
  chemically synthesized
attgctttagttttttacagag

SEQ ID NO: 148580 - DNA, 22 bp, Artificial Sequence
  chemically synthesized
ctttagttttttacagaggaat

SEQ ID NO: 148581 - DNA, 22 bp, Artificial Sequence
  chemically synthesized
tagttttttacagaggaatgaa

SEQ ID NO: 148582 - DNA, 22 bp, Artificial Sequence
  chemically synthesized
agttttttacagaggaatgaat

SEQ ID NO: 148583 - DNA, 22 bp, Artificial Sequence
  chemically synthesized
gttttttacagaggaatgaata

SEQ ID NO: 148584 - DNA, 22 bp, Artificial Sequence
  chemically synthesized
tttacagaggaatgaatataaa

SEQ ID NO: 148585 - DNA, 22 bp, Artificial Sequence
  chemically synthesized
ttacagaggaatgaatataaaa

SEQ ID NO: 148586 - DNA, 22 bp, Artificial Sequence
  chemically synthesized
tacagaggaatgaatataaaaa

SEQ ID NO: 148587 - DNA, 22 bp, Artificial Sequence
  chemically synthesized
acagaggaatgaatataaaaag

SEQ ID NO: 148588 - DNA, 22 bp, Artificial Sequence
  chemically synthesized
cagaggaatgaatataaaaaga

SEQ ID NO: 148589 - DNA, 22 bp, Artificial Sequence
  chemically synthesized
aaattttatccctcttacctct

SEQ ID NO: 148590 - DNA, 22 bp, Artificial Sequence
  chemically synthesized
aattttatccctcttacctcta

SEQ ID NO: 148591 - DNA, 22 bp, Artificial Sequence
  chemically synthesized
tatccctcttacctctataatc

SEQ ID NO: 148592 - DNA, 22 bp, Artificial Sequence
  chemically synthesized
atccctcttacctctataatca

SEQ ID NO: 148593 - DNA, 22 bp, Artificial Sequence
  chemically synthesized
tccctcttacctctataatcat

SEQ ID NO: 148594 - DNA, 22 bp, Artificial Sequence
  chemically synthesized
ttacctctataatcatacatag

SEQ ID NO: 148595 - DNA, 22 bp, Artificial Sequence
  chemically synthesized
acctctataatcatacataggc

SEQ ID NO: 148596 - DNA, 22 bp, Artificial Sequence
  chemically synthesized
cctctataatcatacataggca

SEQ ID NO: 148597 - DNA, 22 bp, Artificial Sequence
  chemically synthesized
tataatcatacataggcataat

SEQ ID NO: 148598 - DNA, 22 bp, Artificial Sequence
  chemically synthesized
taatcatacataggcataattt

SEQ ID NO: 148599 - DNA, 22 bp, Artificial Sequence
  chemically synthesized
tttaacctaggctccagatagc

SEQ ID NO: 148600 - DNA, 22 bp, Artificial Sequence
  chemically synthesized
ttaacctaggctccagatagcc

SEQ ID NO: 148601 - DNA, 22 bp, Artificial Sequence
  chemically synthesized
taacctaggctccagatagcca

SEQ ID NO: 148602 - DNA, 22 bp, Artificial Sequence
  chemically synthesized
aacctaggctccagatagccat

SEQ ID NO: 148603 - DNA, 22 bp, Artificial Sequence
  chemically synthesized
acctaggctccagatagccata

SEQ ID NO: 148604 - DNA, 22 bp, Artificial Sequence
  chemically synthesized
ggctccagatagccatagaaga

SEQ ID NO: 148605 - DNA, 22 bp, Artificial Sequence
  chemically synthesized
cagatagccatagaagaaccaa

SEQ ID NO: 148606 - DNA, 22 bp, Artificial Sequence
  chemically synthesized
tctgcgtgtgtgagaataatca

SEQ ID NO: 148607 - DNA, 22 bp, Artificial Sequence
  chemically synthesized
ctgcgtgtgtgagaataatcag

SEQ ID NO: 148608 - DNA, 22 bp, Artificial Sequence
  chemically synthesized
tgcgtgtgtgagaataatcaga

SEQ ID NO: 148609 - DNA, 22 bp, Artificial Sequence
  chemically synthesized
cgtgtgtgagaataatcagagt

SEQ ID NO: 148610 - DNA, 22 bp, Artificial Sequence
  chemically synthesized
tttcacaagtacctgatgaggg

SEQ ID NO: 148611 - DNA, 22 bp, Artificial Sequence
  chemically synthesized
ttcacaagtacctgatgagggt

SEQ ID NO: 148612 - DNA, 22 bp, Artificial Sequence
  chemically synthesized
tcacaagtacctgatgagggtt

SEQ ID NO: 148613 - DNA, 22 bp, Artificial Sequence
  chemically synthesized
cacaagtacctgatgagggttg

SEQ ID NO: 148614 - DNA, 22 bp, Artificial Sequence
  chemically synthesized
acaagtacctgatgagggttga

SEQ ID NO: 148615 - DNA, 22 bp, Artificial Sequence
  chemically synthesized
atgagggttgagacaggtagaa

SEQ ID NO: 148616 - DNA, 22 bp, Artificial Sequence
  chemically synthesized
agacaggtagaaaaagtgagag

SEQ ID NO: 148617 - DNA, 22 bp, Artificial Sequence
  chemically synthesized
tatttatttagcaataatagag

SEQ ID NO: 148618 - DNA, 22 bp, Artificial Sequence
  chemically synthesized
tttatttagcaataatagagaa

SEQ ID NO: 148619 - DNA, 22 bp, Artificial Sequence
  chemically synthesized
atttagcaataatagagaaagc

SEQ ID NO: 148620 - DNA, 22 bp, Artificial Sequence
  chemically synthesized
tttagcaataatagagaaagca

SEQ ID NO: 148621 - DNA, 22 bp, Artificial Sequence
  chemically synthesized
agcaataatagagaaagcattt

SEQ ID NO: 148622 - DNA, 22 bp, Artificial Sequence
  chemically synthesized
gcaataatagagaaagcattta

SEQ ID NO: 148623 - DNA, 22 bp, Artificial Sequence
  chemically synthesized
aagagaataaagcaatggaaat

SEQ ID NO: 148624 - DNA, 22 bp, Artificial Sequence
  chemically synthesized
agagaataaagcaatggaaata

SEQ ID NO: 148625 - DNA, 22 bp, Artificial Sequence
  chemically synthesized
gtaaatttccttctgataacta

SEQ ID NO: 148626 - DNA, 22 bp, Artificial Sequence
  chemically synthesized
taaatttccttctgataactag

SEQ ID NO: 148627 - DNA, 22 bp, Artificial Sequence
  chemically synthesized
ccttctgataactagaaataga

SEQ ID NO: 148628 - DNA, 22 bp, Artificial Sequence
  chemically synthesized
cttctgataactagaaatagag

SEQ ID NO: 148629 - DNA, 22 bp, Artificial Sequence
  chemically synthesized
ctgataactagaaatagaggat

SEQ ID NO: 148630 - DNA, 22 bp, Artificial Sequence
  chemically synthesized
tgataactagaaatagaggatc

SEQ ID NO: 148631 - DNA, 22 bp, Artificial Sequence
  chemically synthesized
ataactagaaatagaggatcca

SEQ ID NO: 148632 - DNA, 22 bp, Artificial Sequence
  chemically synthesized
gaaatagaggatccagtttctt

SEQ ID NO: 148633 - DNA, 22 bp, Artificial Sequence
  chemically synthesized
cttttggttaacctaaatttta

SEQ ID NO: 148634 - DNA, 22 bp, Artificial Sequence
  chemically synthesized
ttttggttaacctaaattttat

SEQ ID NO: 148635 - DNA, 22 bp, Artificial Sequence
  chemically synthesized
ttggttaacctaaattttattt

SEQ ID NO: 148636 - DNA, 22 bp, Artificial Sequence
  chemically synthesized
tggttaacctaaattttatttc

SEQ ID NO: 148637 - DNA, 22 bp, Artificial Sequence
  chemically synthesized
ggttaacctaaattttatttca

SEQ ID NO: 148638 - DNA, 22 bp, Artificial Sequence
  chemically synthesized
gttaacctaaattttatttcat

SEQ ID NO: 148639 - DNA, 22 bp, Artificial Sequence
  chemically synthesized
acctaaattttatttcatttta

SEQ ID NO: 148640 - DNA, 22 bp, Artificial Sequence
  chemically synthesized
aattttatttcattttattgtt

SEQ ID NO: 148641 - DNA, 22 bp, Artificial Sequence
  chemically synthesized
tatttcattttattgttttatt

SEQ ID NO: 148642 - DNA, 22 bp, Artificial Sequence
  chemically synthesized
atttcattttattgttttattt

SEQ ID NO: 148643 - DNA, 22 bp, Artificial Sequence
  chemically synthesized
tttcattttattgttttatttt

SEQ ID NO: 148644 - DNA, 22 bp, Artificial Sequence
  chemically synthesized
cattttattgttttattttatt

SEQ ID NO: 148645 - DNA, 22 bp, Artificial Sequence
  chemically synthesized
attttattgttttattttattt

SEQ ID NO: 148646 - DNA, 22 bp, Artificial Sequence
  chemically synthesized
tattgttttattttattttatt

SEQ ID NO: 148647 - DNA, 22 bp, Artificial Sequence
  chemically synthesized
attgttttattttattttattt

SEQ ID NO: 148648 - DNA, 22 bp, Artificial Sequence
  chemically synthesized
ttgttttattttattttatttt

SEQ ID NO: 148649 - DNA, 22 bp, Artificial Sequence
  chemically synthesized
ttttattttattttattttatt

SEQ ID NO: 148650 - DNA, 22 bp, Artificial Sequence
  chemically synthesized
tattttattttattttatttta

SEQ ID NO: 148651 - DNA, 22 bp, Artificial Sequence
  chemically synthesized
attttattttattttattttat

SEQ ID NO: 148652 - DNA, 22 bp, Artificial Sequence
  chemically synthesized
ttttattttattttattttatt

SEQ ID NO: 148653 - DNA, 22 bp, Artificial Sequence
  chemically synthesized
tattttattttattttattttg

SEQ ID NO: 148654 - DNA, 22 bp, Artificial Sequence
  chemically synthesized
attttattttattttattttgt

SEQ ID NO: 148655 - DNA, 22 bp, Artificial Sequence
  chemically synthesized
ttttattttattttattttgtg

SEQ ID NO: 148656 - DNA, 22 bp, Artificial Sequence
  chemically synthesized
tattttattttattttgtgtaa

SEQ ID NO: 148657 - DNA, 22 bp, Artificial Sequence
  chemically synthesized
attttattttattttgtgtaat

SEQ ID NO: 148658 - DNA, 22 bp, Artificial Sequence
  chemically synthesized
ttttattttattttgtgtaatc

SEQ ID NO: 148659 - DNA, 22 bp, Artificial Sequence
  chemically synthesized
tattttattttgtgtaatcgta

SEQ ID NO: 148660 - DNA, 22 bp, Artificial Sequence
  chemically synthesized
attttattttgtgtaatcgtag

SEQ ID NO: 148661 - DNA, 22 bp, Artificial Sequence
  chemically synthesized
ttttattttgtgtaatcgtagt

SEQ ID NO: 148662 - DNA, 22 bp, Artificial Sequence
  chemically synthesized
tattttgtgtaatcgtagtttc

SEQ ID NO: 148663 - DNA, 22 bp, Artificial Sequence
  chemically synthesized
attttgtgtaatcgtagtttca

SEQ ID NO: 148664 - DNA, 22 bp, Artificial Sequence
  chemically synthesized
ttttgtgtaatcgtagtttcag

SEQ ID NO: 148665 - DNA, 22 bp, Artificial Sequence
  chemically synthesized
tgtgtaatcgtagtttcagagt

SEQ ID NO: 148666 - DNA, 22 bp, Artificial Sequence
  chemically synthesized
gtgtaatcgtagtttcagagtg

SEQ ID NO: 148667 - DNA, 22 bp, Artificial Sequence
  chemically synthesized
tgtaatcgtagtttcagagtgt

SEQ ID NO: 148668 - DNA, 22 bp, Artificial Sequence
  chemically synthesized
cagagtgttagagctgaaagga

SEQ ID NO: 148669 - DNA, 22 bp, Artificial Sequence
  chemically synthesized
agagtgttagagctgaaaggaa

SEQ ID NO: 148670 - DNA, 22 bp, Artificial Sequence
  chemically synthesized
gagctgaaaggaagaagtagga

SEQ ID NO: 148671 - DNA, 22 bp, Artificial Sequence
  chemically synthesized
aaaggaagaagtaggagaaaca

SEQ ID NO: 148672 - DNA, 22 bp, Artificial Sequence
  chemically synthesized
tccttactaaaccgacatgggt

SEQ ID NO: 148673 - DNA, 22 bp, Artificial Sequence
  chemically synthesized
ccttactaaaccgacatgggtt

SEQ ID NO: 148674 - DNA, 22 bp, Artificial Sequence
  chemically synthesized
cttactaaaccgacatgggttt

SEQ ID NO: 148675 - DNA, 22 bp, Artificial Sequence
  chemically synthesized
actaaaccgacatgggtttcca

SEQ ID NO: 148676 - DNA, 22 bp, Artificial Sequence
  chemically synthesized
ctaaaccgacatgggtttccag

SEQ ID NO: 148677 - DNA, 22 bp, Artificial Sequence
  chemically synthesized
aaccgacatgggtttccaggta

SEQ ID NO: 148678 - DNA, 22 bp, Artificial Sequence
  chemically synthesized
ccaggtaggggcaggattcagg

SEQ ID NO: 148679 - DNA, 22 bp, Artificial Sequence
  chemically synthesized
caggtaggggcaggattcagga

SEQ ID NO: 148680 - DNA, 22 bp, Artificial Sequence
  chemically synthesized
aggatgactgacagggccctta

SEQ ID NO: 148681 - DNA, 22 bp, Artificial Sequence
  chemically synthesized
acagggcccttagggaacactg

SEQ ID NO: 148682 - DNA, 22 bp, Artificial Sequence
  chemically synthesized
agggaacactgagaccctacgc

SEQ ID NO: 148683 - DNA, 22 bp, Artificial Sequence
  chemically synthesized
gggaacactgagaccctacgct

SEQ ID NO: 148684 - DNA, 22 bp, Artificial Sequence
  chemically synthesized
agaccctacgctgacctcataa

SEQ ID NO: 148685 - DNA, 22 bp, Artificial Sequence
  chemically synthesized
cgctgacctcataaatgcttgc

SEQ ID NO: 148686 - DNA, 22 bp, Artificial Sequence
  chemically synthesized
acctcataaatgcttgctacct

SEQ ID NO: 148687 - DNA, 22 bp, Artificial Sequence
  chemically synthesized
ataaatgcttgctacctttgct

SEQ ID NO: 148688 - DNA, 22 bp, Artificial Sequence
  chemically synthesized
gctacctttgctgttttaatta

SEQ ID NO: 148689 - DNA, 22 bp, Artificial Sequence
  chemically synthesized
ctacctttgctgttttaattac

SEQ ID NO: 148690 - DNA, 22 bp, Artificial Sequence
  chemically synthesized
cctttgctgttttaattacatc

SEQ ID NO: 148691 - DNA, 22 bp, Artificial Sequence
  chemically synthesized
tgctgttttaattacatctttt

SEQ ID NO: 148692 - DNA, 22 bp, Artificial Sequence
  chemically synthesized
gctgttttaattacatctttta

SEQ ID NO: 148693 - DNA, 22 bp, Artificial Sequence
  chemically synthesized
ctgttttaattacatcttttaa

SEQ ID NO: 148694 - DNA, 22 bp, Artificial Sequence
  chemically synthesized
ttttaattacatcttttaatag

SEQ ID NO: 148695 - DNA, 22 bp, Artificial Sequence
  chemically synthesized
taattacatcttttaatagcag

SEQ ID NO: 148696 - DNA, 22 bp, Artificial Sequence
  chemically synthesized
aattacatcttttaatagcagg

SEQ ID NO: 148697 - DNA, 22 bp, Artificial Sequence
  chemically synthesized
attacatcttttaatagcagga

SEQ ID NO: 148698 - DNA, 22 bp, Artificial Sequence
  chemically synthesized
catcttttaatagcaggaagca

SEQ ID NO: 148699 - DNA, 22 bp, Artificial Sequence
  chemically synthesized
ttaatagcaggaagcagaactc

SEQ ID NO: 148700 - DNA, 22 bp, Artificial Sequence
  chemically synthesized
taatagcaggaagcagaactct

SEQ ID NO: 148701 - DNA, 22 bp, Artificial Sequence
  chemically synthesized
aatagcaggaagcagaactctg

SEQ ID NO: 148702 - DNA, 22 bp, Artificial Sequence
  chemically synthesized
atagcaggaagcagaactctgc

SEQ ID NO: 148703 - DNA, 22 bp, Artificial Sequence
  chemically synthesized
tgcacttcaaaagtttttcctc

SEQ ID NO: 148704 - DNA, 22 bp, Artificial Sequence
  chemically synthesized
cacttcaaaagtttttcctcac

SEQ ID NO: 148705 - DNA, 22 bp, Artificial Sequence
  chemically synthesized
caaaagtttttcctcacctgag

SEQ ID NO: 148706 - DNA, 22 bp, Artificial Sequence
  chemically synthesized
aaaagtttttcctcacctgagg

SEQ ID NO: 148707 - DNA, 22 bp, Artificial Sequence
  chemically synthesized
ttcctcacctgaggagttaatt

SEQ ID NO: 148708 - DNA, 22 bp, Artificial Sequence
  chemically synthesized
tcctcacctgaggagttaattt

SEQ ID NO: 148709 - DNA, 22 bp, Artificial Sequence
  chemically synthesized
cctcacctgaggagttaattta

SEQ ID NO: 148710 - DNA, 22 bp, Artificial Sequence
  chemically synthesized
ctcacctgaggagttaatttag

SEQ ID NO: 148711 - DNA, 22 bp, Artificial Sequence
  chemically synthesized
acctgaggagttaatttagtac

SEQ ID NO: 148712 - DNA, 22 bp, Artificial Sequence
  chemically synthesized
aggagttaatttagtacaaggg

SEQ ID NO: 148713 - DNA, 22 bp, Artificial Sequence
  chemically synthesized
atttagtacaaggggaaaaagt

SEQ ID NO: 148714 - DNA, 22 bp, Artificial Sequence
  chemically synthesized
agtacaaggggaaaaagtacag

SEQ ID NO: 148715 - DNA, 22 bp, Artificial Sequence
  chemically synthesized
gtacaaggggaaaaagtacagg

SEQ ID NO: 148716 - DNA, 22 bp, Artificial Sequence
  chemically synthesized
ggaagctatagagaaagaagag

SEQ ID NO: 148717 - DNA, 22 bp, Artificial Sequence
  chemically synthesized
tagagaaagaagagtaaatttt

SEQ ID NO: 148718 - DNA, 22 bp, Artificial Sequence
  chemically synthesized
tagtaaaggaggtttaaacaaa

SEQ ID NO: 148719 - DNA, 22 bp, Artificial Sequence
  chemically synthesized
agtaaaggaggtttaaacaaac

SEQ ID NO: 148720 - DNA, 22 bp, Artificial Sequence
  chemically synthesized
gtaaaggaggtttaaacaaaca

SEQ ID NO: 148721 - DNA, 22 bp, Artificial Sequence
  chemically synthesized
aaacaaacaaaatataaagaga

SEQ ID NO: 148722 - DNA, 22 bp, Artificial Sequence
  chemically synthesized
aacaaacaaaatataaagagaa

SEQ ID NO: 148723 - DNA, 22 bp, Artificial Sequence
  chemically synthesized
gaatcaaggaaatgattttaaa

SEQ ID NO: 148724 - DNA, 22 bp, Artificial Sequence
  chemically synthesized
aatcaaggaaatgattttaaaa

SEQ ID NO: 148725 - DNA, 22 bp, Artificial Sequence
  chemically synthesized
taaaacgcagtattcttagtgg

SEQ ID NO: 148726 - DNA, 22 bp, Artificial Sequence
  chemically synthesized
aaaacgcagtattcttagtgga

SEQ ID NO: 148727 - DNA, 22 bp, Artificial Sequence
  chemically synthesized
aaacgcagtattcttagtggac

SEQ ID NO: 148728 - DNA, 22 bp, Artificial Sequence
  chemically synthesized
ttagtggactagaggaaaaaaa

SEQ ID NO: 148729 - DNA, 22 bp, Artificial Sequence
  chemically synthesized
agtggactagaggaaaaaaata

SEQ ID NO: 148730 - DNA, 22 bp, Artificial Sequence
  chemically synthesized
gtggactagaggaaaaaaataa

SEQ ID NO: 148731 - DNA, 22 bp, Artificial Sequence
  chemically synthesized
gaggaaaaaaataatctgagcc

SEQ ID NO: 148732 - DNA, 22 bp, Artificial Sequence
  chemically synthesized
agccaagtagaagaccttttcc

SEQ ID NO: 148733 - DNA, 22 bp, Artificial Sequence
  chemically synthesized
ttcccctcctacccctactttc

SEQ ID NO: 148734 - DNA, 22 bp, Artificial Sequence
  chemically synthesized
tcccctcctacccctactttct

SEQ ID NO: 148735 - DNA, 22 bp, Artificial Sequence
  chemically synthesized
cccctcctacccctactttcta

SEQ ID NO: 148736 - DNA, 22 bp, Artificial Sequence
  chemically synthesized
ccctcctacccctactttctaa

SEQ ID NO: 148737 - DNA, 22 bp, Artificial Sequence
  chemically synthesized
ctacccctactttctaagtcac

SEQ ID NO: 148738 - DNA, 22 bp, Artificial Sequence
  chemically synthesized
cccctactttctaagtcacaga

SEQ ID NO: 148739 - DNA, 22 bp, Artificial Sequence
  chemically synthesized
ctttctaagtcacagaggcttt

SEQ ID NO: 148740 - DNA, 22 bp, Artificial Sequence
  chemically synthesized
tctaagtcacagaggctttttg

SEQ ID NO: 148741 - DNA, 22 bp, Artificial Sequence
  chemically synthesized
ctaagtcacagaggctttttgt

SEQ ID NO: 148742 - DNA, 22 bp, Artificial Sequence
  chemically synthesized
taagtcacagaggctttttgtt

SEQ ID NO: 148743 - DNA, 22 bp, Artificial Sequence
  chemically synthesized
agtcacagaggctttttgttcc

SEQ ID NO: 148744 - DNA, 22 bp, Artificial Sequence
  chemically synthesized
tttgttcccccagacactcttg

SEQ ID NO: 148745 - DNA, 22 bp, Artificial Sequence
  chemically synthesized
ttgttcccccagacactcttgc

SEQ ID NO: 148746 - DNA, 22 bp, Artificial Sequence
  chemically synthesized
tgttcccccagacactcttgca

SEQ ID NO: 148747 - DNA, 22 bp, Artificial Sequence
  chemically synthesized
gttcccccagacactcttgcag

SEQ ID NO: 148748 - DNA, 22 bp, Artificial Sequence
  chemically synthesized
ttcccccagacactcttgcaga

SEQ ID NO: 148749 - DNA, 22 bp, Artificial Sequence
  chemically synthesized
ccccagacactcttgcagatta

SEQ ID NO: 148750 - DNA, 22 bp, Artificial Sequence
  chemically synthesized
ttgcagattagtccaggcagaa

SEQ ID NO: 148751 - DNA, 22 bp, Artificial Sequence
  chemically synthesized
gcagattagtccaggcagaaac

SEQ ID NO: 148752 - DNA, 22 bp, Artificial Sequence
  chemically synthesized
cagattagtccaggcagaaaca

SEQ ID NO: 148753 - DNA, 22 bp, Artificial Sequence
  chemically synthesized
gtccaggcagaaacagttagat

SEQ ID NO: 148754 - DNA, 22 bp, Artificial Sequence
  chemically synthesized
gatgtccccagttaacctccta

SEQ ID NO: 148755 - DNA, 22 bp, Artificial Sequence
  chemically synthesized
acctcctatttgacaccactga

SEQ ID NO: 148756 - DNA, 22 bp, Artificial Sequence
  chemically synthesized
ctatttgacaccactgattacc

SEQ ID NO: 148757 - DNA, 22 bp, Artificial Sequence
  chemically synthesized
tttgacaccactgattacccca

SEQ ID NO: 148758 - DNA, 22 bp, Artificial Sequence
  chemically synthesized
gacaccactgattaccccattg

SEQ ID NO: 148759 - DNA, 22 bp, Artificial Sequence
  chemically synthesized
acaccactgattaccccattga

SEQ ID NO: 148760 - DNA, 22 bp, Artificial Sequence
  chemically synthesized
attaccccattgatagtcacac

SEQ ID NO: 148761 - DNA, 22 bp, Artificial Sequence
  chemically synthesized
ccccattgatagtcacactttg

SEQ ID NO: 148762 - DNA, 22 bp, Artificial Sequence
  chemically synthesized
atagtcacactttgggttgtaa

SEQ ID NO: 148763 - DNA, 22 bp, Artificial Sequence
  chemically synthesized
tgggttgtaagtgactttttat

SEQ ID NO: 148764 - DNA, 22 bp, Artificial Sequence
  chemically synthesized
gggttgtaagtgactttttatt

SEQ ID NO: 148765 - DNA, 22 bp, Artificial Sequence
  chemically synthesized
ggttgtaagtgactttttattt

SEQ ID NO: 148766 - DNA, 22 bp, Artificial Sequence
  chemically synthesized
taagtgactttttatttatttg

SEQ ID NO: 148767 - DNA, 22 bp, Artificial Sequence
  chemically synthesized
tttatttatttgtatttttgac

SEQ ID NO: 148768 - DNA, 22 bp, Artificial Sequence
  chemically synthesized
ttatttatttgtatttttgact

SEQ ID NO: 148769 - DNA, 22 bp, Artificial Sequence
  chemically synthesized
tatttatttgtatttttgactg

SEQ ID NO: 148770 - DNA, 22 bp, Artificial Sequence
  chemically synthesized
atttatttgtatttttgactgc

SEQ ID NO: 148771 - DNA, 22 bp, Artificial Sequence
  chemically synthesized
tttatttgtatttttgactgca

SEQ ID NO: 148772 - DNA, 22 bp, Artificial Sequence
  chemically synthesized
atttgtatttttgactgcatta

SEQ ID NO: 148773 - DNA, 22 bp, Artificial Sequence
  chemically synthesized
tttgtatttttgactgcattaa

SEQ ID NO: 148774 - DNA, 22 bp, Artificial Sequence
  chemically synthesized
gtatttttgactgcattaagag

SEQ ID NO: 148775 - DNA, 22 bp, Artificial Sequence
  chemically synthesized
tatttttgactgcattaagagg

SEQ ID NO: 148776 - DNA, 22 bp, Artificial Sequence
  chemically synthesized
ttgactgcattaagaggtctct

SEQ ID NO: 148777 - DNA, 22 bp, Artificial Sequence
  chemically synthesized
tgactgcattaagaggtctcta

SEQ ID NO: 148778 - DNA, 22 bp, Artificial Sequence
  chemically synthesized
gactgcattaagaggtctctag

SEQ ID NO: 148779 - DNA, 22 bp, Artificial Sequence
  chemically synthesized
actgcattaagaggtctctagt

SEQ ID NO: 148780 - DNA, 22 bp, Artificial Sequence
  chemically synthesized
cattaagaggtctctagttttt

SEQ ID NO: 148781 - DNA, 22 bp, Artificial Sequence
  chemically synthesized
agaggtctctagttttttatct

SEQ ID NO: 148782 - DNA, 22 bp, Artificial Sequence
  chemically synthesized
tagttttttatctcttgtttcc

SEQ ID NO: 148783 - DNA, 22 bp, Artificial Sequence
  chemically synthesized
gttttttatctcttgtttccca

SEQ ID NO: 148784 - DNA, 22 bp, Artificial Sequence
  chemically synthesized
tttatctcttgtttcccaaaac

SEQ ID NO: 148785 - DNA, 22 bp, Artificial Sequence
  chemically synthesized
ttatctcttgtttcccaaaacc

SEQ ID NO: 148786 - DNA, 22 bp, Artificial Sequence
  chemically synthesized
tatctcttgtttcccaaaacct

SEQ ID NO: 148787 - DNA, 22 bp, Artificial Sequence
  chemically synthesized
atctcttgtttcccaaaaccta

SEQ ID NO: 148788 - DNA, 22 bp, Artificial Sequence
  chemically synthesized
tctcttgtttcccaaaacctaa

SEQ ID NO: 148789 - DNA, 22 bp, Artificial Sequence
  chemically synthesized
ttgtttcccaaaacctaataag

SEQ ID NO: 148790 - DNA, 22 bp, Artificial Sequence
  chemically synthesized
gtttcccaaaacctaataagta

SEQ ID NO: 148791 - DNA, 22 bp, Artificial Sequence
  chemically synthesized
tttcccaaaacctaataagtaa

SEQ ID NO: 148792 - DNA, 22 bp, Artificial Sequence
  chemically synthesized
cccaaaacctaataagtaacta

SEQ ID NO: 148793 - DNA, 22 bp, Artificial Sequence
  chemically synthesized
ccaaaacctaataagtaactaa

SEQ ID NO: 148794 - DNA, 22 bp, Artificial Sequence
  chemically synthesized
ataagtaactaatgcacagagc

SEQ ID NO: 148795 - DNA, 22 bp, Artificial Sequence
  chemically synthesized
atgcacagagcacattgatttg

SEQ ID NO: 148796 - DNA, 22 bp, Artificial Sequence
  chemically synthesized
atttgtatttattctattttta

SEQ ID NO: 148797 - DNA, 22 bp, Artificial Sequence
  chemically synthesized
gtatttattctatttttagaca

SEQ ID NO: 148798 - DNA, 22 bp, Artificial Sequence
  chemically synthesized
tatttattctatttttagacat

SEQ ID NO: 148799 - DNA, 22 bp, Artificial Sequence
  chemically synthesized
attctatttttagacataattt

SEQ ID NO: 148800 - DNA, 22 bp, Artificial Sequence
  chemically synthesized
ttctatttttagacataattta

SEQ ID NO: 148801 - DNA, 22 bp, Artificial Sequence
  chemically synthesized
tatttttagacataatttatta

SEQ ID NO: 148802 - DNA, 22 bp, Artificial Sequence
  chemically synthesized
tttttagacataatttattagc

SEQ ID NO: 148803 - DNA, 22 bp, Artificial Sequence
  chemically synthesized
ttagacataatttattagcatg

SEQ ID NO: 148804 - DNA, 22 bp, Artificial Sequence
  chemically synthesized
tagacataatttattagcatgc

SEQ ID NO: 148805 - DNA, 22 bp, Artificial Sequence
  chemically synthesized
agacataatttattagcatgca

SEQ ID NO: 148806 - DNA, 22 bp, Artificial Sequence
  chemically synthesized
gacataatttattagcatgcat

SEQ ID NO: 148807 - DNA, 22 bp, Artificial Sequence
  chemically synthesized
attagcatgcatgagcaaatta

SEQ ID NO: 148808 - DNA, 22 bp, Artificial Sequence
  chemically synthesized
ttagcatgcatgagcaaattaa

SEQ ID NO: 148809 - DNA, 22 bp, Artificial Sequence
  chemically synthesized
gcatgcatgagcaaattaagaa

SEQ ID NO: 148810 - DNA, 22 bp, Artificial Sequence
  chemically synthesized
agaaaaacaacaacaaatgaat

SEQ ID NO: 148811 - DNA, 22 bp, Artificial Sequence
  chemically synthesized
tttcttttcttaccagaaggtt

SEQ ID NO: 148812 - DNA, 22 bp, Artificial Sequence
  chemically synthesized
ttcttttcttaccagaaggttt

SEQ ID NO: 148813 - DNA, 22 bp, Artificial Sequence
  chemically synthesized
tcttttcttaccagaaggtttt

SEQ ID NO: 148814 - DNA, 22 bp, Artificial Sequence
  chemically synthesized
cttttcttaccagaaggtttta

SEQ ID NO: 148815 - DNA, 22 bp, Artificial Sequence
  chemically synthesized
ttttcttaccagaaggttttaa

SEQ ID NO: 148816 - DNA, 22 bp, Artificial Sequence
  chemically synthesized
ttcttaccagaaggttttaatc

SEQ ID NO: 148817 - DNA, 22 bp, Artificial Sequence
  chemically synthesized
tcttaccagaaggttttaatcc

SEQ ID NO: 148818 - DNA, 22 bp, Artificial Sequence
  chemically synthesized
cttaccagaaggttttaatcca

SEQ ID NO: 148819 - DNA, 22 bp, Artificial Sequence
  chemically synthesized
ttaccagaaggttttaatccaa

SEQ ID NO: 148820 - DNA, 22 bp, Artificial Sequence
  chemically synthesized
accagaaggttttaatccaaat

SEQ ID NO: 148821 - DNA, 22 bp, Artificial Sequence
  chemically synthesized
ccagaaggttttaatccaaata

SEQ ID NO: 148822 - DNA, 22 bp, Artificial Sequence
  chemically synthesized
taatccaaataaggagaagata

SEQ ID NO: 148823 - DNA, 22 bp, Artificial Sequence
  chemically synthesized
aatccaaataaggagaagatat

SEQ ID NO: 148824 - DNA, 22 bp, Artificial Sequence
  chemically synthesized
atccaaataaggagaagatatg

SEQ ID NO: 148825 - DNA, 22 bp, Artificial Sequence
  chemically synthesized
agaaccgaggtagagttttcat

SEQ ID NO: 148826 - DNA, 22 bp, Artificial Sequence
  chemically synthesized
gaaccgaggtagagttttcatc

SEQ ID NO: 148827 - DNA, 22 bp, Artificial Sequence
  chemically synthesized
tcatccattctgtcctgtaagt

SEQ ID NO: 148828 - DNA, 22 bp, Artificial Sequence
  chemically synthesized
catccattctgtcctgtaagta

SEQ ID NO: 148829 - DNA, 22 bp, Artificial Sequence
  chemically synthesized
atccattctgtcctgtaagtat

SEQ ID NO: 148830 - DNA, 22 bp, Artificial Sequence
  chemically synthesized
tgtcctgtaagtattttgcata

SEQ ID NO: 148831 - DNA, 22 bp, Artificial Sequence
  chemically synthesized
tcctgtaagtattttgcatatt

SEQ ID NO: 148832 - DNA, 22 bp, Artificial Sequence
  chemically synthesized
taagtattttgcatattctgga

SEQ ID NO: 148833 - DNA, 22 bp, Artificial Sequence
  chemically synthesized
tgcatattctggagacgcagga

SEQ ID NO: 148834 - DNA, 22 bp, Artificial Sequence
  chemically synthesized
gcatattctggagacgcaggaa

SEQ ID NO: 148835 - DNA, 22 bp, Artificial Sequence
  chemically synthesized
catattctggagacgcaggaag

SEQ ID NO: 148836 - DNA, 22 bp, Artificial Sequence
  chemically synthesized
tggagacgcaggaagagatcca

SEQ ID NO: 148837 - DNA, 22 bp, Artificial Sequence
  chemically synthesized
gagacgcaggaagagatccatc

SEQ ID NO: 148838 - DNA, 22 bp, Artificial Sequence
  chemically synthesized
catatcccaaagctgaattatg

SEQ ID NO: 148839 - DNA, 22 bp, Artificial Sequence
  chemically synthesized
aattatggtagacaaaactctt

SEQ ID NO: 148840 - DNA, 22 bp, Artificial Sequence
  chemically synthesized
tggtagacaaaactcttccact

SEQ ID NO: 148841 - DNA, 22 bp, Artificial Sequence
  chemically synthesized
ttccacttttagtgcatcaact

SEQ ID NO: 148842 - DNA, 22 bp, Artificial Sequence
  chemically synthesized
ccacttttagtgcatcaacttc

SEQ ID NO: 148843 - DNA, 22 bp, Artificial Sequence
  chemically synthesized
cacttttagtgcatcaacttct

SEQ ID NO: 148844 - DNA, 22 bp, Artificial Sequence
  chemically synthesized
ttagtgcatcaacttcttattt

SEQ ID NO: 148845 - DNA, 22 bp, Artificial Sequence
  chemically synthesized
tagtgcatcaacttcttatttg

SEQ ID NO: 148846 - DNA, 22 bp, Artificial Sequence
  chemically synthesized
agtgcatcaacttcttatttgt

SEQ ID NO: 148847 - DNA, 22 bp, Artificial Sequence
  chemically synthesized
gtgcatcaacttcttatttgtg

SEQ ID NO: 148848 - DNA, 22 bp, Artificial Sequence
  chemically synthesized
cttatttgtgtaataagaaaat

SEQ ID NO: 148849 - DNA, 22 bp, Artificial Sequence
  chemically synthesized
ttatttgtgtaataagaaaatt

SEQ ID NO: 148850 - DNA, 22 bp, Artificial Sequence
  chemically synthesized
atttgtgtaataagaaaattgg

SEQ ID NO: 148851 - DNA, 22 bp, Artificial Sequence
  chemically synthesized
tttgtgtaataagaaaattggg

SEQ ID NO: 148852 - DNA, 22 bp, Artificial Sequence
  chemically synthesized
gtgtaataagaaaattgggaaa

SEQ ID NO: 148853 - DNA, 22 bp, Artificial Sequence
  chemically synthesized
tgtaataagaaaattgggaaaa

SEQ ID NO: 148854 - DNA, 22 bp, Artificial Sequence
  chemically synthesized
ggaaaacgatcttcaatatgct

SEQ ID NO: 148855 - DNA, 22 bp, Artificial Sequence
  chemically synthesized
caatatgcttaccaagctgtga

SEQ ID NO: 148856 - DNA, 22 bp, Artificial Sequence
  chemically synthesized
aatatgcttaccaagctgtgat

SEQ ID NO: 148857 - DNA, 22 bp, Artificial Sequence
  chemically synthesized
accaagctgtgattccaaatat

SEQ ID NO: 148858 - DNA, 22 bp, Artificial Sequence
  chemically synthesized
ccaagctgtgattccaaatatt

SEQ ID NO: 148859 - DNA, 22 bp, Artificial Sequence
  chemically synthesized
tgattccaaatattacgtaaat

SEQ ID NO: 148860 - DNA, 22 bp, Artificial Sequence
  chemically synthesized
caaatattacgtaaatacactt

SEQ ID NO: 148861 - DNA, 22 bp, Artificial Sequence
  chemically synthesized
cgtaaatacacttgcaaaggag

SEQ ID NO: 148862 - DNA, 22 bp, Artificial Sequence
  chemically synthesized
gcaaaggaggatgtttttagta

SEQ ID NO: 148863 - DNA, 22 bp, Artificial Sequence
  chemically synthesized
caaaggaggatgtttttagtag

SEQ ID NO: 148864 - DNA, 22 bp, Artificial Sequence
  chemically synthesized
ttagtagcaatttgtactgatg

SEQ ID NO: 148865 - DNA, 22 bp, Artificial Sequence
  chemically synthesized
tagtagcaatttgtactgatgg

SEQ ID NO: 148866 - DNA, 22 bp, Artificial Sequence
  chemically synthesized
agtagcaatttgtactgatggt

SEQ ID NO: 148867 - DNA, 22 bp, Artificial Sequence
  chemically synthesized
gtagcaatttgtactgatggta

SEQ ID NO: 148868 - DNA, 22 bp, Artificial Sequence
  chemically synthesized
gtactgatggtatggggccaag

SEQ ID NO: 148869 - DNA, 22 bp, Artificial Sequence
  chemically synthesized
tactgatggtatggggccaaga

SEQ ID NO: 148870 - DNA, 22 bp, Artificial Sequence
  chemically synthesized
atggtatggggccaagagatat

SEQ ID NO: 148871 - DNA, 22 bp, Artificial Sequence
  chemically synthesized
agagggagggctgagggtttga

SEQ ID NO: 148872 - DNA, 22 bp, Artificial Sequence
  chemically synthesized
gagggagggctgagggtttgaa

SEQ ID NO: 148873 - DNA, 22 bp, Artificial Sequence
  chemically synthesized
agggtttgaagtccaactccta

SEQ ID NO: 148874 - DNA, 22 bp, Artificial Sequence
  chemically synthesized
gaagtccaactcctaagccagt

SEQ ID NO: 148875 - DNA, 22 bp, Artificial Sequence
  chemically synthesized
aagtccaactcctaagccagtg

SEQ ID NO: 148876 - DNA, 22 bp, Artificial Sequence
  chemically synthesized
ctaagccagtgccagaagagcc

SEQ ID NO: 148877 - DNA, 22 bp, Artificial Sequence
  chemically synthesized
agccagtgccagaagagccaag

SEQ ID NO: 148878 - DNA, 22 bp, Artificial Sequence
  chemically synthesized
tcatcacttagacctcaccctg

SEQ ID NO: 148879 - DNA, 22 bp, Artificial Sequence
  chemically synthesized
agacctcaccctgtggagccac

SEQ ID NO: 148880 - DNA, 22 bp, Artificial Sequence
  chemically synthesized
gacctcaccctgtggagccaca

SEQ ID NO: 148881 - DNA, 22 bp, Artificial Sequence
  chemically synthesized
accctgtggagccacaccctag

SEQ ID NO: 148882 - DNA, 22 bp, Artificial Sequence
  chemically synthesized
tggagccacaccctagggttgg

SEQ ID NO: 148883 - DNA, 22 bp, Artificial Sequence
  chemically synthesized
gggttggccaatctactcccag

SEQ ID NO: 148884 - DNA, 22 bp, Artificial Sequence
  chemically synthesized
gccaatctactcccaggagcag

SEQ ID NO: 148885 - DNA, 22 bp, Artificial Sequence
  chemically synthesized
ctcccaggagcagggagggcag

SEQ ID NO: 148886 - DNA, 22 bp, Artificial Sequence
  chemically synthesized
ccaggagcagggagggcaggag

SEQ ID NO: 148887 - DNA, 22 bp, Artificial Sequence
  chemically synthesized
ggcataaaagtcagggcagagc

SEQ ID NO: 148888 - DNA, 22 bp, Artificial Sequence
  chemically synthesized
ttgcttacatttgcttctgaca

SEQ ID NO: 148889 - DNA, 22 bp, Artificial Sequence
  chemically synthesized
cttacatttgcttctgacacaa

SEQ ID NO: 148890 - DNA, 22 bp, Artificial Sequence
  chemically synthesized
acatttgcttctgacacaactg

SEQ ID NO: 148891 - DNA, 22 bp, Artificial Sequence
  chemically synthesized
catttgcttctgacacaactgt

SEQ ID NO: 148892 - DNA, 22 bp, Artificial Sequence
  chemically synthesized
gcttctgacacaactgtgttca

SEQ ID NO: 148893 - DNA, 22 bp, Artificial Sequence
  chemically synthesized
cttctgacacaactgtgttcac

SEQ ID NO: 148894 - DNA, 22 bp, Artificial Sequence
  chemically synthesized
ctgacacaactgtgttcactag

SEQ ID NO: 148895 - DNA, 22 bp, Artificial Sequence
  chemically synthesized
tgacacaactgtgttcactagc

SEQ ID NO: 148896 - DNA, 22 bp, Artificial Sequence
  chemically synthesized
acacaactgtgttcactagcaa

SEQ ID NO: 148897 - DNA, 22 bp, Artificial Sequence
  chemically synthesized
tgttcactagcaacctcaaaca

SEQ ID NO: 148898 - DNA, 22 bp, Artificial Sequence
  chemically synthesized
actagcaacctcaaacagacac

SEQ ID NO: 148899 - DNA, 22 bp, Artificial Sequence
  chemically synthesized
gcaacctcaaacagacaccatg

SEQ ID NO: 148900 - DNA, 22 bp, Artificial Sequence
  chemically synthesized
aaacagacaccatggtgcatct

SEQ ID NO: 148901 - DNA, 22 bp, Artificial Sequence
  chemically synthesized
actcctgaggagaagtctgccg

SEQ ID NO: 148902 - DNA, 22 bp, Artificial Sequence
  chemically synthesized
ctgaggagaagtctgccgttac

SEQ ID NO: 148903 - DNA, 22 bp, Artificial Sequence
  chemically synthesized
aggagaagtctgccgttactgc

SEQ ID NO: 148904 - DNA, 22 bp, Artificial Sequence
  chemically synthesized
ccgttactgccctgtggggcaa

SEQ ID NO: 148905 - DNA, 22 bp, Artificial Sequence
  chemically synthesized
ctgccctgtggggcaaggtgaa

SEQ ID NO: 148906 - DNA, 22 bp, Artificial Sequence
  chemically synthesized
ccctgtggggcaaggtgaacgt

SEQ ID NO: 148907 - DNA, 22 bp, Artificial Sequence
  chemically synthesized
tggggcaaggtgaacgtggatg

SEQ ID NO: 148908 - DNA, 22 bp, Artificial Sequence
  chemically synthesized
gtggtgaggccctgggcaggtt

SEQ ID NO: 148909 - DNA, 22 bp, Artificial Sequence
  chemically synthesized
ggcaggttggtatcaaggttac

SEQ ID NO: 148910 - DNA, 22 bp, Artificial Sequence
  chemically synthesized
gtatcaaggttacaagacaggt

SEQ ID NO: 148911 - DNA, 22 bp, Artificial Sequence
  chemically synthesized
caagacaggtttaaggagacca

SEQ ID NO: 148912 - DNA, 22 bp, Artificial Sequence
  chemically synthesized
aaggagaccaatagaaactggg

SEQ ID NO: 148913 - DNA, 22 bp, Artificial Sequence
  chemically synthesized
aggagaccaatagaaactgggc

SEQ ID NO: 148914 - DNA, 22 bp, Artificial Sequence
  chemically synthesized
ggcatgtggagacagagaagac

SEQ ID NO: 148915 - DNA, 22 bp, Artificial Sequence
  chemically synthesized
ttgggtttctgataggcactga

SEQ ID NO: 148916 - DNA, 22 bp, Artificial Sequence
  chemically synthesized
gggtttctgataggcactgact

SEQ ID NO: 148917 - DNA, 22 bp, Artificial Sequence
  chemically synthesized
ggtttctgataggcactgactc

SEQ ID NO: 148918 - DNA, 22 bp, Artificial Sequence
  chemically synthesized
ctgataggcactgactctctct

SEQ ID NO: 148919 - DNA, 22 bp, Artificial Sequence
  chemically synthesized
tgataggcactgactctctctg

SEQ ID NO: 148920 - DNA, 22 bp, Artificial Sequence
  chemically synthesized
ataggcactgactctctctgcc

SEQ ID NO: 148921 - DNA, 22 bp, Artificial Sequence
  chemically synthesized
actctctctgcctattggtcta

SEQ ID NO: 148922 - DNA, 22 bp, Artificial Sequence
  chemically synthesized
tctctgcctattggtctatttt

SEQ ID NO: 148923 - DNA, 22 bp, Artificial Sequence
  chemically synthesized
tctgcctattggtctattttcc

SEQ ID NO: 148924 - DNA, 22 bp, Artificial Sequence
  chemically synthesized
tgcctattggtctattttccca

SEQ ID NO: 148925 - DNA, 22 bp, Artificial Sequence
  chemically synthesized
cctattggtctattttcccacc

SEQ ID NO: 148926 - DNA, 22 bp, Artificial Sequence
  chemically synthesized
ttggtctattttcccaccctta

SEQ ID NO: 148927 - DNA, 22 bp, Artificial Sequence
  chemically synthesized
gtctattttcccacccttaggc

SEQ ID NO: 148928 - DNA, 22 bp, Artificial Sequence
  chemically synthesized
ttttcccacccttaggctgctg

SEQ ID NO: 148929 - DNA, 22 bp, Artificial Sequence
  chemically synthesized
tcccacccttaggctgctggtg

SEQ ID NO: 148930 - DNA, 22 bp, Artificial Sequence
  chemically synthesized
cccacccttaggctgctggtgg

SEQ ID NO: 148931 - DNA, 22 bp, Artificial Sequence
  chemically synthesized
ccacccttaggctgctggtggt

SEQ ID NO: 148932 - DNA, 22 bp, Artificial Sequence
  chemically synthesized
aggctgctggtggtctaccctt

SEQ ID NO: 148933 - DNA, 22 bp, Artificial Sequence
  chemically synthesized
ggctgctggtggtctacccttg

SEQ ID NO: 148934 - DNA, 22 bp, Artificial Sequence
  chemically synthesized
ctggtggtctacccttggaccc

SEQ ID NO: 148935 - DNA, 22 bp, Artificial Sequence
  chemically synthesized
gtggtctacccttggacccaga

SEQ ID NO: 148936 - DNA, 22 bp, Artificial Sequence
  chemically synthesized
cccttggacccagaggttcttt

SEQ ID NO: 148937 - DNA, 22 bp, Artificial Sequence
  chemically synthesized
ggacccagaggttctttgagtc

SEQ ID NO: 148938 - DNA, 22 bp, Artificial Sequence
  chemically synthesized
gacccagaggttctttgagtcc

SEQ ID NO: 148939 - DNA, 22 bp, Artificial Sequence
  chemically synthesized
tttgagtcctttggggatctgt

SEQ ID NO: 148940 - DNA, 22 bp, Artificial Sequence
  chemically synthesized
tgagtcctttggggatctgtcc

SEQ ID NO: 148941 - DNA, 22 bp, Artificial Sequence
  chemically synthesized
gagtcctttggggatctgtcca

SEQ ID NO: 148942 - DNA, 22 bp, Artificial Sequence
  chemically synthesized
agtcctttggggatctgtccac

SEQ ID NO: 148943 - DNA, 22 bp, Artificial Sequence
  chemically synthesized
tggggatctgtccactcctgat

SEQ ID NO: 148944 - DNA, 22 bp, Artificial Sequence
  chemically synthesized
ggggatctgtccactcctgatg

SEQ ID NO: 148945 - DNA, 22 bp, Artificial Sequence
  chemically synthesized
gggatctgtccactcctgatgc

SEQ ID NO: 148946 - DNA, 22 bp, Artificial Sequence
  chemically synthesized
tccactcctgatgctgttatgg

SEQ ID NO: 148947 - DNA, 22 bp, Artificial Sequence
  chemically synthesized
ctgatgctgttatgggcaaccc

SEQ ID NO: 148948 - DNA, 22 bp, Artificial Sequence
  chemically synthesized
atgctgttatgggcaaccctaa

SEQ ID NO: 148949 - DNA, 22 bp, Artificial Sequence
  chemically synthesized
ttatgggcaaccctaaggtgaa

SEQ ID NO: 148950 - DNA, 22 bp, Artificial Sequence
  chemically synthesized
tgggcaaccctaaggtgaaggc

SEQ ID NO: 148951 - DNA, 22 bp, Artificial Sequence
  chemically synthesized
aggtgaaggctcatggcaagaa

SEQ ID NO: 148952 - DNA, 22 bp, Artificial Sequence
  chemically synthesized
atggcaagaaagtgctcggtgc

SEQ ID NO: 148953 - DNA, 22 bp, Artificial Sequence
  chemically synthesized
ggtgcctttagtgatggcctgg

SEQ ID NO: 148954 - DNA, 22 bp, Artificial Sequence
  chemically synthesized
tagtgatggcctggctcacctg

SEQ ID NO: 148955 - DNA, 22 bp, Artificial Sequence
  chemically synthesized
agtgatggcctggctcacctgg

SEQ ID NO: 148956 - DNA, 22 bp, Artificial Sequence
  chemically synthesized
gtgatggcctggctcacctgga

SEQ ID NO: 148957 - DNA, 22 bp, Artificial Sequence
  chemically synthesized
gctcacctggacaacctcaagg

SEQ ID NO: 148958 - DNA, 22 bp, Artificial Sequence
  chemically synthesized
acctggacaacctcaagggcac

SEQ ID NO: 148959 - DNA, 22 bp, Artificial Sequence
  chemically synthesized
gacaacctcaagggcacctttg

SEQ ID NO: 148960 - DNA, 22 bp, Artificial Sequence
  chemically synthesized
aagggcacctttgccacactga

SEQ ID NO: 148961 - DNA, 22 bp, Artificial Sequence
  chemically synthesized
tgccacactgagtgagctgcac

SEQ ID NO: 148962 - DNA, 22 bp, Artificial Sequence
  chemically synthesized
gccacactgagtgagctgcact

SEQ ID NO: 148963 - DNA, 22 bp, Artificial Sequence
  chemically synthesized
ccacactgagtgagctgcactg

SEQ ID NO: 148964 - DNA, 22 bp, Artificial Sequence
  chemically synthesized
agtgagctgcactgtgacaagc

SEQ ID NO: 148965 - DNA, 22 bp, Artificial Sequence
  chemically synthesized
cactgtgacaagctgcacgtgg

SEQ ID NO: 148966 - DNA, 22 bp, Artificial Sequence
  chemically synthesized
tgacaagctgcacgtggatcct

SEQ ID NO: 148967 - DNA, 22 bp, Artificial Sequence
  chemically synthesized
cacgtggatcctgagaacttca

SEQ ID NO: 148968 - DNA, 22 bp, Artificial Sequence
  chemically synthesized
agaacttcagggtgagtctatg

SEQ ID NO: 148969 - DNA, 22 bp, Artificial Sequence
  chemically synthesized
cagggtgagtctatgggacgct

SEQ ID NO: 148970 - DNA, 22 bp, Artificial Sequence
  chemically synthesized
agggtgagtctatgggacgctt

SEQ ID NO: 148971 - DNA, 22 bp, Artificial Sequence
  chemically synthesized
tgggacgcttgatgttttcttt

SEQ ID NO: 148972 - DNA, 22 bp, Artificial Sequence
  chemically synthesized
gatgttttctttccccttcttt

SEQ ID NO: 148973 - DNA, 22 bp, Artificial Sequence
  chemically synthesized
atgttttctttccccttctttt

SEQ ID NO: 148974 - DNA, 22 bp, Artificial Sequence
  chemically synthesized
tctttccccttcttttctatgg

SEQ ID NO: 148975 - DNA, 22 bp, Artificial Sequence
  chemically synthesized
ctttccccttcttttctatggt

SEQ ID NO: 148976 - DNA, 22 bp, Artificial Sequence
  chemically synthesized
tttccccttcttttctatggtt

SEQ ID NO: 148977 - DNA, 22 bp, Artificial Sequence
  chemically synthesized
tccccttcttttctatggttaa

SEQ ID NO: 148978 - DNA, 22 bp, Artificial Sequence
  chemically synthesized
ccccttcttttctatggttaag

SEQ ID NO: 148979 - DNA, 22 bp, Artificial Sequence
  chemically synthesized
cccttcttttctatggttaagt

SEQ ID NO: 148980 - DNA, 22 bp, Artificial Sequence
  chemically synthesized
cttttctatggttaagttcatg

SEQ ID NO: 148981 - DNA, 22 bp, Artificial Sequence
  chemically synthesized
ttttctatggttaagttcatgt

SEQ ID NO: 148982 - DNA, 22 bp, Artificial Sequence
  chemically synthesized
ttctatggttaagttcatgtca

SEQ ID NO: 148983 - DNA, 22 bp, Artificial Sequence
  chemically synthesized
tctatggttaagttcatgtcat

SEQ ID NO: 148984 - DNA, 22 bp, Artificial Sequence
  chemically synthesized
ctatggttaagttcatgtcata

SEQ ID NO: 148985 - DNA, 22 bp, Artificial Sequence
  chemically synthesized
tatggttaagttcatgtcatag

SEQ ID NO: 148986 - DNA, 22 bp, Artificial Sequence
  chemically synthesized
tggttaagttcatgtcatagga

SEQ ID NO: 148987 - DNA, 22 bp, Artificial Sequence
  chemically synthesized
agttcatgtcataggaagggga

SEQ ID NO: 148988 - DNA, 22 bp, Artificial Sequence
  chemically synthesized
atgtcataggaaggggataagt

SEQ ID NO: 148989 - DNA, 22 bp, Artificial Sequence
  chemically synthesized
agaatgggaaacagacgaatga

SEQ ID NO: 148990 - DNA, 22 bp, Artificial Sequence
  chemically synthesized
gaatgggaaacagacgaatgat

SEQ ID NO: 148991 - DNA, 22 bp, Artificial Sequence
  chemically synthesized
catcagtgtggaagtctcagga

SEQ ID NO: 148992 - DNA, 22 bp, Artificial Sequence
  chemically synthesized
aggatcgttttagtttctttta

SEQ ID NO: 148993 - DNA, 22 bp, Artificial Sequence
  chemically synthesized
tagtttcttttatttgctgttc

SEQ ID NO: 148994 - DNA, 22 bp, Artificial Sequence
  chemically synthesized
agtttcttttatttgctgttca

SEQ ID NO: 148995 - DNA, 22 bp, Artificial Sequence
  chemically synthesized
gtttcttttatttgctgttcat

SEQ ID NO: 148996 - DNA, 22 bp, Artificial Sequence
  chemically synthesized
cttttatttgctgttcataaca

SEQ ID NO: 148997 - DNA, 22 bp, Artificial Sequence
  chemically synthesized
ttttatttgctgttcataacaa

SEQ ID NO: 148998 - DNA, 22 bp, Artificial Sequence
  chemically synthesized
ttatttgctgttcataacaatt

SEQ ID NO: 148999 - DNA, 22 bp, Artificial Sequence
  chemically synthesized
tatttgctgttcataacaattg

SEQ ID NO: 149000 - DNA, 22 bp, Artificial Sequence
  chemically synthesized
atttgctgttcataacaattgt

SEQ ID NO: 149001 - DNA, 22 bp, Artificial Sequence
  chemically synthesized
tttgctgttcataacaattgtt

SEQ ID NO: 149002 - DNA, 22 bp, Artificial Sequence
  chemically synthesized
gctgttcataacaattgttttc

SEQ ID NO: 149003 - DNA, 22 bp, Artificial Sequence
  chemically synthesized
ctgttcataacaattgttttct

SEQ ID NO: 149004 - DNA, 22 bp, Artificial Sequence
  chemically synthesized
ttcataacaattgttttctttt

SEQ ID NO: 149005 - DNA, 22 bp, Artificial Sequence
  chemically synthesized
ataacaattgttttcttttgtt

SEQ ID NO: 149006 - DNA, 22 bp, Artificial Sequence
  chemically synthesized
ttttcttttgtttaattcttgc

SEQ ID NO: 149007 - DNA, 22 bp, Artificial Sequence
  chemically synthesized
tcttttgtttaattcttgcttt

SEQ ID NO: 149008 - DNA, 22 bp, Artificial Sequence
  chemically synthesized
cttttgtttaattcttgctttc

SEQ ID NO: 149009 - DNA, 22 bp, Artificial Sequence
  chemically synthesized
ttttgtttaattcttgctttct

SEQ ID NO: 149010 - DNA, 22 bp, Artificial Sequence
  chemically synthesized
ttgtttaattcttgctttcttt

SEQ ID NO: 149011 - DNA, 22 bp, Artificial Sequence
  chemically synthesized
tgtttaattcttgctttctttt

SEQ ID NO: 149012 - DNA, 22 bp, Artificial Sequence
  chemically synthesized
gtttaattcttgctttcttttt

SEQ ID NO: 149013 - DNA, 22 bp, Artificial Sequence
  chemically synthesized
tttaattcttgctttctttttt

SEQ ID NO: 149014 - DNA, 22 bp, Artificial Sequence
  chemically synthesized
aattcttgctttcttttttttt

SEQ ID NO: 149015 - DNA, 22 bp, Artificial Sequence
  chemically synthesized
attcttgctttctttttttttc

SEQ ID NO: 149016 - DNA, 22 bp, Artificial Sequence
  chemically synthesized
ttgctttctttttttttcttct

SEQ ID NO: 149017 - DNA, 22 bp, Artificial Sequence
  chemically synthesized
gctttctttttttttcttctcc

SEQ ID NO: 149018 - DNA, 22 bp, Artificial Sequence
  chemically synthesized
ctttctttttttttcttctccg

SEQ ID NO: 149019 - DNA, 22 bp, Artificial Sequence
  chemically synthesized
tctttttttttcttctccgcaa

SEQ ID NO: 149020 - DNA, 22 bp, Artificial Sequence
  chemically synthesized
ctttttttttcttctccgcaat

SEQ ID NO: 149021 - DNA, 22 bp, Artificial Sequence
  chemically synthesized
tttttttttcttctccgcaatt

SEQ ID NO: 149022 - DNA, 22 bp, Artificial Sequence
  chemically synthesized
tttttttcttctccgcaatttt

SEQ ID NO: 149023 - DNA, 22 bp, Artificial Sequence
  chemically synthesized
ttttttcttctccgcaattttt

SEQ ID NO: 149024 - DNA, 22 bp, Artificial Sequence
  chemically synthesized
tttttcttctccgcaattttta

SEQ ID NO: 149025 - DNA, 22 bp, Artificial Sequence
  chemically synthesized
ttttcttctccgcaatttttac

SEQ ID NO: 149026 - DNA, 22 bp, Artificial Sequence
  chemically synthesized
tttcttctccgcaatttttact

SEQ ID NO: 149027 - DNA, 22 bp, Artificial Sequence
  chemically synthesized
ttcttctccgcaatttttacta

SEQ ID NO: 149028 - DNA, 22 bp, Artificial Sequence
  chemically synthesized
tcttctccgcaatttttactat

SEQ ID NO: 149029 - DNA, 22 bp, Artificial Sequence
  chemically synthesized
cttctccgcaatttttactatt

SEQ ID NO: 149030 - DNA, 22 bp, Artificial Sequence
  chemically synthesized
ttctccgcaatttttactatta

SEQ ID NO: 149031 - DNA, 22 bp, Artificial Sequence
  chemically synthesized
ctccgcaatttttactattata

SEQ ID NO: 149032 - DNA, 22 bp, Artificial Sequence
  chemically synthesized
tccgcaatttttactattatac

SEQ ID NO: 149033 - DNA, 22 bp, Artificial Sequence
  chemically synthesized
cgcaatttttactattatactt

SEQ ID NO: 149034 - DNA, 22 bp, Artificial Sequence
  chemically synthesized
ttactattatacttaatgcctt

SEQ ID NO: 149035 - DNA, 22 bp, Artificial Sequence
  chemically synthesized
tactattatacttaatgcctta

SEQ ID NO: 149036 - DNA, 22 bp, Artificial Sequence
  chemically synthesized
actattatacttaatgccttaa

SEQ ID NO: 149037 - DNA, 22 bp, Artificial Sequence
  chemically synthesized
ctattatacttaatgccttaac

SEQ ID NO: 149038 - DNA, 22 bp, Artificial Sequence
  chemically synthesized
ttatacttaatgccttaacatt

SEQ ID NO: 149039 - DNA, 22 bp, Artificial Sequence
  chemically synthesized
tacttaatgccttaacattgtg

SEQ ID NO: 149040 - DNA, 22 bp, Artificial Sequence
  chemically synthesized
aatgccttaacattgtgtataa

SEQ ID NO: 149041 - DNA, 22 bp, Artificial Sequence
  chemically synthesized
atgccttaacattgtgtataac

SEQ ID NO: 149042 - DNA, 22 bp, Artificial Sequence
  chemically synthesized
aacattgtgtataacaaaagga

SEQ ID NO: 149043 - DNA, 22 bp, Artificial Sequence
  chemically synthesized
acattgtgtataacaaaaggaa

SEQ ID NO: 149044 - DNA, 22 bp, Artificial Sequence
  chemically synthesized
tgtataacaaaaggaaatatct

SEQ ID NO: 149045 - DNA, 22 bp, Artificial Sequence
  chemically synthesized
tgagatacattaagtaacttaa

SEQ ID NO: 149046 - DNA, 22 bp, Artificial Sequence
  chemically synthesized
agatacattaagtaacttaaaa

SEQ ID NO: 149047 - DNA, 22 bp, Artificial Sequence
  chemically synthesized
agtaacttaaaaaaaaacttta

SEQ ID NO: 149048 - DNA, 22 bp, Artificial Sequence
  chemically synthesized
aaaaaaaaactttacacagtct

SEQ ID NO: 149049 - DNA, 22 bp, Artificial Sequence
  chemically synthesized
aaaaaaaactttacacagtctg

SEQ ID NO: 149050 - DNA, 22 bp, Artificial Sequence
  chemically synthesized
tacacagtctgcctagtacatt

SEQ ID NO: 149051 - DNA, 22 bp, Artificial Sequence
  chemically synthesized
acacagtctgcctagtacatta

SEQ ID NO: 149052 - DNA, 22 bp, Artificial Sequence
  chemically synthesized
cacagtctgcctagtacattac

SEQ ID NO: 149053 - DNA, 22 bp, Artificial Sequence
  chemically synthesized
cctagtacattactatttggaa

SEQ ID NO: 149054 - DNA, 22 bp, Artificial Sequence
  chemically synthesized
gtacattactatttggaatata

SEQ ID NO: 149055 - DNA, 22 bp, Artificial Sequence
  chemically synthesized
ctatttggaatatatgtgtgct

SEQ ID NO: 149056 - DNA, 22 bp, Artificial Sequence
  chemically synthesized
tttggaatatatgtgtgcttat

SEQ ID NO: 149057 - DNA, 22 bp, Artificial Sequence
  chemically synthesized
ggaatatatgtgtgcttatttg

SEQ ID NO: 149058 - DNA, 22 bp, Artificial Sequence
  chemically synthesized
gaatatatgtgtgcttatttgc

SEQ ID NO: 149059 - DNA, 22 bp, Artificial Sequence
  chemically synthesized
atttgcatattcataatctccc

SEQ ID NO: 149060 - DNA, 22 bp, Artificial Sequence
  chemically synthesized
tttgcatattcataatctccct

SEQ ID NO: 149061 - DNA, 22 bp, Artificial Sequence
  chemically synthesized
gcatattcataatctccctact

SEQ ID NO: 149062 - DNA, 22 bp, Artificial Sequence
  chemically synthesized
catattcataatctccctactt

SEQ ID NO: 149063 - DNA, 22 bp, Artificial Sequence
  chemically synthesized
ataatctccctactttattttc

SEQ ID NO: 149064 - DNA, 22 bp, Artificial Sequence
  chemically synthesized
cctactttattttcttttattt

SEQ ID NO: 149065 - DNA, 22 bp, Artificial Sequence
  chemically synthesized
ctttattttcttttatttttaa

SEQ ID NO: 149066 - DNA, 22 bp, Artificial Sequence
  chemically synthesized
tattttcttttatttttaattg

SEQ ID NO: 149067 - DNA, 22 bp, Artificial Sequence
  chemically synthesized
attttcttttatttttaattga

SEQ ID NO: 149068 - DNA, 22 bp, Artificial Sequence
  chemically synthesized
ttttcttttatttttaattgat

SEQ ID NO: 149069 - DNA, 22 bp, Artificial Sequence
  chemically synthesized
tcttttatttttaattgataca

SEQ ID NO: 149070 - DNA, 22 bp, Artificial Sequence
  chemically synthesized
cttttatttttaattgatacat

SEQ ID NO: 149071 - DNA, 22 bp, Artificial Sequence
  chemically synthesized
ttttatttttaattgatacata

SEQ ID NO: 149072 - DNA, 22 bp, Artificial Sequence
  chemically synthesized
ttatttttaattgatacataat

SEQ ID NO: 149073 - DNA, 22 bp, Artificial Sequence
  chemically synthesized
tatttttaattgatacataatc

SEQ ID NO: 149074 - DNA, 22 bp, Artificial Sequence
  chemically synthesized
atttttaattgatacataatca

SEQ ID NO: 149075 - DNA, 22 bp, Artificial Sequence
  chemically synthesized
tttttaattgatacataatcat

SEQ ID NO: 149076 - DNA, 22 bp, Artificial Sequence
  chemically synthesized
ttaattgatacataatcattat

SEQ ID NO: 149077 - DNA, 22 bp, Artificial Sequence
  chemically synthesized
taattgatacataatcattata

SEQ ID NO: 149078 - DNA, 22 bp, Artificial Sequence
  chemically synthesized
aattgatacataatcattatac

SEQ ID NO: 149079 - DNA, 22 bp, Artificial Sequence
  chemically synthesized
attgatacataatcattataca

SEQ ID NO: 149080 - DNA, 22 bp, Artificial Sequence
  chemically synthesized
atacataatcattatacatatt

SEQ ID NO: 149081 - DNA, 22 bp, Artificial Sequence
  chemically synthesized
tacatatttatgggttaaagtg

SEQ ID NO: 149082 - DNA, 22 bp, Artificial Sequence
  chemically synthesized
atgggttaaagtgtaatgtttt

SEQ ID NO: 149083 - DNA, 22 bp, Artificial Sequence
  chemically synthesized
tgggttaaagtgtaatgtttta

SEQ ID NO: 149084 - DNA, 22 bp, Artificial Sequence
  chemically synthesized
aagtgtaatgttttaatatgtg

SEQ ID NO: 149085 - DNA, 22 bp, Artificial Sequence
  chemically synthesized
taatatgtgtacacatattgac

SEQ ID NO: 149086 - DNA, 22 bp, Artificial Sequence
  chemically synthesized
aatatgtgtacacatattgacc

SEQ ID NO: 149087 - DNA, 22 bp, Artificial Sequence
  chemically synthesized
atatgtgtacacatattgacca

SEQ ID NO: 149088 - DNA, 22 bp, Artificial Sequence
  chemically synthesized
accaaatcagggtaattttgca

SEQ ID NO: 149089 - DNA, 22 bp, Artificial Sequence
  chemically synthesized
tgcatttgtaattttaaaaaat

SEQ ID NO: 149090 - DNA, 22 bp, Artificial Sequence
  chemically synthesized
gcatttgtaattttaaaaaatg

SEQ ID NO: 149091 - DNA, 22 bp, Artificial Sequence
  chemically synthesized
catttgtaattttaaaaaatgc

SEQ ID NO: 149092 - DNA, 22 bp, Artificial Sequence
  chemically synthesized
gtaattttaaaaaatgctttct

SEQ ID NO: 149093 - DNA, 22 bp, Artificial Sequence
  chemically synthesized
taattttaaaaaatgctttctt

SEQ ID NO: 149094 - DNA, 22 bp, Artificial Sequence
  chemically synthesized
taaaaaatgctttcttctttta

SEQ ID NO: 149095 - DNA, 22 bp, Artificial Sequence
  chemically synthesized
aaaaaatgctttcttcttttaa

SEQ ID NO: 149096 - DNA, 22 bp, Artificial Sequence
  chemically synthesized
aaaaatgctttcttcttttaat

SEQ ID NO: 149097 - DNA, 22 bp, Artificial Sequence
  chemically synthesized
tcttcttttaatatactttttt

SEQ ID NO: 149098 - DNA, 22 bp, Artificial Sequence
  chemically synthesized
cttcttttaatatacttttttg

SEQ ID NO: 149099 - DNA, 22 bp, Artificial Sequence
  chemically synthesized
ttcttttaatatacttttttgt

SEQ ID NO: 149100 - DNA, 22 bp, Artificial Sequence
  chemically synthesized
cttttaatatacttttttgttt

SEQ ID NO: 149101 - DNA, 22 bp, Artificial Sequence
  chemically synthesized
ttttaatatacttttttgttta

SEQ ID NO: 149102 - DNA, 22 bp, Artificial Sequence
  chemically synthesized
ttaatatacttttttgtttatc

SEQ ID NO: 149103 - DNA, 22 bp, Artificial Sequence
  chemically synthesized
taatatacttttttgtttatct

SEQ ID NO: 149104 - DNA, 22 bp, Artificial Sequence
  chemically synthesized
aatatacttttttgtttatctt

SEQ ID NO: 149105 - DNA, 22 bp, Artificial Sequence
  chemically synthesized
atatacttttttgtttatctta

SEQ ID NO: 149106 - DNA, 22 bp, Artificial Sequence
  chemically synthesized
ttttgtttatcttatttctaat

SEQ ID NO: 149107 - DNA, 22 bp, Artificial Sequence
  chemically synthesized
tttgtttatcttatttctaata

SEQ ID NO: 149108 - DNA, 22 bp, Artificial Sequence
  chemically synthesized
ttgtttatcttatttctaatac

SEQ ID NO: 149109 - DNA, 22 bp, Artificial Sequence
  chemically synthesized
tgtttatcttatttctaatact

SEQ ID NO: 149110 - DNA, 22 bp, Artificial Sequence
  chemically synthesized
gtttatcttatttctaatactt

SEQ ID NO: 149111 - DNA, 22 bp, Artificial Sequence
  chemically synthesized
tttatcttatttctaatacttt

SEQ ID NO: 149112 - DNA, 22 bp, Artificial Sequence
  chemically synthesized
atcttatttctaatactttccc

SEQ ID NO: 149113 - DNA, 22 bp, Artificial Sequence
  chemically synthesized
tcttatttctaatactttccct

SEQ ID NO: 149114 - DNA, 22 bp, Artificial Sequence
  chemically synthesized
atttctaatactttccctaatc

SEQ ID NO: 149115 - DNA, 22 bp, Artificial Sequence
  chemically synthesized
tttctaatactttccctaatct

SEQ ID NO: 149116 - DNA, 22 bp, Artificial Sequence
  chemically synthesized
ctaatactttccctaatctctt

SEQ ID NO: 149117 - DNA, 22 bp, Artificial Sequence
  chemically synthesized
taatactttccctaatctcttt

SEQ ID NO: 149118 - DNA, 22 bp, Artificial Sequence
  chemically synthesized
atactttccctaatctctttct

SEQ ID NO: 149119 - DNA, 22 bp, Artificial Sequence
  chemically synthesized
tccctaatctctttctttcagg

SEQ ID NO: 149120 - DNA, 22 bp, Artificial Sequence
  chemically synthesized
ccctaatctctttctttcaggg

SEQ ID NO: 149121 - DNA, 22 bp, Artificial Sequence
  chemically synthesized
cctaatctctttctttcagggc

SEQ ID NO: 149122 - DNA, 22 bp, Artificial Sequence
  chemically synthesized
atctctttctttcagggcaata

SEQ ID NO: 149123 - DNA, 22 bp, Artificial Sequence
  chemically synthesized
tttctttcagggcaataatgat

SEQ ID NO: 149124 - DNA, 22 bp, Artificial Sequence
  chemically synthesized
tctttcagggcaataatgatac

SEQ ID NO: 149125 - DNA, 22 bp, Artificial Sequence
  chemically synthesized
ctttcagggcaataatgataca

SEQ ID NO: 149126 - DNA, 22 bp, Artificial Sequence
  chemically synthesized
tttcagggcaataatgatacaa

SEQ ID NO: 149127 - DNA, 22 bp, Artificial Sequence
  chemically synthesized
tcagggcaataatgatacaatg

SEQ ID NO: 149128 - DNA, 22 bp, Artificial Sequence
  chemically synthesized
cagggcaataatgatacaatgt

SEQ ID NO: 149129 - DNA, 22 bp, Artificial Sequence
  chemically synthesized
agggcaataatgatacaatgta

SEQ ID NO: 149130 - DNA, 22 bp, Artificial Sequence
  chemically synthesized
tttgcaccattctaaagaataa

SEQ ID NO: 149131 - DNA, 22 bp, Artificial Sequence
  chemically synthesized
tgcaccattctaaagaataaca

SEQ ID NO: 149132 - DNA, 22 bp, Artificial Sequence
  chemically synthesized
gcaccattctaaagaataacag

SEQ ID NO: 149133 - DNA, 22 bp, Artificial Sequence
  chemically synthesized
caccattctaaagaataacagt

SEQ ID NO: 149134 - DNA, 22 bp, Artificial Sequence
  chemically synthesized
taaagaataacagtgataattt

SEQ ID NO: 149135 - DNA, 22 bp, Artificial Sequence
  chemically synthesized
aagaataacagtgataatttct

SEQ ID NO: 149136 - DNA, 22 bp, Artificial Sequence
  chemically synthesized
ctgggttaaggcaatagcaata

SEQ ID NO: 149137 - DNA, 22 bp, Artificial Sequence
  chemically synthesized
tgggttaaggcaatagcaatat

SEQ ID NO: 149138 - DNA, 22 bp, Artificial Sequence
  chemically synthesized
ggttaaggcaatagcaatatct

SEQ ID NO: 149139 - DNA, 22 bp, Artificial Sequence
  chemically synthesized
aggcaatagcaatatctctgca

SEQ ID NO: 149140 - DNA, 22 bp, Artificial Sequence
  chemically synthesized
tgcatataaatatttctgcata

SEQ ID NO: 149141 - DNA, 22 bp, Artificial Sequence
  chemically synthesized
catataaatatttctgcatata

SEQ ID NO: 149142 - DNA, 22 bp, Artificial Sequence
  chemically synthesized
ctgcatataaattgtaactgat

SEQ ID NO: 149143 - DNA, 22 bp, Artificial Sequence
  chemically synthesized
tgcatataaattgtaactgatg

SEQ ID NO: 149144 - DNA, 22 bp, Artificial Sequence
  chemically synthesized
catataaattgtaactgatgta

SEQ ID NO: 149145 - DNA, 22 bp, Artificial Sequence
  chemically synthesized
taactgatgtaagaggtttcat

SEQ ID NO: 149146 - DNA, 22 bp, Artificial Sequence
  chemically synthesized
atgtaagaggtttcatattgct

SEQ ID NO: 149147 - DNA, 22 bp, Artificial Sequence
  chemically synthesized
catattgctaatagcagctaca

SEQ ID NO: 149148 - DNA, 22 bp, Artificial Sequence
  chemically synthesized
atattgctaatagcagctacaa

SEQ ID NO: 149149 - DNA, 22 bp, Artificial Sequence
  chemically synthesized
ctaatagcagctacaatccagc

SEQ ID NO: 149150 - DNA, 22 bp, Artificial Sequence
  chemically synthesized
atagcagctacaatccagctac

SEQ ID NO: 149151 - DNA, 22 bp, Artificial Sequence
  chemically synthesized
caatccagctaccattctgctt

SEQ ID NO: 149152 - DNA, 22 bp, Artificial Sequence
  chemically synthesized
ccattctgcttttattttatgg

SEQ ID NO: 149153 - DNA, 22 bp, Artificial Sequence
  chemically synthesized
tgcttttattttatggttggga

SEQ ID NO: 149154 - DNA, 22 bp, Artificial Sequence
  chemically synthesized
cttttattttatggttgggata

SEQ ID NO: 149155 - DNA, 22 bp, Artificial Sequence
  chemically synthesized
ttattttatggttgggataagg

SEQ ID NO: 149156 - DNA, 22 bp, Artificial Sequence
  chemically synthesized
tattttatggttgggataaggc

SEQ ID NO: 149157 - DNA, 22 bp, Artificial Sequence
  chemically synthesized
attttatggttgggataaggct

SEQ ID NO: 149158 - DNA, 22 bp, Artificial Sequence
  chemically synthesized
ttttatggttgggataaggctg

SEQ ID NO: 149159 - DNA, 22 bp, Artificial Sequence
  chemically synthesized
tatggttgggataaggctggat

SEQ ID NO: 149160 - DNA, 22 bp, Artificial Sequence
  chemically synthesized
atggttgggataaggctggatt

SEQ ID NO: 149161 - DNA, 22 bp, Artificial Sequence
  chemically synthesized
tggttgggataaggctggatta

SEQ ID NO: 149162 - DNA, 22 bp, Artificial Sequence
  chemically synthesized
ggataaggctggattattctga

SEQ ID NO: 149163 - DNA, 22 bp, Artificial Sequence
  chemically synthesized
gattattctgagtccaagctag

SEQ ID NO: 149164 - DNA, 22 bp, Artificial Sequence
  chemically synthesized
ttctgagtccaagctaggccct

SEQ ID NO: 149165 - DNA, 22 bp, Artificial Sequence
  chemically synthesized
tgagtccaagctaggccctttt

SEQ ID NO: 149166 - DNA, 22 bp, Artificial Sequence
  chemically synthesized
agtccaagctaggcccttttgc

SEQ ID NO: 149167 - DNA, 22 bp, Artificial Sequence
  chemically synthesized
ggcccttttgctaatcatgttc

SEQ ID NO: 149168 - DNA, 22 bp, Artificial Sequence
  chemically synthesized
ttgctaatcatgttcatacctc

SEQ ID NO: 149169 - DNA, 22 bp, Artificial Sequence
  chemically synthesized
tgctaatcatgttcatacctct

SEQ ID NO: 149170 - DNA, 22 bp, Artificial Sequence
  chemically synthesized
gctaatcatgttcatacctctt

SEQ ID NO: 149171 - DNA, 22 bp, Artificial Sequence
  chemically synthesized
ctaatcatgttcatacctctta

SEQ ID NO: 149172 - DNA, 22 bp, Artificial Sequence
  chemically synthesized
atcatgttcatacctcttatct

SEQ ID NO: 149173 - DNA, 22 bp, Artificial Sequence
  chemically synthesized
atacctcttatcttcctcccac

SEQ ID NO: 149174 - DNA, 22 bp, Artificial Sequence
  chemically synthesized
ttatcttcctcccacagctcct

SEQ ID NO: 149175 - DNA, 22 bp, Artificial Sequence
  chemically synthesized
atcttcctcccacagctcctgg

SEQ ID NO: 149176 - DNA, 22 bp, Artificial Sequence
  chemically synthesized
tcttcctcccacagctcctggg

SEQ ID NO: 149177 - DNA, 22 bp, Artificial Sequence
  chemically synthesized
cctcccacagctcctgggcaac

SEQ ID NO: 149178 - DNA, 22 bp, Artificial Sequence
  chemically synthesized
ctcccacagctcctgggcaacg

SEQ ID NO: 149179 - DNA, 22 bp, Artificial Sequence
  chemically synthesized
ccacagctcctgggcaacgtgc

SEQ ID NO: 149180 - DNA, 22 bp, Artificial Sequence
  chemically synthesized
ctgggcaacgtgctggtctgtg

SEQ ID NO: 149181 - DNA, 22 bp, Artificial Sequence
  chemically synthesized
ggcaacgtgctggtctgtgtgc

SEQ ID NO: 149182 - DNA, 22 bp, Artificial Sequence
  chemically synthesized
gtctgtgtgctggcccatcact

SEQ ID NO: 149183 - DNA, 22 bp, Artificial Sequence
  chemically synthesized
tgtgctggcccatcactttggc

SEQ ID NO: 149184 - DNA, 22 bp, Artificial Sequence
  chemically synthesized
gcccatcactttggcaaagaat

SEQ ID NO: 149185 - DNA, 22 bp, Artificial Sequence
  chemically synthesized
tggcaaagaattcaccccacca

SEQ ID NO: 149186 - DNA, 22 bp, Artificial Sequence
  chemically synthesized
ggcaaagaattcaccccaccag

SEQ ID NO: 149187 - DNA, 22 bp, Artificial Sequence
  chemically synthesized
gcaaagaattcaccccaccagt

SEQ ID NO: 149188 - DNA, 22 bp, Artificial Sequence
  chemically synthesized
accccaccagtgcaggctgcct

SEQ ID NO: 149189 - DNA, 22 bp, Artificial Sequence
  chemically synthesized
cctatcagaaagtggtggctgg

SEQ ID NO: 149190 - DNA, 22 bp, Artificial Sequence
  chemically synthesized
tcagaaagtggtggctggtgtg

SEQ ID NO: 149191 - DNA, 22 bp, Artificial Sequence
  chemically synthesized
gtgtggctaatgccctggccca

SEQ ID NO: 149192 - DNA, 22 bp, Artificial Sequence
  chemically synthesized
atgccctggcccacaagtatca

SEQ ID NO: 149193 - DNA, 22 bp, Artificial Sequence
  chemically synthesized
gcccacaagtatcactaagctc

SEQ ID NO: 149194 - DNA, 22 bp, Artificial Sequence
  chemically synthesized
agctcgctttcttgctgtccaa

SEQ ID NO: 149195 - DNA, 22 bp, Artificial Sequence
  chemically synthesized
gctttcttgctgtccaatttct

SEQ ID NO: 149196 - DNA, 22 bp, Artificial Sequence
  chemically synthesized
tcttgctgtccaatttctatta

SEQ ID NO: 149197 - DNA, 22 bp, Artificial Sequence
  chemically synthesized
cttgctgtccaatttctattaa

SEQ ID NO: 149198 - DNA, 22 bp, Artificial Sequence
  chemically synthesized
ttgctgtccaatttctattaaa

SEQ ID NO: 149199 - DNA, 22 bp, Artificial Sequence
  chemically synthesized
gctgtccaatttctattaaagg

SEQ ID NO: 149200 - DNA, 22 bp, Artificial Sequence
  chemically synthesized
ctgtccaatttctattaaaggt

SEQ ID NO: 149201 - DNA, 22 bp, Artificial Sequence
  chemically synthesized
tccaatttctattaaaggttcc

SEQ ID NO: 149202 - DNA, 22 bp, Artificial Sequence
  chemically synthesized
ctattaaaggttcctttgttcc

SEQ ID NO: 149203 - DNA, 22 bp, Artificial Sequence
  chemically synthesized
tattaaaggttcctttgttccc

SEQ ID NO: 149204 - DNA, 22 bp, Artificial Sequence
  chemically synthesized
ttaaaggttcctttgttcccta

SEQ ID NO: 149205 - DNA, 22 bp, Artificial Sequence
  chemically synthesized
aaggttcctttgttccctaagt

SEQ ID NO: 149206 - DNA, 22 bp, Artificial Sequence
  chemically synthesized
ctttgttccctaagtccaacta

SEQ ID NO: 149207 - DNA, 22 bp, Artificial Sequence
  chemically synthesized
tgttccctaagtccaactacta

SEQ ID NO: 149208 - DNA, 22 bp, Artificial Sequence
  chemically synthesized
gttccctaagtccaactactaa

SEQ ID NO: 149209 - DNA, 22 bp, Artificial Sequence
  chemically synthesized
ttccctaagtccaactactaaa

SEQ ID NO: 149210 - DNA, 22 bp, Artificial Sequence
  chemically synthesized
cctaagtccaactactaaactg

SEQ ID NO: 149211 - DNA, 22 bp, Artificial Sequence
  chemically synthesized
agtccaactactaaactggggg

SEQ ID NO: 149212 - DNA, 22 bp, Artificial Sequence
  chemically synthesized
ctaaactgggggatattatgaa

SEQ ID NO: 149213 - DNA, 22 bp, Artificial Sequence
  chemically synthesized
aactgggggatattatgaaggg

SEQ ID NO: 149214 - DNA, 22 bp, Artificial Sequence
  chemically synthesized
ggggatattatgaagggccttg

SEQ ID NO: 149215 - DNA, 22 bp, Artificial Sequence
  chemically synthesized
tgaagggccttgagcatctgga

SEQ ID NO: 149216 - DNA, 22 bp, Artificial Sequence
  chemically synthesized
gagcatctggattctgcctaat

SEQ ID NO: 149217 - DNA, 22 bp, Artificial Sequence
  chemically synthesized
agcatctggattctgcctaata

SEQ ID NO: 149218 - DNA, 22 bp, Artificial Sequence
  chemically synthesized
gattctgcctaataaaaaacat

SEQ ID NO: 149219 - DNA, 22 bp, Artificial Sequence
  chemically synthesized
tgcctaataaaaaacatttatt

SEQ ID NO: 149220 - DNA, 22 bp, Artificial Sequence
  chemically synthesized
cctaataaaaaacatttatttt

SEQ ID NO: 149221 - DNA, 22 bp, Artificial Sequence
  chemically synthesized
ataaaaaacatttattttcatt

SEQ ID NO: 149222 - DNA, 22 bp, Artificial Sequence
  chemically synthesized
attttcattgcaatgatgtatt

SEQ ID NO: 149223 - DNA, 22 bp, Artificial Sequence
  chemically synthesized
ttttcattgcaatgatgtattt

SEQ ID NO: 149224 - DNA, 22 bp, Artificial Sequence
  chemically synthesized
tcattgcaatgatgtatttaaa

SEQ ID NO: 149225 - DNA, 22 bp, Artificial Sequence
  chemically synthesized
cattgcaatgatgtatttaaat

SEQ ID NO: 149226 - DNA, 22 bp, Artificial Sequence
  chemically synthesized
attgcaatgatgtatttaaatt

SEQ ID NO: 149227 - DNA, 22 bp, Artificial Sequence
  chemically synthesized
caatgatgtatttaaattattt

SEQ ID NO: 149228 - DNA, 22 bp, Artificial Sequence
  chemically synthesized
aaattatttctgaatattttac

SEQ ID NO: 149229 - DNA, 22 bp, Artificial Sequence
  chemically synthesized
aattatttctgaatattttact

SEQ ID NO: 149230 - DNA, 22 bp, Artificial Sequence
  chemically synthesized
tttctgaatattttactaaaaa

SEQ ID NO: 149231 - DNA, 22 bp, Artificial Sequence
  chemically synthesized
ctgaatattttactaaaaaggg

SEQ ID NO: 149232 - DNA, 22 bp, Artificial Sequence
  chemically synthesized
tgaatattttactaaaaaggga

SEQ ID NO: 149233 - DNA, 22 bp, Artificial Sequence
  chemically synthesized
aatattttactaaaaagggaat

SEQ ID NO: 149234 - DNA, 22 bp, Artificial Sequence
  chemically synthesized
tactaaaaagggaatgtgggag

SEQ ID NO: 149235 - DNA, 22 bp, Artificial Sequence
  chemically synthesized
actaaaaagggaatgtgggagg

SEQ ID NO: 149236 - DNA, 22 bp, Artificial Sequence
  chemically synthesized
ctaaaaagggaatgtgggaggt

SEQ ID NO: 149237 - DNA, 22 bp, Artificial Sequence
  chemically synthesized
aaaagggaatgtgggaggtcag

SEQ ID NO: 149238 - DNA, 22 bp, Artificial Sequence
  chemically synthesized
aaaacataaagaaatgaagagc

SEQ ID NO: 149239 - DNA, 22 bp, Artificial Sequence
  chemically synthesized
aaacataaagaaatgaagagct

SEQ ID NO: 149240 - DNA, 22 bp, Artificial Sequence
  chemically synthesized
gttcaaaccttgggaaaataca

SEQ ID NO: 149241 - DNA, 22 bp, Artificial Sequence
  chemically synthesized
aaaccttgggaaaatacactat

SEQ ID NO: 149242 - DNA, 22 bp, Artificial Sequence
  chemically synthesized
gggaaaatacactatatcttaa

SEQ ID NO: 149243 - DNA, 22 bp, Artificial Sequence
  chemically synthesized
ggaaaatacactatatcttaaa

SEQ ID NO: 149244 - DNA, 22 bp, Artificial Sequence
  chemically synthesized
tatcttaaactccatgaaagaa

SEQ ID NO: 149245 - DNA, 22 bp, Artificial Sequence
  chemically synthesized
aaactccatgaaagaaggtgag

SEQ ID NO: 149246 - DNA, 22 bp, Artificial Sequence
  chemically synthesized
aactccatgaaagaaggtgagg

SEQ ID NO: 149247 - DNA, 22 bp, Artificial Sequence
  chemically synthesized
catgaaagaaggtgaggctgca

SEQ ID NO: 149248 - DNA, 22 bp, Artificial Sequence
  chemically synthesized
caaacagctaatgcacattggc

SEQ ID NO: 149249 - DNA, 22 bp, Artificial Sequence
  chemically synthesized
atgcacattggcaacagcccct

SEQ ID NO: 149250 - DNA, 22 bp, Artificial Sequence
  chemically synthesized
gcaacagcccctgatgcatatg

SEQ ID NO: 149251 - DNA, 22 bp, Artificial Sequence
  chemically synthesized
atgcatatgccttattcatccc

SEQ ID NO: 149252 - DNA, 22 bp, Artificial Sequence
  chemically synthesized
attcatccctcagaaaaggatt

SEQ ID NO: 149253 - DNA, 22 bp, Artificial Sequence
  chemically synthesized
ttcatccctcagaaaaggattc

SEQ ID NO: 149254 - DNA, 22 bp, Artificial Sequence
  chemically synthesized
atccctcagaaaaggattcaag

SEQ ID NO: 149255 - DNA, 22 bp, Artificial Sequence
  chemically synthesized
agaaaaggattcaagtagaggc

SEQ ID NO: 149256 - DNA, 22 bp, Artificial Sequence
  chemically synthesized
aagtagaggcttgatttggagg

SEQ ID NO: 149257 - DNA, 22 bp, Artificial Sequence
  chemically synthesized
gatttggaggttaaagttttgc

SEQ ID NO: 149258 - DNA, 22 bp, Artificial Sequence
  chemically synthesized
atttggaggttaaagttttgct

SEQ ID NO: 149259 - DNA, 22 bp, Artificial Sequence
  chemically synthesized
ggaggttaaagttttgctatgc

SEQ ID NO: 149260 - DNA, 22 bp, Artificial Sequence
  chemically synthesized
gaggttaaagttttgctatgct

SEQ ID NO: 149261 - DNA, 22 bp, Artificial Sequence
  chemically synthesized
aagttttgctatgctgtatttt

SEQ ID NO: 149262 - DNA, 22 bp, Artificial Sequence
  chemically synthesized
tgctatgctgtattttacatta

SEQ ID NO: 149263 - DNA, 22 bp, Artificial Sequence
  chemically synthesized
gctatgctgtattttacattac

SEQ ID NO: 149264 - DNA, 22 bp, Artificial Sequence
  chemically synthesized
ctatgctgtattttacattact

SEQ ID NO: 149265 - DNA, 22 bp, Artificial Sequence
  chemically synthesized
tgctgtattttacattacttat

SEQ ID NO: 149266 - DNA, 22 bp, Artificial Sequence
  chemically synthesized
tattttacattacttattgttt

SEQ ID NO: 149267 - DNA, 22 bp, Artificial Sequence
  chemically synthesized
tacattacttattgttttagct

SEQ ID NO: 149268 - DNA, 22 bp, Artificial Sequence
  chemically synthesized
acattacttattgttttagctg

SEQ ID NO: 149269 - DNA, 22 bp, Artificial Sequence
  chemically synthesized
cattacttattgttttagctgt

SEQ ID NO: 149270 - DNA, 22 bp, Artificial Sequence
  chemically synthesized
cttattgttttagctgtcctca

SEQ ID NO: 149271 - DNA, 22 bp, Artificial Sequence
  chemically synthesized
attgttttagctgtcctcatga

SEQ ID NO: 149272 - DNA, 22 bp, Artificial Sequence
  chemically synthesized
ttgttttagctgtcctcatgaa

SEQ ID NO: 149273 - DNA, 22 bp, Artificial Sequence
  chemically synthesized
ttttagctgtcctcatgaatgt

SEQ ID NO: 149274 - DNA, 22 bp, Artificial Sequence
  chemically synthesized
tagctgtcctcatgaatgtctt

SEQ ID NO: 149275 - DNA, 22 bp, Artificial Sequence
  chemically synthesized
agctgtcctcatgaatgtcttt

SEQ ID NO: 149276 - DNA, 22 bp, Artificial Sequence
  chemically synthesized
gctgtcctcatgaatgtctttt

SEQ ID NO: 149277 - DNA, 22 bp, Artificial Sequence
  chemically synthesized
tcctcatgaatgtcttttcact

SEQ ID NO: 149278 - DNA, 22 bp, Artificial Sequence
  chemically synthesized
atgaatgtcttttcactaccca

SEQ ID NO: 149279 - DNA, 22 bp, Artificial Sequence
  chemically synthesized
ttcactacccatttgcttatcc

SEQ ID NO: 149280 - DNA, 22 bp, Artificial Sequence
  chemically synthesized
tcactacccatttgcttatcct

SEQ ID NO: 149281 - DNA, 22 bp, Artificial Sequence
  chemically synthesized
cactacccatttgcttatcctg

SEQ ID NO: 149282 - DNA, 22 bp, Artificial Sequence
  chemically synthesized
actacccatttgcttatcctgc

SEQ ID NO: 149283 - DNA, 22 bp, Artificial Sequence
  chemically synthesized
cccatttgcttatcctgcatct

SEQ ID NO: 149284 - DNA, 22 bp, Artificial Sequence
  chemically synthesized
gcttatcctgcatctctcagcc

SEQ ID NO: 149285 - DNA, 22 bp, Artificial Sequence
  chemically synthesized
cttatcctgcatctctcagcct

SEQ ID NO: 149286 - DNA, 22 bp, Artificial Sequence
  chemically synthesized
atcctgcatctctcagccttga

SEQ ID NO: 149287 - DNA, 22 bp, Artificial Sequence
  chemically synthesized
tcctgcatctctcagccttgac

SEQ ID NO: 149288 - DNA, 22 bp, Artificial Sequence
  chemically synthesized
catctctcagccttgactccac

SEQ ID NO: 149289 - DNA, 22 bp, Artificial Sequence
  chemically synthesized
tcagccttgactccactcagtt

SEQ ID NO: 149290 - DNA, 22 bp, Artificial Sequence
  chemically synthesized
agccttgactccactcagttct

SEQ ID NO: 149291 - DNA, 22 bp, Artificial Sequence
  chemically synthesized
gactccactcagttctcttgct

SEQ ID NO: 149292 - DNA, 22 bp, Artificial Sequence
  chemically synthesized
actccactcagttctcttgctt

SEQ ID NO: 149293 - DNA, 22 bp, Artificial Sequence
  chemically synthesized
cactcagttctcttgcttagag

SEQ ID NO: 149294 - DNA, 22 bp, Artificial Sequence
  chemically synthesized
agttctcttgcttagagatacc

SEQ ID NO: 149295 - DNA, 22 bp, Artificial Sequence
  chemically synthesized
tcttgcttagagataccacctt

SEQ ID NO: 149296 - DNA, 22 bp, Artificial Sequence
  chemically synthesized
ttgcttagagataccacctttc

SEQ ID NO: 149297 - DNA, 22 bp, Artificial Sequence
  chemically synthesized
gcttagagataccacctttccc

SEQ ID NO: 149298 - DNA, 22 bp, Artificial Sequence
  chemically synthesized
cttagagataccacctttcccc

SEQ ID NO: 149299 - DNA, 22 bp, Artificial Sequence
  chemically synthesized
agagataccacctttcccctga

SEQ ID NO: 149300 - DNA, 22 bp, Artificial Sequence
  chemically synthesized
gagataccacctttcccctgaa

SEQ ID NO: 149301 - DNA, 22 bp, Artificial Sequence
  chemically synthesized
tcccctgaagtgttccttccat

SEQ ID NO: 149302 - DNA, 22 bp, Artificial Sequence
  chemically synthesized
cccctgaagtgttccttccatg

SEQ ID NO: 149303 - DNA, 22 bp, Artificial Sequence
  chemically synthesized
ccctgaagtgttccttccatgt

SEQ ID NO: 149304 - DNA, 22 bp, Artificial Sequence
  chemically synthesized
aagtgttccttccatgttttac

SEQ ID NO: 149305 - DNA, 22 bp, Artificial Sequence
  chemically synthesized
cttccatgttttacggcgagat

SEQ ID NO: 149306 - DNA, 22 bp, Artificial Sequence
  chemically synthesized
ccatgttttacggcgagatggt

SEQ ID NO: 149307 - DNA, 22 bp, Artificial Sequence
  chemically synthesized
catgttttacggcgagatggtt

SEQ ID NO: 149308 - DNA, 22 bp, Artificial Sequence
  chemically synthesized
tacggcgagatggtttctcctc

SEQ ID NO: 149309 - DNA, 22 bp, Artificial Sequence
  chemically synthesized
acggcgagatggtttctcctcg

SEQ ID NO: 149310 - DNA, 22 bp, Artificial Sequence
  chemically synthesized
cggcgagatggtttctcctcgc

SEQ ID NO: 149311 - DNA, 22 bp, Artificial Sequence
  chemically synthesized
ctcctcgcctggccactcagcc

SEQ ID NO: 149312 - DNA, 22 bp, Artificial Sequence
  chemically synthesized
tcctcgcctggccactcagcct

SEQ ID NO: 149313 - DNA, 22 bp, Artificial Sequence
  chemically synthesized
ctcgcctggccactcagcctta

SEQ ID NO: 149314 - DNA, 22 bp, Artificial Sequence
  chemically synthesized
gcctggccactcagccttagtt

SEQ ID NO: 149315 - DNA, 22 bp, Artificial Sequence
  chemically synthesized
gccactcagccttagttgtctc

SEQ ID NO: 149316 - DNA, 22 bp, Artificial Sequence
  chemically synthesized
agccttagttgtctctgttgtc

SEQ ID NO: 149317 - DNA, 22 bp, Artificial Sequence
  chemically synthesized
agttgtctctgttgtcttatag

SEQ ID NO: 149318 - DNA, 22 bp, Artificial Sequence
  chemically synthesized
gttgtctctgttgtcttataga

SEQ ID NO: 149319 - DNA, 22 bp, Artificial Sequence
  chemically synthesized
tctctgttgtcttatagaggtc

SEQ ID NO: 149320 - DNA, 22 bp, Artificial Sequence
  chemically synthesized
tgttgtcttatagaggtctact

SEQ ID NO: 149321 - DNA, 22 bp, Artificial Sequence
  chemically synthesized
ttgtcttatagaggtctacttg

SEQ ID NO: 149322 - DNA, 22 bp, Artificial Sequence
  chemically synthesized
tcttatagaggtctacttgaag

SEQ ID NO: 149323 - DNA, 22 bp, Artificial Sequence
  chemically synthesized
atagaggtctacttgaagaagg

SEQ ID NO: 149324 - DNA, 22 bp, Artificial Sequence
  chemically synthesized
tagaggtctacttgaagaagga

SEQ ID NO: 149325 - DNA, 22 bp, Artificial Sequence
  chemically synthesized
cttgaagaaggaaaaacagggg

SEQ ID NO: 149326 - DNA, 22 bp, Artificial Sequence
  chemically synthesized
gaagaaggaaaaacaggggtca

SEQ ID NO: 149327 - DNA, 22 bp, Artificial Sequence
  chemically synthesized
aagaaggaaaaacaggggtcat

SEQ ID NO: 149328 - DNA, 22 bp, Artificial Sequence
  chemically synthesized
gactgtcctgtgagcccttctt

SEQ ID NO: 149329 - DNA, 22 bp, Artificial Sequence
  chemically synthesized
actgtcctgtgagcccttcttc

SEQ ID NO: 149330 - DNA, 22 bp, Artificial Sequence
  chemically synthesized
tcctgtgagcccttcttccctg

SEQ ID NO: 149331 - DNA, 22 bp, Artificial Sequence
  chemically synthesized
tgagcccttcttccctgcctcc

SEQ ID NO: 149332 - DNA, 22 bp, Artificial Sequence
  chemically synthesized
cttccctgcctcccccactcac

SEQ ID NO: 149333 - DNA, 22 bp, Artificial Sequence
  chemically synthesized
ttccctgcctcccccactcaca

SEQ ID NO: 149334 - DNA, 22 bp, Artificial Sequence
  chemically synthesized
ccctgcctcccccactcacagt

SEQ ID NO: 149335 - DNA, 22 bp, Artificial Sequence
  chemically synthesized
cctgcctcccccactcacagtg

SEQ ID NO: 149336 - DNA, 22 bp, Artificial Sequence
  chemically synthesized
cctcccccactcacagtgaccc

SEQ ID NO: 149337 - DNA, 22 bp, Artificial Sequence
  chemically synthesized
ccccactcacagtgacccggaa

SEQ ID NO: 149338 - DNA, 22 bp, Artificial Sequence
  chemically synthesized
acagtgacccggaatctgcagt

SEQ ID NO: 149339 - DNA, 22 bp, Artificial Sequence
  chemically synthesized
cagtgctagtctcccggaacta

SEQ ID NO: 149340 - DNA, 22 bp, Artificial Sequence
  chemically synthesized
gtctcccggaactatcactctt

SEQ ID NO: 149341 - DNA, 22 bp, Artificial Sequence
  chemically synthesized
ccggaactatcactctttcaca

SEQ ID NO: 149342 - DNA, 22 bp, Artificial Sequence
  chemically synthesized
tcactctttcacagtctgcttt

SEQ ID NO: 149343 - DNA, 22 bp, Artificial Sequence
  chemically synthesized
tttcacagtctgctttggaagg

SEQ ID NO: 149344 - DNA, 22 bp, Artificial Sequence
  chemically synthesized
tcacagtctgctttggaaggac

SEQ ID NO: 149345 - DNA, 22 bp, Artificial Sequence
  chemically synthesized
cacagtctgctttggaaggact

SEQ ID NO: 149346 - DNA, 22 bp, Artificial Sequence
  chemically synthesized
acagtctgctttggaaggactg

SEQ ID NO: 149347 - DNA, 22 bp, Artificial Sequence
  chemically synthesized
ctttggaaggactgggcttagt

SEQ ID NO: 149348 - DNA, 22 bp, Artificial Sequence
  chemically synthesized
tggaaggactgggcttagtatg

SEQ ID NO: 149349 - DNA, 22 bp, Artificial Sequence
  chemically synthesized
ggaaggactgggcttagtatga

SEQ ID NO: 149350 - DNA, 22 bp, Artificial Sequence
  chemically synthesized
gaaggactgggcttagtatgaa

SEQ ID NO: 149351 - DNA, 22 bp, Artificial Sequence
  chemically synthesized
ggcttagtatgaaaagttagga

SEQ ID NO: 149352 - DNA, 22 bp, Artificial Sequence
  chemically synthesized
agtatgaaaagttaggactgag

SEQ ID NO: 149353 - DNA, 22 bp, Artificial Sequence
  chemically synthesized
gtatgaaaagttaggactgaga

SEQ ID NO: 149354 - DNA, 22 bp, Artificial Sequence
  chemically synthesized
ggactgagaagaatttgaaagg

SEQ ID NO: 149355 - DNA, 22 bp, Artificial Sequence
  chemically synthesized
agaagaatttgaaaggcggctt

SEQ ID NO: 149356 - DNA, 22 bp, Artificial Sequence
  chemically synthesized
gaaaggcggctttttgtagctt

SEQ ID NO: 149357 - DNA, 22 bp, Artificial Sequence
  chemically synthesized
aaaggcggctttttgtagcttg

SEQ ID NO: 149358 - DNA, 22 bp, Artificial Sequence
  chemically synthesized
tttgtagcttgatattcactac

SEQ ID NO: 149359 - DNA, 22 bp, Artificial Sequence
  chemically synthesized
ttgtagcttgatattcactact

SEQ ID NO: 149360 - DNA, 22 bp, Artificial Sequence
  chemically synthesized
tgtagcttgatattcactactg

SEQ ID NO: 149361 - DNA, 22 bp, Artificial Sequence
  chemically synthesized
gtagcttgatattcactactgt

SEQ ID NO: 149362 - DNA, 22 bp, Artificial Sequence
  chemically synthesized
tagcttgatattcactactgtc

SEQ ID NO: 149363 - DNA, 22 bp, Artificial Sequence
  chemically synthesized
gatattcactactgtcttatta

SEQ ID NO: 149364 - DNA, 22 bp, Artificial Sequence
  chemically synthesized
atattcactactgtcttattac

SEQ ID NO: 149365 - DNA, 22 bp, Artificial Sequence
  chemically synthesized
actactgtcttattaccctgtc

SEQ ID NO: 149366 - DNA, 22 bp, Artificial Sequence
  chemically synthesized
ctgtcttattaccctgtcatag

SEQ ID NO: 149367 - DNA, 22 bp, Artificial Sequence
  chemically synthesized
tcttattaccctgtcataggcc

SEQ ID NO: 149368 - DNA, 22 bp, Artificial Sequence
  chemically synthesized
attaccctgtcataggcccacc

SEQ ID NO: 149369 - DNA, 22 bp, Artificial Sequence
  chemically synthesized
ttaccctgtcataggcccaccc

SEQ ID NO: 149370 - DNA, 22 bp, Artificial Sequence
  chemically synthesized
ccctgtcataggcccaccccaa

SEQ ID NO: 149371 - DNA, 22 bp, Artificial Sequence
  chemically synthesized
tcataggcccaccccaaatgga

SEQ ID NO: 149372 - DNA, 22 bp, Artificial Sequence
  chemically synthesized
ttcctcaggatgtttaagatta

SEQ ID NO: 149373 - DNA, 22 bp, Artificial Sequence
  chemically synthesized
cctcaggatgtttaagattagc

SEQ ID NO: 149374 - DNA, 22 bp, Artificial Sequence
  chemically synthesized
ctcaggatgtttaagattagca

SEQ ID NO: 149375 - DNA, 22 bp, Artificial Sequence
  chemically synthesized
aggatgtttaagattagcattc

SEQ ID NO: 149376 - DNA, 22 bp, Artificial Sequence
  chemically synthesized
aagattagcattcaggaagaga

SEQ ID NO: 149377 - DNA, 22 bp, Artificial Sequence
  chemically synthesized
agattagcattcaggaagagat

SEQ ID NO: 149378 - DNA, 22 bp, Artificial Sequence
  chemically synthesized
gcattcaggaagagatcagagg

SEQ ID NO: 149379 - DNA, 22 bp, Artificial Sequence
  chemically synthesized
aggaagagatcagaggtctgct

SEQ ID NO: 149380 - DNA, 22 bp, Artificial Sequence
  chemically synthesized
ctggctcccttatcatgtccct

SEQ ID NO: 149381 - DNA, 22 bp, Artificial Sequence
  chemically synthesized
gctcccttatcatgtcccttat

SEQ ID NO: 149382 - DNA, 22 bp, Artificial Sequence
  chemically synthesized
ccttatcatgtcccttatggtg

SEQ ID NO: 149383 - DNA, 22 bp, Artificial Sequence
  chemically synthesized
atcatgtcccttatggtgcttc

SEQ ID NO: 149384 - DNA, 22 bp, Artificial Sequence
  chemically synthesized
tcatgtcccttatggtgcttct

SEQ ID NO: 149385 - DNA, 22 bp, Artificial Sequence
  chemically synthesized
atggtgcttctggctctgcagt

SEQ ID NO: 149386 - DNA, 22 bp, Artificial Sequence
  chemically synthesized
tggtgcttctggctctgcagtt

SEQ ID NO: 149387 - DNA, 22 bp, Artificial Sequence
  chemically synthesized
ctggctctgcagttattagcat

SEQ ID NO: 149388 - DNA, 22 bp, Artificial Sequence
  chemically synthesized
tggctctgcagttattagcata

SEQ ID NO: 149389 - DNA, 22 bp, Artificial Sequence
  chemically synthesized
gctctgcagttattagcatagt

SEQ ID NO: 149390 - DNA, 22 bp, Artificial Sequence
  chemically synthesized
tgcagttattagcatagtgtta

SEQ ID NO: 149391 - DNA, 22 bp, Artificial Sequence
  chemically synthesized
cagttattagcatagtgttacc

SEQ ID NO: 149392 - DNA, 22 bp, Artificial Sequence
  chemically synthesized
ttagcatagtgttaccatcaac

SEQ ID NO: 149393 - DNA, 22 bp, Artificial Sequence
  chemically synthesized
gcatagtgttaccatcaaccac

SEQ ID NO: 149394 - DNA, 22 bp, Artificial Sequence
  chemically synthesized
ccatcaaccaccttaacttcat

SEQ ID NO: 149395 - DNA, 22 bp, Artificial Sequence
  chemically synthesized
aacttcatttttcttattcaat

SEQ ID NO: 149396 - DNA, 22 bp, Artificial Sequence
  chemically synthesized
acttcatttttcttattcaata

SEQ ID NO: 149397 - DNA, 22 bp, Artificial Sequence
  chemically synthesized
catttttcttattcaataccta

SEQ ID NO: 149398 - DNA, 22 bp, Artificial Sequence
  chemically synthesized
atttttcttattcaatacctag

SEQ ID NO: 149399 - DNA, 22 bp, Artificial Sequence
  chemically synthesized
ttcttattcaatacctaggtag

SEQ ID NO: 149400 - DNA, 22 bp, Artificial Sequence
  chemically synthesized
tcttattcaatacctaggtagg

SEQ ID NO: 149401 - DNA, 22 bp, Artificial Sequence
  chemically synthesized
cttattcaatacctaggtaggt

SEQ ID NO: 149402 - DNA, 22 bp, Artificial Sequence
  chemically synthesized
ttattcaatacctaggtaggta

SEQ ID NO: 149403 - DNA, 22 bp, Artificial Sequence
  chemically synthesized
attcaatacctaggtaggtaga

SEQ ID NO: 149404 - DNA, 22 bp, Artificial Sequence
  chemically synthesized
ttcaatacctaggtaggtagat

SEQ ID NO: 149405 - DNA, 22 bp, Artificial Sequence
  chemically synthesized
aatacctaggtaggtagatgct

SEQ ID NO: 149406 - DNA, 22 bp, Artificial Sequence
  chemically synthesized
ggtaggtagatgctagattctg

SEQ ID NO: 149407 - DNA, 22 bp, Artificial Sequence
  chemically synthesized
gattctggaaataaaatatgag

SEQ ID NO: 149408 - DNA, 22 bp, Artificial Sequence
  chemically synthesized
tggaaataaaatatgagtctca

SEQ ID NO: 149409 - DNA, 22 bp, Artificial Sequence
  chemically synthesized
gaaataaaatatgagtctcaag

SEQ ID NO: 149410 - DNA, 22 bp, Artificial Sequence
  chemically synthesized
aagtggtccttgtcctctctcc

SEQ ID NO: 149411 - DNA, 22 bp, Artificial Sequence
  chemically synthesized
gtcctctctcccagtcaaattc

SEQ ID NO: 149412 - DNA, 22 bp, Artificial Sequence
  chemically synthesized
tcctctctcccagtcaaattct

SEQ ID NO: 149413 - DNA, 22 bp, Artificial Sequence
  chemically synthesized
tctcccagtcaaattctgaatc

SEQ ID NO: 149414 - DNA, 22 bp, Artificial Sequence
  chemically synthesized
tcccagtcaaattctgaatcta

SEQ ID NO: 149415 - DNA, 22 bp, Artificial Sequence
  chemically synthesized
ccagtcaaattctgaatctagt

SEQ ID NO: 149416 - DNA, 22 bp, Artificial Sequence
  chemically synthesized
tgaatctagttggcaagattct

SEQ ID NO: 149417 - DNA, 22 bp, Artificial Sequence
  chemically synthesized
aatctagttggcaagattctga

SEQ ID NO: 149418 - DNA, 22 bp, Artificial Sequence
  chemically synthesized
gttggcaagattctgaaatcaa

SEQ ID NO: 149419 - DNA, 22 bp, Artificial Sequence
  chemically synthesized
gcaagattctgaaatcaaggca

SEQ ID NO: 149420 - DNA, 22 bp, Artificial Sequence
  chemically synthesized
tgaaatcaaggcatataatcag

SEQ ID NO: 149421 - DNA, 22 bp, Artificial Sequence
  chemically synthesized
aaatcaaggcatataatcagta

SEQ ID NO: 149422 - DNA, 22 bp, Artificial Sequence
  chemically synthesized
tattatatgagagggtgaaacc

SEQ ID NO: 149423 - DNA, 22 bp, Artificial Sequence
  chemically synthesized
attatatgagagggtgaaaccc

SEQ ID NO: 149424 - DNA, 22 bp, Artificial Sequence
  chemically synthesized
ttatatgagagggtgaaaccct

SEQ ID NO: 149425 - DNA, 22 bp, Artificial Sequence
  chemically synthesized
tatgagagggtgaaaccctcaa

SEQ ID NO: 149426 - DNA, 22 bp, Artificial Sequence
  chemically synthesized
aaaatgaaatgaaatcagaccc

SEQ ID NO: 149427 - DNA, 22 bp, Artificial Sequence
  chemically synthesized
gtcttacaccataaacaaaaat

SEQ ID NO: 149428 - DNA, 22 bp, Artificial Sequence
  chemically synthesized
tcttacaccataaacaaaaata

SEQ ID NO: 149429 - DNA, 22 bp, Artificial Sequence
  chemically synthesized
acaccataaacaaaaataaatt

SEQ ID NO: 149430 - DNA, 22 bp, Artificial Sequence
  chemically synthesized
caccataaacaaaaataaattt

SEQ ID NO: 149431 - DNA, 22 bp, Artificial Sequence
  chemically synthesized
gaatgggttaaagaattaaact

SEQ ID NO: 149432 - DNA, 22 bp, Artificial Sequence
  chemically synthesized
aatgggttaaagaattaaacta

SEQ ID NO: 149433 - DNA, 22 bp, Artificial Sequence
  chemically synthesized
aagaattaaactaagacctaaa

SEQ ID NO: 149434 - DNA, 22 bp, Artificial Sequence
  chemically synthesized
aactaagacctaaaaccataaa

SEQ ID NO: 149435 - DNA, 22 bp, Artificial Sequence
  chemically synthesized
agacctaaaaccataaaaattt

SEQ ID NO: 149436 - DNA, 22 bp, Artificial Sequence
  chemically synthesized
aaaccataaaaatttttaaaga

SEQ ID NO: 149437 - DNA, 22 bp, Artificial Sequence
  chemically synthesized
ttaaagaaatcaaaagaagaaa

SEQ ID NO: 149438 - DNA, 22 bp, Artificial Sequence
  chemically synthesized
taaagaaatcaaaagaagaaaa

SEQ ID NO: 149439 - DNA, 22 bp, Artificial Sequence
  chemically synthesized
aaagaaatcaaaagaagaaaat

SEQ ID NO: 149440 - DNA, 22 bp, Artificial Sequence
  chemically synthesized
aagaaatcaaaagaagaaaatt

SEQ ID NO: 149441 - DNA, 22 bp, Artificial Sequence
  chemically synthesized
taatattcacgttgcagccgtt

SEQ ID NO: 149442 - DNA, 22 bp, Artificial Sequence
  chemically synthesized
atattcacgttgcagccgtttt

SEQ ID NO: 149443 - DNA, 22 bp, Artificial Sequence
  chemically synthesized
acgttgcagccgttttttgaat

SEQ ID NO: 149444 - DNA, 22 bp, Artificial Sequence
  chemically synthesized
cagccgttttttgaatttgata

SEQ ID NO: 149445 - DNA, 22 bp, Artificial Sequence
  chemically synthesized
tttgaatttgatatgagaagca

SEQ ID NO: 149446 - DNA, 22 bp, Artificial Sequence
  chemically synthesized
ttgaatttgatatgagaagcaa

SEQ ID NO: 149447 - DNA, 22 bp, Artificial Sequence
  chemically synthesized
tgaatttgatatgagaagcaaa

SEQ ID NO: 149448 - DNA, 22 bp, Artificial Sequence
  chemically synthesized
gaatttgatatgagaagcaaag

SEQ ID NO: 149449 - DNA, 22 bp, Artificial Sequence
  chemically synthesized
aatttgatatgagaagcaaagg

SEQ ID NO: 149450 - DNA, 22 bp, Artificial Sequence
  chemically synthesized
gatatgagaagcaaaggcaaca

SEQ ID NO: 149451 - DNA, 22 bp, Artificial Sequence
  chemically synthesized
atatgagaagcaaaggcaacaa

SEQ ID NO: 149452 - DNA, 22 bp, Artificial Sequence
  chemically synthesized
catcaaactaaaaaatttccac

SEQ ID NO: 149453 - DNA, 22 bp, Artificial Sequence
  chemically synthesized
aaaaatttccacacaaaaaaca

SEQ ID NO: 149454 - DNA, 22 bp, Artificial Sequence
  chemically synthesized
ccacacaaaaaacaaaacaatg

SEQ ID NO: 149455 - DNA, 22 bp, Artificial Sequence
  chemically synthesized
cacacaaaaaacaaaacaatga

SEQ ID NO: 149456 - DNA, 22 bp, Artificial Sequence
  chemically synthesized
gcaaaccaaatatttcttaaat

SEQ ID NO: 149457 - DNA, 22 bp, Artificial Sequence
  chemically synthesized
caaaccaaatatttcttaaata

SEQ ID NO: 149458 - DNA, 22 bp, Artificial Sequence
  chemically synthesized
cttaaatattttggttaatatc

SEQ ID NO: 149459 - DNA, 22 bp, Artificial Sequence
  chemically synthesized
ttaaatattttggttaatatcc

SEQ ID NO: 149460 - DNA, 22 bp, Artificial Sequence
  chemically synthesized
aaatattttggttaatatccaa

SEQ ID NO: 149461 - DNA, 22 bp, Artificial Sequence
  chemically synthesized
aatattttggttaatatccaaa

SEQ ID NO: 149462 - DNA, 22 bp, Artificial Sequence
  chemically synthesized
tggttaatatccaaaatatata

SEQ ID NO: 149463 - DNA, 22 bp, Artificial Sequence
  chemically synthesized
ggttaatatccaaaatatataa

SEQ ID NO: 149464 - DNA, 22 bp, Artificial Sequence
  chemically synthesized
gttaatatccaaaatatataag

SEQ ID NO: 149465 - DNA, 22 bp, Artificial Sequence
  chemically synthesized
atatccaaaatatataagaaac

SEQ ID NO: 149466 - DNA, 22 bp, Artificial Sequence
  chemically synthesized
aataacaaacaaaaaattaaaa

SEQ ID NO: 149467 - DNA, 22 bp, Artificial Sequence
  chemically synthesized
aaaataggaaaataaaaaaatt

SEQ ID NO: 149468 - DNA, 22 bp, Artificial Sequence
  chemically synthesized
aaaagaagaaaatcctgccatt

SEQ ID NO: 149469 - DNA, 22 bp, Artificial Sequence
  chemically synthesized
ccatttatggcagaattgatga

SEQ ID NO: 149470 - DNA, 22 bp, Artificial Sequence
  chemically synthesized
atggcagaattgatgaacctgg

SEQ ID NO: 149471 - DNA, 22 bp, Artificial Sequence
  chemically synthesized
tggcagaattgatgaacctgga

SEQ ID NO: 149472 - DNA, 22 bp, Artificial Sequence
  chemically synthesized
atgaacctggaggatgtaaaac

SEQ ID NO: 149473 - DNA, 22 bp, Artificial Sequence
  chemically synthesized
gaggatgtaaaactaagaaaaa

SEQ ID NO: 149474 - DNA, 22 bp, Artificial Sequence
  chemically synthesized
agaaaaataagcctgacacaaa

SEQ ID NO: 149475 - DNA, 22 bp, Artificial Sequence
  chemically synthesized
acacaaaaagacaaatactaca

SEQ ID NO: 149476 - DNA, 22 bp, Artificial Sequence
  chemically synthesized
cacaaccttgctcatatgtgaa

SEQ ID NO: 149477 - DNA, 22 bp, Artificial Sequence
  chemically synthesized
gctcatatgtgaaacataaaaa

SEQ ID NO: 149478 - DNA, 22 bp, Artificial Sequence
  chemically synthesized
ctcatatgtgaaacataaaaaa

SEQ ID NO: 149479 - DNA, 22 bp, Artificial Sequence
  chemically synthesized
atatgtgaaacataaaaaagtc

SEQ ID NO: 149480 - DNA, 22 bp, Artificial Sequence
  chemically synthesized
tcatggaaacagacagtagagg

SEQ ID NO: 149481 - DNA, 22 bp, Artificial Sequence
  chemically synthesized
atggaaacagacagtagaggta

SEQ ID NO: 149482 - DNA, 22 bp, Artificial Sequence
  chemically synthesized
ccaggggttgggggtgggagaa

SEQ ID NO: 149483 - DNA, 22 bp, Artificial Sequence
  chemically synthesized
caggggttgggggtgggagaat

SEQ ID NO: 149484 - DNA, 22 bp, Artificial Sequence
  chemically synthesized
ggggtgggagaatcaggaaact

SEQ ID NO: 149485 - DNA, 22 bp, Artificial Sequence
  chemically synthesized
ttactcaaagggtataaaattt

SEQ ID NO: 149486 - DNA, 22 bp, Artificial Sequence
  chemically synthesized
ctcaaagggtataaaatttcag

SEQ ID NO: 149487 - DNA, 22 bp, Artificial Sequence
  chemically synthesized
aaagggtataaaatttcagtta

SEQ ID NO: 149488 - DNA, 22 bp, Artificial Sequence
  chemically synthesized
cagttatgtgggatgaataaat

SEQ ID NO: 149489 - DNA, 22 bp, Artificial Sequence
  chemically synthesized
agttatgtgggatgaataaatt

SEQ ID NO: 149490 - DNA, 22 bp, Artificial Sequence
  chemically synthesized
tgtgggatgaataaattctaga

SEQ ID NO: 149491 - DNA, 22 bp, Artificial Sequence
  chemically synthesized
tagatatctaatgtacagcatc

SEQ ID NO: 149492 - DNA, 22 bp, Artificial Sequence
  chemically synthesized
gatatctaatgtacagcatcgt

SEQ ID NO: 149493 - DNA, 22 bp, Artificial Sequence
  chemically synthesized
atgtacagcatcgtgactgtag

SEQ ID NO: 149494 - DNA, 22 bp, Artificial Sequence
  chemically synthesized
tagttaattgtactgtaagtat

SEQ ID NO: 149495 - DNA, 22 bp, Artificial Sequence
  chemically synthesized
attgtactgtaagtatatttaa

SEQ ID NO: 149496 - DNA, 22 bp, Artificial Sequence
  chemically synthesized
tactgtaagtatatttaaaatt

SEQ ID NO: 149497 - DNA, 22 bp, Artificial Sequence
  chemically synthesized
taagtatatttaaaatttgcaa

SEQ ID NO: 149498 - DNA, 22 bp, Artificial Sequence
  chemically synthesized
aaaatttgcaaagagagtagat

SEQ ID NO: 149499 - DNA, 22 bp, Artificial Sequence
  chemically synthesized
aaatttgcaaagagagtagatt

SEQ ID NO: 149500 - DNA, 22 bp, Artificial Sequence
  chemically synthesized
gcaaagagagtagatttttttt

SEQ ID NO: 149501 - DNA, 22 bp, Artificial Sequence
  chemically synthesized
caaagagagtagattttttttt

SEQ ID NO: 149502 - DNA, 22 bp, Artificial Sequence
  chemically synthesized
ttttttttttttagatggagtt

SEQ ID NO: 149503 - DNA, 22 bp, Artificial Sequence
  chemically synthesized
tttttttttttagatggagttt

SEQ ID NO: 149504 - DNA, 22 bp, Artificial Sequence
  chemically synthesized
ttttttttttagatggagtttt

SEQ ID NO: 149505 - DNA, 22 bp, Artificial Sequence
  chemically synthesized
tttttttttagatggagttttg

SEQ ID NO: 149506 - DNA, 22 bp, Artificial Sequence
  chemically synthesized
ttttttttagatggagttttgc

SEQ ID NO: 149507 - DNA, 22 bp, Artificial Sequence
  chemically synthesized
tttttttagatggagttttgct

SEQ ID NO: 149508 - DNA, 22 bp, Artificial Sequence
  chemically synthesized
ttttttagatggagttttgctc

SEQ ID NO: 149509 - DNA, 22 bp, Artificial Sequence
  chemically synthesized
tttttagatggagttttgctct

SEQ ID NO: 149510 - DNA, 22 bp, Artificial Sequence
  chemically synthesized
ttttagatggagttttgctctt

SEQ ID NO: 149511 - DNA, 22 bp, Artificial Sequence
  chemically synthesized
tttagatggagttttgctcttg

SEQ ID NO: 149512 - DNA, 22 bp, Artificial Sequence
  chemically synthesized
ttagatggagttttgctcttgt

SEQ ID NO: 149513 - DNA, 22 bp, Artificial Sequence
  chemically synthesized
tagatggagttttgctcttgtt

SEQ ID NO: 149514 - DNA, 22 bp, Artificial Sequence
  chemically synthesized
agatggagttttgctcttgttg

SEQ ID NO: 149515 - DNA, 22 bp, Artificial Sequence
  chemically synthesized
gatggagttttgctcttgttgt

SEQ ID NO: 149516 - DNA, 22 bp, Artificial Sequence
  chemically synthesized
tgctcttgttgtccaggctgga

SEQ ID NO: 149517 - DNA, 22 bp, Artificial Sequence
  chemically synthesized
gctcttgttgtccaggctggag

SEQ ID NO: 149518 - DNA, 22 bp, Artificial Sequence
  chemically synthesized
ctcttgttgtccaggctggagt

SEQ ID NO: 149519 - DNA, 22 bp, Artificial Sequence
  chemically synthesized
ttgttgtccaggctggagtgca

SEQ ID NO: 149520 - DNA, 22 bp, Artificial Sequence
  chemically synthesized
gttgtccaggctggagtgcaat

SEQ ID NO: 149521 - DNA, 22 bp, Artificial Sequence
  chemically synthesized
ttgtccaggctggagtgcaatg

SEQ ID NO: 149522 - DNA, 22 bp, Artificial Sequence
  chemically synthesized
tccaggctggagtgcaatggca

SEQ ID NO: 149523 - DNA, 22 bp, Artificial Sequence
  chemically synthesized
gagtgcaatggcaagatcttgg

SEQ ID NO: 149524 - DNA, 22 bp, Artificial Sequence
  chemically synthesized
ggctcactgcaacctccgcctc

SEQ ID NO: 149525 - DNA, 22 bp, Artificial Sequence
  chemically synthesized
gctcactgcaacctccgcctcc

SEQ ID NO: 149526 - DNA, 22 bp, Artificial Sequence
  chemically synthesized
actgcaacctccgcctcctggg

SEQ ID NO: 149527 - DNA, 22 bp, Artificial Sequence
  chemically synthesized
caacctccgcctcctgggttca

SEQ ID NO: 149528 - DNA, 22 bp, Artificial Sequence
  chemically synthesized
cgcctcctgggttcaagcaaat

SEQ ID NO: 149529 - DNA, 22 bp, Artificial Sequence
  chemically synthesized
ctgggttcaagcaaatctcctg

SEQ ID NO: 149530 - DNA, 22 bp, Artificial Sequence
  chemically synthesized
ggttcaagcaaatctcctgcct

SEQ ID NO: 149531 - DNA, 22 bp, Artificial Sequence
  chemically synthesized
aagcaaatctcctgcctcagcc

SEQ ID NO: 149532 - DNA, 22 bp, Artificial Sequence
  chemically synthesized
ctgcctcagcctcccgagtagc

SEQ ID NO: 149533 - DNA, 22 bp, Artificial Sequence
  chemically synthesized
cctcagcctcccgagtagctgg

SEQ ID NO: 149534 - DNA, 22 bp, Artificial Sequence
  chemically synthesized
agcctcccgagtagctgggatt

SEQ ID NO: 149535 - DNA, 22 bp, Artificial Sequence
  chemically synthesized
ccgagtagctgggattacaggc

SEQ ID NO: 149536 - DNA, 22 bp, Artificial Sequence
  chemically synthesized
ggattacaggcatgcgacacca

SEQ ID NO: 149537 - DNA, 22 bp, Artificial Sequence
  chemically synthesized
caggcatgcgacaccatgccca

SEQ ID NO: 149538 - DNA, 22 bp, Artificial Sequence
  chemically synthesized
attttgtatttttagtagagac

SEQ ID NO: 149539 - DNA, 22 bp, Artificial Sequence
  chemically synthesized
tgtatttttagtagagacgggg

SEQ ID NO: 149540 - DNA, 22 bp, Artificial Sequence
  chemically synthesized
gtatttttagtagagacggggt

SEQ ID NO: 149541 - DNA, 22 bp, Artificial Sequence
  chemically synthesized
tatttttagtagagacggggtt

SEQ ID NO: 149542 - DNA, 22 bp, Artificial Sequence
  chemically synthesized
ttagtagagacggggtttctcc

SEQ ID NO: 149543 - DNA, 22 bp, Artificial Sequence
  chemically synthesized
tagtagagacggggtttctcca

SEQ ID NO: 149544 - DNA, 22 bp, Artificial Sequence
  chemically synthesized
agtagagacggggtttctccat

SEQ ID NO: 149545 - DNA, 22 bp, Artificial Sequence
  chemically synthesized
gtagagacggggtttctccatg

SEQ ID NO: 149546 - DNA, 22 bp, Artificial Sequence
  chemically synthesized
ctccatgttggtcaggctgatc

SEQ ID NO: 149547 - DNA, 22 bp, Artificial Sequence
  chemically synthesized
tccatgttggtcaggctgatcc

SEQ ID NO: 149548 - DNA, 22 bp, Artificial Sequence
  chemically synthesized
catgttggtcaggctgatccgc

SEQ ID NO: 149549 - DNA, 22 bp, Artificial Sequence
  chemically synthesized
gtcaggctgatccgcctgcctc

SEQ ID NO: 149550 - DNA, 22 bp, Artificial Sequence
  chemically synthesized
atccgcctgcctcggccaccca

SEQ ID NO: 149551 - DNA, 22 bp, Artificial Sequence
  chemically synthesized
cctcggccacccaaagggctgg

SEQ ID NO: 149552 - DNA, 22 bp, Artificial Sequence
  chemically synthesized
ggccacccaaagggctgggatt

SEQ ID NO: 149553 - DNA, 22 bp, Artificial Sequence
  chemically synthesized
ggattacaggcgtgagccaccg

SEQ ID NO: 149554 - DNA, 22 bp, Artificial Sequence
  chemically synthesized
caggcgtgagccaccgggcctg

SEQ ID NO: 149555 - DNA, 22 bp, Artificial Sequence
  chemically synthesized
gccgagagtagatcttaaaagc

SEQ ID NO: 149556 - DNA, 22 bp, Artificial Sequence
  chemically synthesized
aaaagcatttaccacaagaaaa

SEQ ID NO: 149557 - DNA, 22 bp, Artificial Sequence
  chemically synthesized
aaagcatttaccacaagaaaaa

SEQ ID NO: 149558 - DNA, 22 bp, Artificial Sequence
  chemically synthesized
accacaagaaaaaggtaactat

SEQ ID NO: 149559 - DNA, 22 bp, Artificial Sequence
  chemically synthesized
ccacaagaaaaaggtaactatg

SEQ ID NO: 149560 - DNA, 22 bp, Artificial Sequence
  chemically synthesized
tgtgagataatgggtatgttaa

SEQ ID NO: 149561 - DNA, 22 bp, Artificial Sequence
  chemically synthesized
attagcttgattgtggtaatca

SEQ ID NO: 149562 - DNA, 22 bp, Artificial Sequence
  chemically synthesized
gcttgattgtggtaatcatttc

SEQ ID NO: 149563 - DNA, 22 bp, Artificial Sequence
  chemically synthesized
gattgtggtaatcatttcacaa

SEQ ID NO: 149564 - DNA, 22 bp, Artificial Sequence
  chemically synthesized
attgtggtaatcatttcacaag

SEQ ID NO: 149565 - DNA, 22 bp, Artificial Sequence
  chemically synthesized
tggtaatcatttcacaaggtat

SEQ ID NO: 149566 - DNA, 22 bp, Artificial Sequence
  chemically synthesized
cacaaggtatacatatattaaa

SEQ ID NO: 149567 - DNA, 22 bp, Artificial Sequence
  chemically synthesized
acaaggtatacatatattaaaa

SEQ ID NO: 149568 - DNA, 22 bp, Artificial Sequence
  chemically synthesized
aaacatcatgttgtacacctta

SEQ ID NO: 149569 - DNA, 22 bp, Artificial Sequence
  chemically synthesized
tacaccttaaatatatacaatt

SEQ ID NO: 149570 - DNA, 22 bp, Artificial Sequence
  chemically synthesized
aaatatatacaatttttatttg

SEQ ID NO: 149571 - DNA, 22 bp, Artificial Sequence
  chemically synthesized
aatatatacaatttttatttgt

SEQ ID NO: 149572 - DNA, 22 bp, Artificial Sequence
  chemically synthesized
ttatttgtgaatgatacctcaa

SEQ ID NO: 149573 - DNA, 22 bp, Artificial Sequence
  chemically synthesized
tatttgtgaatgatacctcaat

SEQ ID NO: 149574 - DNA, 22 bp, Artificial Sequence
  chemically synthesized
atttgtgaatgatacctcaata

SEQ ID NO: 149575 - DNA, 22 bp, Artificial Sequence
  chemically synthesized
tttgtgaatgatacctcaataa

SEQ ID NO: 149576 - DNA, 22 bp, Artificial Sequence
  chemically synthesized
gtgaatgatacctcaataaagt

SEQ ID NO: 149577 - DNA, 22 bp, Artificial Sequence
  chemically synthesized
tgaatgatacctcaataaagtt

SEQ ID NO: 149578 - DNA, 22 bp, Artificial Sequence
  chemically synthesized
aataaagttgaagaataataaa

SEQ ID NO: 149579 - DNA, 22 bp, Artificial Sequence
  chemically synthesized
aagaataataaaaaagaataga

SEQ ID NO: 149580 - DNA, 22 bp, Artificial Sequence
  chemically synthesized
aaaaactaaaaaataaaaaaat

SEQ ID NO: 149581 - DNA, 22 bp, Artificial Sequence
  chemically synthesized
aaaaataaaaaaatgcatcttg

SEQ ID NO: 149582 - DNA, 22 bp, Artificial Sequence
  chemically synthesized
gatgattagaattgcattcttg

SEQ ID NO: 149583 - DNA, 22 bp, Artificial Sequence
  chemically synthesized
atgattagaattgcattcttga

SEQ ID NO: 149584 - DNA, 22 bp, Artificial Sequence
  chemically synthesized
gaattgcattcttgatttttca

SEQ ID NO: 149585 - DNA, 22 bp, Artificial Sequence
  chemically synthesized
cattcttgatttttcagataca

SEQ ID NO: 149586 - DNA, 22 bp, Artificial Sequence
  chemically synthesized
ttgatttttcagatacaaatat

SEQ ID NO: 149587 - DNA, 22 bp, Artificial Sequence
  chemically synthesized
gatttttcagatacaaatatcc

SEQ ID NO: 149588 - DNA, 22 bp, Artificial Sequence
  chemically synthesized
atttttcagatacaaatatcca

SEQ ID NO: 149589 - DNA, 22 bp, Artificial Sequence
  chemically synthesized
ttcagatacaaatatccatttg

SEQ ID NO: 149590 - DNA, 22 bp, Artificial Sequence
  chemically synthesized
tcagatacaaatatccatttga

SEQ ID NO: 149591 - DNA, 22 bp, Artificial Sequence
  chemically synthesized
cagatacaaatatccatttgac

SEQ ID NO: 149592 - DNA, 22 bp, Artificial Sequence
  chemically synthesized
agatacaaatatccatttgact

SEQ ID NO: 149593 - DNA, 22 bp, Artificial Sequence
  chemically synthesized
gactgtttactcttttccaaaa

SEQ ID NO: 149594 - DNA, 22 bp, Artificial Sequence
  chemically synthesized
actgtttactcttttccaaaac

SEQ ID NO: 149595 - DNA, 22 bp, Artificial Sequence
  chemically synthesized
tttactcttttccaaaacaata

SEQ ID NO: 149596 - DNA, 22 bp, Artificial Sequence
  chemically synthesized
actcttttccaaaacaatacaa

SEQ ID NO: 149597 - DNA, 22 bp, Artificial Sequence
  chemically synthesized
ctcttttccaaaacaatacaat

SEQ ID NO: 149598 - DNA, 22 bp, Artificial Sequence
  chemically synthesized
ttttccaaaacaatacaataaa

SEQ ID NO: 149599 - DNA, 22 bp, Artificial Sequence
  chemically synthesized
ttccaaaacaatacaataaatt

SEQ ID NO: 149600 - DNA, 22 bp, Artificial Sequence
  chemically synthesized
tccaaaacaatacaataaattt

SEQ ID NO: 149601 - DNA, 22 bp, Artificial Sequence
  chemically synthesized
ccaaaacaatacaataaatttt

SEQ ID NO: 149602 - DNA, 22 bp, Artificial Sequence
  chemically synthesized
caaaacaatacaataaatttta

SEQ ID NO: 149603 - DNA, 22 bp, Artificial Sequence
  chemically synthesized
tagcactttatcttcattttcc

SEQ ID NO: 149604 - DNA, 22 bp, Artificial Sequence
  chemically synthesized
agcactttatcttcattttccc

SEQ ID NO: 149605 - DNA, 22 bp, Artificial Sequence
  chemically synthesized
gcactttatcttcattttcccc

SEQ ID NO: 149606 - DNA, 22 bp, Artificial Sequence
  chemically synthesized
tatcttcattttccccttccca

SEQ ID NO: 149607 - DNA, 22 bp, Artificial Sequence
  chemically synthesized
atcttcattttccccttcccaa

SEQ ID NO: 149608 - DNA, 22 bp, Artificial Sequence
  chemically synthesized
tcttcattttccccttcccaat

SEQ ID NO: 149609 - DNA, 22 bp, Artificial Sequence
  chemically synthesized
cattttccccttcccaatctat

SEQ ID NO: 149610 - DNA, 22 bp, Artificial Sequence
  chemically synthesized
attttccccttcccaatctata

SEQ ID NO: 149611 - DNA, 22 bp, Artificial Sequence
  chemically synthesized
tccccttcccaatctataatta

SEQ ID NO: 149612 - DNA, 22 bp, Artificial Sequence
  chemically synthesized
ccccttcccaatctataattat

SEQ ID NO: 149613 - DNA, 22 bp, Artificial Sequence
  chemically synthesized
cccttcccaatctataattata

SEQ ID NO: 149614 - DNA, 22 bp, Artificial Sequence
  chemically synthesized
cccaatctataattatatatat

SEQ ID NO: 149615 - DNA, 22 bp, Artificial Sequence
  chemically synthesized
ccaatctataattatatatata

SEQ ID NO: 149616 - DNA, 22 bp, Artificial Sequence
  chemically synthesized
taattatatatatatatatttt

SEQ ID NO: 149617 - DNA, 22 bp, Artificial Sequence
  chemically synthesized
tatatatatatattttagatat

SEQ ID NO: 149618 - DNA, 22 bp, Artificial Sequence
  chemically synthesized
tagatattttgtatagttttac

SEQ ID NO: 149619 - DNA, 22 bp, Artificial Sequence
  chemically synthesized
agatattttgtatagttttact

SEQ ID NO: 149620 - DNA, 22 bp, Artificial Sequence
  chemically synthesized
gatattttgtatagttttactc

SEQ ID NO: 149621 - DNA, 22 bp, Artificial Sequence
  chemically synthesized
tgtatagttttactccctagat

SEQ ID NO: 149622 - DNA, 22 bp, Artificial Sequence
  chemically synthesized
gtatagttttactccctagatt

SEQ ID NO: 149623 - DNA, 22 bp, Artificial Sequence
  chemically synthesized
tatagttttactccctagattt

SEQ ID NO: 149624 - DNA, 22 bp, Artificial Sequence
  chemically synthesized
tactccctagattttctagtgt

SEQ ID NO: 149625 - DNA, 22 bp, Artificial Sequence
  chemically synthesized
actccctagattttctagtgtt

SEQ ID NO: 149626 - DNA, 22 bp, Artificial Sequence
  chemically synthesized
ctccctagattttctagtgtta

SEQ ID NO: 149627 - DNA, 22 bp, Artificial Sequence
  chemically synthesized
cctagattttctagtgttatta

SEQ ID NO: 149628 - DNA, 22 bp, Artificial Sequence
  chemically synthesized
gattttctagtgttattattaa

SEQ ID NO: 149629 - DNA, 22 bp, Artificial Sequence
  chemically synthesized
tctagtgttattattaaatagt

SEQ ID NO: 149630 - DNA, 22 bp, Artificial Sequence
  chemically synthesized
ctagtgttattattaaatagtg

SEQ ID NO: 149631 - DNA, 22 bp, Artificial Sequence
  chemically synthesized
tagtgttattattaaatagtga

SEQ ID NO: 149632 - DNA, 22 bp, Artificial Sequence
  chemically synthesized
gtgttattattaaatagtgaag

SEQ ID NO: 149633 - DNA, 22 bp, Artificial Sequence
  chemically synthesized
ttattaaatagtgaagaaatgt

SEQ ID NO: 149634 - DNA, 22 bp, Artificial Sequence
  chemically synthesized
ttaaatagtgaagaaatgttta

SEQ ID NO: 149635 - DNA, 22 bp, Artificial Sequence
  chemically synthesized
aatagtgaagaaatgtttacac

SEQ ID NO: 149636 - DNA, 22 bp, Artificial Sequence
  chemically synthesized
acacttatgtacaaaatgtttt

SEQ ID NO: 149637 - DNA, 22 bp, Artificial Sequence
  chemically synthesized
cacttatgtacaaaatgttttg

SEQ ID NO: 149638 - DNA, 22 bp, Artificial Sequence
  chemically synthesized
atgtacaaaatgttttgcatgc

SEQ ID NO: 149639 - DNA, 22 bp, Artificial Sequence
  chemically synthesized
tgtacaaaatgttttgcatgct

SEQ ID NO: 149640 - DNA, 22 bp, Artificial Sequence
  chemically synthesized
tgcatgcttttcttcatttcta

SEQ ID NO: 149641 - DNA, 22 bp, Artificial Sequence
  chemically synthesized
gcatgcttttcttcatttctaa

SEQ ID NO: 149642 - DNA, 22 bp, Artificial Sequence
  chemically synthesized
catgcttttcttcatttctaac

SEQ ID NO: 149643 - DNA, 22 bp, Artificial Sequence
  chemically synthesized
ttcttcatttctaacattctct

SEQ ID NO: 149644 - DNA, 22 bp, Artificial Sequence
  chemically synthesized
tcttcatttctaacattctctc

SEQ ID NO: 149645 - DNA, 22 bp, Artificial Sequence
  chemically synthesized
cttcatttctaacattctctct

SEQ ID NO: 149646 - DNA, 22 bp, Artificial Sequence
  chemically synthesized
ttcatttctaacattctctcta

SEQ ID NO: 149647 - DNA, 22 bp, Artificial Sequence
  chemically synthesized
catttctaacattctctctaag

SEQ ID NO: 149648 - DNA, 22 bp, Artificial Sequence
  chemically synthesized
atttctaacattctctctaagt

SEQ ID NO: 149649 - DNA, 22 bp, Artificial Sequence
  chemically synthesized
ctaacattctctctaagtttat

SEQ ID NO: 149650 - DNA, 22 bp, Artificial Sequence
  chemically synthesized
taacattctctctaagtttatt

SEQ ID NO: 149651 - DNA, 22 bp, Artificial Sequence
  chemically synthesized
acattctctctaagtttattct

SEQ ID NO: 149652 - DNA, 22 bp, Artificial Sequence
  chemically synthesized
tctctaagtttattctattttt

SEQ ID NO: 149653 - DNA, 22 bp, Artificial Sequence
  chemically synthesized
tctaagtttattctattttttt

SEQ ID NO: 149654 - DNA, 22 bp, Artificial Sequence
  chemically synthesized
taagtttattctatttttttct

SEQ ID NO: 149655 - DNA, 22 bp, Artificial Sequence
  chemically synthesized
agtttattctatttttttctga

SEQ ID NO: 149656 - DNA, 22 bp, Artificial Sequence
  chemically synthesized
attctatttttttctgattatc

SEQ ID NO: 149657 - DNA, 22 bp, Artificial Sequence
  chemically synthesized
ttctatttttttctgattatcc

SEQ ID NO: 149658 - DNA, 22 bp, Artificial Sequence
  chemically synthesized
tatttttttctgattatcctta

SEQ ID NO: 149659 - DNA, 22 bp, Artificial Sequence
  chemically synthesized
tttttttctgattatccttaat

SEQ ID NO: 149660 - DNA, 22 bp, Artificial Sequence
  chemically synthesized
ttttctgattatccttaatatt

SEQ ID NO: 149661 - DNA, 22 bp, Artificial Sequence
  chemically synthesized
tttctgattatccttaatatta

SEQ ID NO: 149662 - DNA, 22 bp, Artificial Sequence
  chemically synthesized
ttctgattatccttaatattat

SEQ ID NO: 149663 - DNA, 22 bp, Artificial Sequence
  chemically synthesized
tctgattatccttaatattatc

SEQ ID NO: 149664 - DNA, 22 bp, Artificial Sequence
  chemically synthesized
ctgattatccttaatattatct

SEQ ID NO: 149665 - DNA, 22 bp, Artificial Sequence
  chemically synthesized
tgattatccttaatattatctc

SEQ ID NO: 149666 - DNA, 22 bp, Artificial Sequence
  chemically synthesized
attatccttaatattatctctt

SEQ ID NO: 149667 - DNA, 22 bp, Artificial Sequence
  chemically synthesized
tccttaatattatctctttctg

SEQ ID NO: 149668 - DNA, 22 bp, Artificial Sequence
  chemically synthesized
aatattatctctttctgctgga

SEQ ID NO: 149669 - DNA, 22 bp, Artificial Sequence
  chemically synthesized
atattatctctttctgctggaa

SEQ ID NO: 149670 - DNA, 22 bp, Artificial Sequence
  chemically synthesized
tctctttctgctggaaatacat

SEQ ID NO: 149671 - DNA, 22 bp, Artificial Sequence
  chemically synthesized
tttctgctggaaatacattgtt

SEQ ID NO: 149672 - DNA, 22 bp, Artificial Sequence
  chemically synthesized
tctgctggaaatacattgttac

SEQ ID NO: 149673 - DNA, 22 bp, Artificial Sequence
  chemically synthesized
ctgctggaaatacattgttact

SEQ ID NO: 149674 - DNA, 22 bp, Artificial Sequence
  chemically synthesized
tgctggaaatacattgttactt

SEQ ID NO: 149675 - DNA, 22 bp, Artificial Sequence
  chemically synthesized
ctggaaatacattgttactttt

SEQ ID NO: 149676 - DNA, 22 bp, Artificial Sequence
  chemically synthesized
gaaatacattgttacttttggt

SEQ ID NO: 149677 - DNA, 22 bp, Artificial Sequence
  chemically synthesized
ttacttttggtttatctaaaaa

SEQ ID NO: 149678 - DNA, 22 bp, Artificial Sequence
  chemically synthesized
cttttggtttatctaaaaatgg

SEQ ID NO: 149679 - DNA, 22 bp, Artificial Sequence
  chemically synthesized
ttggtttatctaaaaatggctt

SEQ ID NO: 149680 - DNA, 22 bp, Artificial Sequence
  chemically synthesized
tggtttatctaaaaatggcttc

SEQ ID NO: 149681 - DNA, 22 bp, Artificial Sequence
  chemically synthesized
ggtttatctaaaaatggcttca

SEQ ID NO: 149682 - DNA, 22 bp, Artificial Sequence
  chemically synthesized
gtttatctaaaaatggcttcat

SEQ ID NO: 149683 - DNA, 22 bp, Artificial Sequence
  chemically synthesized
atctaaaaatggcttcattttc

SEQ ID NO: 149684 - DNA, 22 bp, Artificial Sequence
  chemically synthesized
tctaaaaatggcttcattttct

SEQ ID NO: 149685 - DNA, 22 bp, Artificial Sequence
  chemically synthesized
aaaatggcttcattttcttcat

SEQ ID NO: 149686 - DNA, 22 bp, Artificial Sequence
  chemically synthesized
cattttcttcattctaaaatca

SEQ ID NO: 149687 - DNA, 22 bp, Artificial Sequence
  chemically synthesized
attttcttcattctaaaatcat

SEQ ID NO: 149688 - DNA, 22 bp, Artificial Sequence
  chemically synthesized
tcttcattctaaaatcatgtta

SEQ ID NO: 149689 - DNA, 22 bp, Artificial Sequence
  chemically synthesized
cttcattctaaaatcatgttaa

SEQ ID NO: 149690 - DNA, 22 bp, Artificial Sequence
  chemically synthesized
ttcattctaaaatcatgttaaa

SEQ ID NO: 149691 - DNA, 22 bp, Artificial Sequence
  chemically synthesized
cattctaaaatcatgttaaatt

SEQ ID NO: 149692 - DNA, 22 bp, Artificial Sequence
  chemically synthesized
attctaaaatcatgttaaatta

SEQ ID NO: 149693 - DNA, 22 bp, Artificial Sequence
  chemically synthesized
taaaatcatgttaaattaatac

SEQ ID NO: 149694 - DNA, 22 bp, Artificial Sequence
  chemically synthesized
aaatcatgttaaattaatacca

SEQ ID NO: 149695 - DNA, 22 bp, Artificial Sequence
  chemically synthesized
aattaataccactcatgtgtaa

SEQ ID NO: 149696 - DNA, 22 bp, Artificial Sequence
  chemically synthesized
ataccactcatgtgtaagtaag

SEQ ID NO: 149697 - DNA, 22 bp, Artificial Sequence
  chemically synthesized
atgtgtaagtaagatagtggaa

SEQ ID NO: 149698 - DNA, 22 bp, Artificial Sequence
  chemically synthesized
aatctcactaaaatataataat

SEQ ID NO: 149699 - DNA, 22 bp, Artificial Sequence
  chemically synthesized
actaaaatataataatgtgata

SEQ ID NO: 149700 - DNA, 22 bp, Artificial Sequence
  chemically synthesized
aaatataataatgtgatatata

SEQ ID NO: 149701 - DNA, 22 bp, Artificial Sequence
  chemically synthesized
ttaaatttagcttggaaataaa

SEQ ID NO: 149702 - DNA, 22 bp, Artificial Sequence
  chemically synthesized
taaatttagcttggaaataaaa

SEQ ID NO: 149703 - DNA, 22 bp, Artificial Sequence
  chemically synthesized
aaatttagcttggaaataaaaa

SEQ ID NO: 149704 - DNA, 22 bp, Artificial Sequence
  chemically synthesized
aatttagcttggaaataaaaaa

SEQ ID NO: 149705 - DNA, 22 bp, Artificial Sequence
  chemically synthesized
agcttggaaataaaaaacaaac

SEQ ID NO: 149706 - DNA, 22 bp, Artificial Sequence
  chemically synthesized
gcttggaaataaaaaacaaaca

SEQ ID NO: 149707 - DNA, 22 bp, Artificial Sequence
  chemically synthesized
ggaaataaaaaacaaacagtaa

SEQ ID NO: 149708 - DNA, 22 bp, Artificial Sequence
  chemically synthesized
gaaataaaaaacaaacagtaat

SEQ ID NO: 149709 - DNA, 22 bp, Artificial Sequence
  chemically synthesized
aacaactatactttttgaaaag

SEQ ID NO: 149710 - DNA, 22 bp, Artificial Sequence
  chemically synthesized
tactttttgaaaagagtaaagt

SEQ ID NO: 149711 - DNA, 22 bp, Artificial Sequence
  chemically synthesized
tttgaaaagagtaaagtgaaat

SEQ ID NO: 149712 - DNA, 22 bp, Artificial Sequence
  chemically synthesized
ttgaaaagagtaaagtgaaatg

SEQ ID NO: 149713 - DNA, 22 bp, Artificial Sequence
  chemically synthesized
tgaaaagagtaaagtgaaatgc

SEQ ID NO: 149714 - DNA, 22 bp, Artificial Sequence
  chemically synthesized
gaaaagagtaaagtgaaatgct

SEQ ID NO: 149715 - DNA, 22 bp, Artificial Sequence
  chemically synthesized
aaaagagtaaagtgaaatgctt

SEQ ID NO: 149716 - DNA, 22 bp, Artificial Sequence
  chemically synthesized
aactgcatataccacaatcgat

SEQ ID NO: 149717 - DNA, 22 bp, Artificial Sequence
  chemically synthesized
actgcatataccacaatcgatt

SEQ ID NO: 149718 - DNA, 22 bp, Artificial Sequence
  chemically synthesized
catataccacaatcgattacac

SEQ ID NO: 149719 - DNA, 22 bp, Artificial Sequence
  chemically synthesized
cacaattaggtgtgaaggtaaa

SEQ ID NO: 149720 - DNA, 22 bp, Artificial Sequence
  chemically synthesized
ggtgtgaaggtaaaattcagtc

SEQ ID NO: 149721 - DNA, 22 bp, Artificial Sequence
  chemically synthesized
agtcacgaaaaaactagaataa

SEQ ID NO: 149722 - DNA, 22 bp, Artificial Sequence
  chemically synthesized
gaataaaaatatgggaagacat

SEQ ID NO: 149723 - DNA, 22 bp, Artificial Sequence
  chemically synthesized
agagataacactgttatttaat

SEQ ID NO: 149724 - DNA, 22 bp, Artificial Sequence
  chemically synthesized
gagataacactgttatttaatt

SEQ ID NO: 149725 - DNA, 22 bp, Artificial Sequence
  chemically synthesized
ttatttaattatcaacccaaag

SEQ ID NO: 149726 - DNA, 22 bp, Artificial Sequence
  chemically synthesized
tttaattatcaacccaaagtag

SEQ ID NO: 149727 - DNA, 22 bp, Artificial Sequence
  chemically synthesized
aattatcaacccaaagtagaaa

SEQ ID NO: 149728 - DNA, 22 bp, Artificial Sequence
  chemically synthesized
attatcaacccaaagtagaaac

SEQ ID NO: 149729 - DNA, 22 bp, Artificial Sequence
  chemically synthesized
tcaacccaaagtagaaactatc

SEQ ID NO: 149730 - DNA, 22 bp, Artificial Sequence
  chemically synthesized
tcaagggagaaataaattcagt

SEQ ID NO: 149731 - DNA, 22 bp, Artificial Sequence
  chemically synthesized
agtcaacaataaaagcatttaa

SEQ ID NO: 149732 - DNA, 22 bp, Artificial Sequence
  chemically synthesized
aagaagttattctaggctggga

SEQ ID NO: 149733 - DNA, 22 bp, Artificial Sequence
  chemically synthesized
agaagttattctaggctgggag

SEQ ID NO: 149734 - DNA, 22 bp, Artificial Sequence
  chemically synthesized
ttctaggctgggagcggtggct

SEQ ID NO: 149735 - DNA, 22 bp, Artificial Sequence
  chemically synthesized
taggctgggagcggtggctcac

SEQ ID NO: 149736 - DNA, 22 bp, Artificial Sequence
  chemically synthesized
ggctgggagcggtggctcacac

SEQ ID NO: 149737 - DNA, 22 bp, Artificial Sequence
  chemically synthesized
ggagcggtggctcacacctgca

SEQ ID NO: 149738 - DNA, 22 bp, Artificial Sequence
  chemically synthesized
acacctgcaattgcagcacttt

SEQ ID NO: 149739 - DNA, 22 bp, Artificial Sequence
  chemically synthesized
caattgcagcactttgggaggc

SEQ ID NO: 149740 - DNA, 22 bp, Artificial Sequence
  chemically synthesized
cagcactttgggaggcctagac

SEQ ID NO: 149741 - DNA, 22 bp, Artificial Sequence
  chemically synthesized
tgggaggcctagacaggcggat

SEQ ID NO: 149742 - DNA, 22 bp, Artificial Sequence
  chemically synthesized
gggaggcctagacaggcggatc

SEQ ID NO: 149743 - DNA, 22 bp, Artificial Sequence
  chemically synthesized
ggaggcctagacaggcggatca

SEQ ID NO: 149744 - DNA, 22 bp, Artificial Sequence
  chemically synthesized
gacaggcggatcacgacgtcag

SEQ ID NO: 149745 - DNA, 22 bp, Artificial Sequence
  chemically synthesized
aagatcagcctggccaacatag

SEQ ID NO: 149746 - DNA, 22 bp, Artificial Sequence
  chemically synthesized
gccaacatagtgaaacctcatc

SEQ ID NO: 149747 - DNA, 22 bp, Artificial Sequence
  chemically synthesized
atcgctactaaaaatataaaaa

SEQ ID NO: 149748 - DNA, 22 bp, Artificial Sequence
  chemically synthesized
ctaaaaatataaaaacttagcc

SEQ ID NO: 149749 - DNA, 22 bp, Artificial Sequence
  chemically synthesized
aaaatataaaaacttagcctgg

SEQ ID NO: 149750 - DNA, 22 bp, Artificial Sequence
  chemically synthesized
agcctggcgtggtggcaggcat

SEQ ID NO: 149751 - DNA, 22 bp, Artificial Sequence
  chemically synthesized
gcctggcgtggtggcaggcatg

SEQ ID NO: 149752 - DNA, 22 bp, Artificial Sequence
  chemically synthesized
gcgtggtggcaggcatgtgtaa

SEQ ID NO: 149753 - DNA, 22 bp, Artificial Sequence
  chemically synthesized
gggaggctgaggcaggagaatc

SEQ ID NO: 149754 - DNA, 22 bp, Artificial Sequence
  chemically synthesized
ggaggctgaggcaggagaatcg

SEQ ID NO: 149755 - DNA, 22 bp, Artificial Sequence
  chemically synthesized
aggcaggagaatcgcttgatcc

SEQ ID NO: 149756 - DNA, 22 bp, Artificial Sequence
  chemically synthesized
gatcctgggaggcagaggttgc

SEQ ID NO: 149757 - DNA, 22 bp, Artificial Sequence
  chemically synthesized
atcctgggaggcagaggttgca

SEQ ID NO: 149758 - DNA, 22 bp, Artificial Sequence
  chemically synthesized
ggaggcagaggttgcagtgagc

SEQ ID NO: 149759 - DNA, 22 bp, Artificial Sequence
  chemically synthesized
cagtgagccaagattgtgccac

SEQ ID NO: 149760 - DNA, 22 bp, Artificial Sequence
  chemically synthesized
tgccactgcattccagcccagg

SEQ ID NO: 149761 - DNA, 22 bp, Artificial Sequence
  chemically synthesized
cattccagcccaggtgacagca

SEQ ID NO: 149762 - DNA, 22 bp, Artificial Sequence
  chemically synthesized
cagcccaggtgacagcatgaga

SEQ ID NO: 149763 - DNA, 22 bp, Artificial Sequence
  chemically synthesized
cgtcacaaaaaaaaaagaaaaa

SEQ ID NO: 149764 - DNA, 22 bp, Artificial Sequence
  chemically synthesized
cagtctatagctcccatcgtga

SEQ ID NO: 149765 - DNA, 22 bp, Artificial Sequence
  chemically synthesized
tagctcccatcgtgagtgacgc

SEQ ID NO: 149766 - DNA, 22 bp, Artificial Sequence
  chemically synthesized
ccatcgtgagtgacgcagaaga

SEQ ID NO: 149767 - DNA, 22 bp, Artificial Sequence
  chemically synthesized
ctgcatttccaactgaggtacc

SEQ ID NO: 149768 - DNA, 22 bp, Artificial Sequence
  chemically synthesized
tgcatttccaactgaggtacca

SEQ ID NO: 149769 - DNA, 22 bp, Artificial Sequence
  chemically synthesized
catttccaactgaggtaccagg

SEQ ID NO: 149770 - DNA, 22 bp, Artificial Sequence
  chemically synthesized
ccaactgaggtaccaggttcat

SEQ ID NO: 149771 - DNA, 22 bp, Artificial Sequence
  chemically synthesized
caactgaggtaccaggttcatc

SEQ ID NO: 149772 - DNA, 22 bp, Artificial Sequence
  chemically synthesized
aggtaccaggttcatctcacag

SEQ ID NO: 149773 - DNA, 22 bp, Artificial Sequence
  chemically synthesized
atctcacagggaagtgccaggc

SEQ ID NO: 149774 - DNA, 22 bp, Artificial Sequence
  chemically synthesized
acagggaagtgccaggcagtgg

SEQ ID NO: 149775 - DNA, 22 bp, Artificial Sequence
  chemically synthesized
tgcatgagccaaagcagggcga

SEQ ID NO: 149776 - DNA, 22 bp, Artificial Sequence
  chemically synthesized
acccgggaagcacaaggggtca

SEQ ID NO: 149777 - DNA, 22 bp, Artificial Sequence
  chemically synthesized
cctttcctagtcaaagaaaagg

SEQ ID NO: 149778 - DNA, 22 bp, Artificial Sequence
  chemically synthesized
tcctagtcaaagaaaagggtga

SEQ ID NO: 149779 - DNA, 22 bp, Artificial Sequence
  chemically synthesized
cctagtcaaagaaaagggtgac

SEQ ID NO: 149780 - DNA, 22 bp, Artificial Sequence
  chemically synthesized
ctagtcaaagaaaagggtgaca

SEQ ID NO: 149781 - DNA, 22 bp, Artificial Sequence
  chemically synthesized
gtcaaagaaaagggtgacagat

SEQ ID NO: 149782 - DNA, 22 bp, Artificial Sequence
  chemically synthesized
gaaaatcgggtcactcccgccc

SEQ ID NO: 149783 - DNA, 22 bp, Artificial Sequence
  chemically synthesized
ccgccctaatactgcgctcttc

SEQ ID NO: 149784 - DNA, 22 bp, Artificial Sequence
  chemically synthesized
atactgcgctcttccaacaagc

SEQ ID NO: 149785 - DNA, 22 bp, Artificial Sequence
  chemically synthesized
cgctcttccaacaagcttaaca

SEQ ID NO: 149786 - DNA, 22 bp, Artificial Sequence
  chemically synthesized
ttccaacaagcttaacaaatgg

SEQ ID NO: 149787 - DNA, 22 bp, Artificial Sequence
  chemically synthesized
ccaacaagcttaacaaatggca

SEQ ID NO: 149788 - DNA, 22 bp, Artificial Sequence
  chemically synthesized
caacaagcttaacaaatggcac

SEQ ID NO: 149789 - DNA, 22 bp, Artificial Sequence
  chemically synthesized
aacaaatggcacaccaggagat

SEQ ID NO: 149790 - DNA, 22 bp, Artificial Sequence
  chemically synthesized
acaaatggcacaccaggagatt

SEQ ID NO: 149791 - DNA, 22 bp, Artificial Sequence
  chemically synthesized
tatcccatgcctggctcagagg

SEQ ID NO: 149792 - DNA, 22 bp, Artificial Sequence
  chemically synthesized
gctcagagggtcctacgcccat

SEQ ID NO: 149793 - DNA, 22 bp, Artificial Sequence
  chemically synthesized
agagggtcctacgcccatggag

SEQ ID NO: 149794 - DNA, 22 bp, Artificial Sequence
  chemically synthesized
cgcccatggagcctcgctcatt

SEQ ID NO: 149795 - DNA, 22 bp, Artificial Sequence
  chemically synthesized
gctcattgctagcacagcagtc

SEQ ID NO: 149796 - DNA, 22 bp, Artificial Sequence
  chemically synthesized
attgctagcacagcagtctgag

SEQ ID NO: 149797 - DNA, 22 bp, Artificial Sequence
  chemically synthesized
ctagcacagcagtctgaggtca

SEQ ID NO: 149798 - DNA, 22 bp, Artificial Sequence
  chemically synthesized
gcacagcagtctgaggtcaaac

SEQ ID NO: 149799 - DNA, 22 bp, Artificial Sequence
  chemically synthesized
aggtcaaactgcaaggtggcag

SEQ ID NO: 149800 - DNA, 22 bp, Artificial Sequence
  chemically synthesized
caaggtggcagtgaggctgggg

SEQ ID NO: 149801 - DNA, 22 bp, Artificial Sequence
  chemically synthesized
ggggaggggtgcccaccattgt

SEQ ID NO: 149802 - DNA, 22 bp, Artificial Sequence
  chemically synthesized
tccaggcttgagcaggtaaaca

SEQ ID NO: 149803 - DNA, 22 bp, Artificial Sequence
  chemically synthesized
gagcaggtaaacaaagccgcct

SEQ ID NO: 149804 - DNA, 22 bp, Artificial Sequence
  chemically synthesized
agcaggtaaacaaagccgcctg

SEQ ID NO: 149805 - DNA, 22 bp, Artificial Sequence
  chemically synthesized
gaagctcgaactgggtggagcc

SEQ ID NO: 149806 - DNA, 22 bp, Artificial Sequence
  chemically synthesized
gaactgggtggagcccaccaca

SEQ ID NO: 149807 - DNA, 22 bp, Artificial Sequence
  chemically synthesized
ggtggagcccaccacagctcaa

SEQ ID NO: 149808 - DNA, 22 bp, Artificial Sequence
  chemically synthesized
aaggaggcctgcctgcctctgt

SEQ ID NO: 149809 - DNA, 22 bp, Artificial Sequence
  chemically synthesized
cctgcctctgtaggctccacct

SEQ ID NO: 149810 - DNA, 22 bp, Artificial Sequence
  chemically synthesized
cctctgtaggctccacctctag

SEQ ID NO: 149811 - DNA, 22 bp, Artificial Sequence
  chemically synthesized
tgtaggctccacctctaggggc

SEQ ID NO: 149812 - DNA, 22 bp, Artificial Sequence
  chemically synthesized
taggctccacctctaggggcag

SEQ ID NO: 149813 - DNA, 22 bp, Artificial Sequence
  chemically synthesized
cacctctaggggcagggcacag

SEQ ID NO: 149814 - DNA, 22 bp, Artificial Sequence
  chemically synthesized
taggggcagggcacagacaaac

SEQ ID NO: 149815 - DNA, 22 bp, Artificial Sequence
  chemically synthesized
ggggcagggcacagacaaacaa

SEQ ID NO: 149816 - DNA, 22 bp, Artificial Sequence
  chemically synthesized
tgcagacttaaatgtccctgtc

SEQ ID NO: 149817 - DNA, 22 bp, Artificial Sequence
  chemically synthesized
cagacttaaatgtccctgtctg

SEQ ID NO: 149818 - DNA, 22 bp, Artificial Sequence
  chemically synthesized
aaatgtccctgtctgacagctt

SEQ ID NO: 149819 - DNA, 22 bp, Artificial Sequence
  chemically synthesized
aatgtccctgtctgacagcttt

SEQ ID NO: 149820 - DNA, 22 bp, Artificial Sequence
  chemically synthesized
tctgacagctttgaagagagta

SEQ ID NO: 149821 - DNA, 22 bp, Artificial Sequence
  chemically synthesized
acagctttgaagagagtagtgg

SEQ ID NO: 149822 - DNA, 22 bp, Artificial Sequence
  chemically synthesized
tgaagagagtagtggttctccc

SEQ ID NO: 149823 - DNA, 22 bp, Artificial Sequence
  chemically synthesized
gaagagagtagtggttctccca

SEQ ID NO: 149824 - DNA, 22 bp, Artificial Sequence
  chemically synthesized
aagagagtagtggttctcccag

SEQ ID NO: 149825 - DNA, 22 bp, Artificial Sequence
  chemically synthesized
tcccagcacatagcttcagatc

SEQ ID NO: 149826 - DNA, 22 bp, Artificial Sequence
  chemically synthesized
ccagcacatagcttcagatctg

SEQ ID NO: 149827 - DNA, 22 bp, Artificial Sequence
  chemically synthesized
cagatctgagaacaggcagact

SEQ ID NO: 149828 - DNA, 22 bp, Artificial Sequence
  chemically synthesized
agatctgagaacaggcagactg

SEQ ID NO: 149829 - DNA, 22 bp, Artificial Sequence
  chemically synthesized
agaacaggcagactgcctcctc

SEQ ID NO: 149830 - DNA, 22 bp, Artificial Sequence
  chemically synthesized
cctcctcaagtgggtccctgac

SEQ ID NO: 149831 - DNA, 22 bp, Artificial Sequence
  chemically synthesized
ctcaagtgggtccctgaccccc

SEQ ID NO: 149832 - DNA, 22 bp, Artificial Sequence
  chemically synthesized
aagtgggtccctgacccccgag

SEQ ID NO: 149833 - DNA, 22 bp, Artificial Sequence
  chemically synthesized
acccccgagtagcctaactggg

SEQ ID NO: 149834 - DNA, 22 bp, Artificial Sequence
  chemically synthesized
actgggaggcatcccccagtag

SEQ ID NO: 149835 - DNA, 22 bp, Artificial Sequence
  chemically synthesized
ggaggcatcccccagtaggggc

SEQ ID NO: 149836 - DNA, 22 bp, Artificial Sequence
  chemically synthesized
acacctcacatggctggtactc

SEQ ID NO: 149837 - DNA, 22 bp, Artificial Sequence
  chemically synthesized
acatggctggtactcctctaag

SEQ ID NO: 149838 - DNA, 22 bp, Artificial Sequence
  chemically synthesized
gtactcctctaagacaaaactt

SEQ ID NO: 149839 - DNA, 22 bp, Artificial Sequence
  chemically synthesized
ctctaagacaaaacttccagag

SEQ ID NO: 149840 - DNA, 22 bp, Artificial Sequence
  chemically synthesized
taagacaaaacttccagaggaa

SEQ ID NO: 149841 - DNA, 22 bp, Artificial Sequence
  chemically synthesized
agacaaaacttccagaggaatg

SEQ ID NO: 149842 - DNA, 22 bp, Artificial Sequence
  chemically synthesized
ccagaggaatgatcaggcagca

SEQ ID NO: 149843 - DNA, 22 bp, Artificial Sequence
  chemically synthesized
cagaggaatgatcaggcagcag

SEQ ID NO: 149844 - DNA, 22 bp, Artificial Sequence
  chemically synthesized
gcggttcaccaatatccactgt

SEQ ID NO: 149845 - DNA, 22 bp, Artificial Sequence
  chemically synthesized
cggttcaccaatatccactgtt

SEQ ID NO: 149846 - DNA, 22 bp, Artificial Sequence
  chemically synthesized
accaatatccactgttctgcag

SEQ ID NO: 149847 - DNA, 22 bp, Artificial Sequence
  chemically synthesized
ttctgcagccaccgctgttgat

SEQ ID NO: 149848 - DNA, 22 bp, Artificial Sequence
  chemically synthesized
tgcagccaccgctgttgatacc

SEQ ID NO: 149849 - DNA, 22 bp, Artificial Sequence
  chemically synthesized
cagccaccgctgttgataccca

SEQ ID NO: 149850 - DNA, 22 bp, Artificial Sequence
  chemically synthesized
ttgatacccaggaaaacagctt

SEQ ID NO: 149851 - DNA, 22 bp, Artificial Sequence
  chemically synthesized
atacccaggaaaacagcttctg

SEQ ID NO: 149852 - DNA, 22 bp, Artificial Sequence
  chemically synthesized
ctggagtggacctccagtaaac

SEQ ID NO: 149853 - DNA, 22 bp, Artificial Sequence
  chemically synthesized
tggagtggacctccagtaaact

SEQ ID NO: 149854 - DNA, 22 bp, Artificial Sequence
  chemically synthesized
gagtggacctccagtaaactcc

SEQ ID NO: 149855 - DNA, 22 bp, Artificial Sequence
  chemically synthesized
cagtaaactccaacagacctgc

SEQ ID NO: 149856 - DNA, 22 bp, Artificial Sequence
  chemically synthesized
caacagacctgcagctgagggt

SEQ ID NO: 149857 - DNA, 22 bp, Artificial Sequence
  chemically synthesized
cagctgagggtcctgactgtta

SEQ ID NO: 149858 - DNA, 22 bp, Artificial Sequence
  chemically synthesized
agggtcctgactgttagaagga

SEQ ID NO: 149859 - DNA, 22 bp, Artificial Sequence
  chemically synthesized
actgttagaaggaaaactaaca

SEQ ID NO: 149860 - DNA, 22 bp, Artificial Sequence
  chemically synthesized
ttagaaggaaaactaacaaaca

SEQ ID NO: 149861 - DNA, 22 bp, Artificial Sequence
  chemically synthesized
gaaggaaaactaacaaacagaa

SEQ ID NO: 149862 - DNA, 22 bp, Artificial Sequence
  chemically synthesized
acaaacagaaaggacatccaca

SEQ ID NO: 149863 - DNA, 22 bp, Artificial Sequence
  chemically synthesized
tacatcgccatcatcaaagacc

SEQ ID NO: 149864 - DNA, 22 bp, Artificial Sequence
  chemically synthesized
gacactctaaaaatgagagtgc

SEQ ID NO: 149865 - DNA, 22 bp, Artificial Sequence
  chemically synthesized
taaaaatgagagtgcctctcct

SEQ ID NO: 149866 - DNA, 22 bp, Artificial Sequence
  chemically synthesized
aaaatgagagtgcctctcctcc

SEQ ID NO: 149867 - DNA, 22 bp, Artificial Sequence
  chemically synthesized
tcctcctccaaagtaacgcagc

SEQ ID NO: 149868 - DNA, 22 bp, Artificial Sequence
  chemically synthesized
ctcctccaaagtaacgcagctc

SEQ ID NO: 149869 - DNA, 22 bp, Artificial Sequence
  chemically synthesized
ctccaaagtaacgcagctcctc

SEQ ID NO: 149870 - DNA, 22 bp, Artificial Sequence
  chemically synthesized
caaagtaacgcagctcctcacc

SEQ ID NO: 149871 - DNA, 22 bp, Artificial Sequence
  chemically synthesized
ctcaccagcaatggaacaaagc

SEQ ID NO: 149872 - DNA, 22 bp, Artificial Sequence
  chemically synthesized
accagcaatggaacaaagctgg

SEQ ID NO: 149873 - DNA, 22 bp, Artificial Sequence
  chemically synthesized
ggcagagaatgactttgacgag

SEQ ID NO: 149874 - DNA, 22 bp, Artificial Sequence
  chemically synthesized
tgacgagttgagagaggaaggc

SEQ ID NO: 149875 - DNA, 22 bp, Artificial Sequence
  chemically synthesized
gacgagttgagagaggaaggct

SEQ ID NO: 149876 - DNA, 22 bp, Artificial Sequence
  chemically synthesized
acgagttgagagaggaaggctt

SEQ ID NO: 149877 - DNA, 22 bp, Artificial Sequence
  chemically synthesized
agagaggaaggcttcagaagat

SEQ ID NO: 149878 - DNA, 22 bp, Artificial Sequence
  chemically synthesized
cagaagatcaaactactccaag

SEQ ID NO: 149879 - DNA, 22 bp, Artificial Sequence
  chemically synthesized
agaagatcaaactactccaagc

SEQ ID NO: 149880 - DNA, 22 bp, Artificial Sequence
  chemically synthesized
ctccaagctaaaggaggaagtt

SEQ ID NO: 149881 - DNA, 22 bp, Artificial Sequence
  chemically synthesized
caagctaaaggaggaagttcga

SEQ ID NO: 149882 - DNA, 22 bp, Artificial Sequence
  chemically synthesized
aaggaggaagttcgaacaaacg

SEQ ID NO: 149883 - DNA, 22 bp, Artificial Sequence
  chemically synthesized
gaacaaacggcaaagaagtaaa

SEQ ID NO: 149884 - DNA, 22 bp, Artificial Sequence
  chemically synthesized
tgaaaaaaaattagatgaatgg

SEQ ID NO: 149885 - DNA, 22 bp, Artificial Sequence
  chemically synthesized
gaaaaaaaattagatgaatgga

SEQ ID NO: 149886 - DNA, 22 bp, Artificial Sequence
  chemically synthesized
aaaaaaaattagatgaatggat

SEQ ID NO: 149887 - DNA, 22 bp, Artificial Sequence
  chemically synthesized
gatgaatggataactagaataa

SEQ ID NO: 149888 - DNA, 22 bp, Artificial Sequence
  chemically synthesized
gaataaccaatgcacagaagtc

SEQ ID NO: 149889 - DNA, 22 bp, Artificial Sequence
  chemically synthesized
aaaggacctgatggagctgaaa

SEQ ID NO: 149890 - DNA, 22 bp, Artificial Sequence
  chemically synthesized
aaggacctgatggagctgaaaa

SEQ ID NO: 149891 - DNA, 22 bp, Artificial Sequence
  chemically synthesized
atggagctgaaaaccaaggcag

SEQ ID NO: 149892 - DNA, 22 bp, Artificial Sequence
  chemically synthesized
aaaaccaaggcaggagaactac

SEQ ID NO: 149893 - DNA, 22 bp, Artificial Sequence
  chemically synthesized
cgtgacaaatacacaagcctca

SEQ ID NO: 149894 - DNA, 22 bp, Artificial Sequence
  chemically synthesized
agtaaccgatgagatcaactgg

SEQ ID NO: 149895 - DNA, 22 bp, Artificial Sequence
  chemically synthesized
gaagaaagggtatcaatgacga

SEQ ID NO: 149896 - DNA, 22 bp, Artificial Sequence
  chemically synthesized
agagaaaaaagaataaaaagaa

SEQ ID NO: 149897 - DNA, 22 bp, Artificial Sequence
  chemically synthesized
gagaaaaaagaataaaaagaaa

SEQ ID NO: 149898 - DNA, 22 bp, Artificial Sequence
  chemically synthesized
caagaaatatgggactatgtga

SEQ ID NO: 149899 - DNA, 22 bp, Artificial Sequence
  chemically synthesized
tgtgaaaagaccaaatctacat

SEQ ID NO: 149900 - DNA, 22 bp, Artificial Sequence
  chemically synthesized
catctaattggtgtagctgaaa

SEQ ID NO: 149901 - DNA, 22 bp, Artificial Sequence
  chemically synthesized
attggtgtagctgaaagtgatg

SEQ ID NO: 149902 - DNA, 22 bp, Artificial Sequence
  chemically synthesized
gtgtagctgaaagtgatgggga

SEQ ID NO: 149903 - DNA, 22 bp, Artificial Sequence
  chemically synthesized
aaagtgatggggagaatggaac

SEQ ID NO: 149904 - DNA, 22 bp, Artificial Sequence
  chemically synthesized
gaaaacactctgcaggatatta

SEQ ID NO: 149905 - DNA, 22 bp, Artificial Sequence
  chemically synthesized
tgcaggatattatccaggagaa

SEQ ID NO: 149906 - DNA, 22 bp, Artificial Sequence
  chemically synthesized
caggatattatccaggagaact

SEQ ID NO: 149907 - DNA, 22 bp, Artificial Sequence
  chemically synthesized
tccaggagaacttccccaatct

SEQ ID NO: 149908 - DNA, 22 bp, Artificial Sequence
  chemically synthesized
ccccaatctagcaaggcaagcc

SEQ ID NO: 149909 - DNA, 22 bp, Artificial Sequence
  chemically synthesized
cccaatctagcaaggcaagccc

SEQ ID NO: 149910 - DNA, 22 bp, Artificial Sequence
  chemically synthesized
gcaaggcaagcccaaattcaca

SEQ ID NO: 149911 - DNA, 22 bp, Artificial Sequence
  chemically synthesized
acattcaggaaatacagagaac

SEQ ID NO: 149912 - DNA, 22 bp, Artificial Sequence
  chemically synthesized
aggaaatacagagaacgccaca

SEQ ID NO: 149913 - DNA, 22 bp, Artificial Sequence
  chemically synthesized
ctagagaaaagcaactccaaga

SEQ ID NO: 149914 - DNA, 22 bp, Artificial Sequence
  chemically synthesized
gagaaaagcaactccaagacac

SEQ ID NO: 149915 - DNA, 22 bp, Artificial Sequence
  chemically synthesized
caagacacataactgtcagatt

SEQ ID NO: 149916 - DNA, 22 bp, Artificial Sequence
  chemically synthesized
tcagattcaccaaagttgaaat

SEQ ID NO: 149917 - DNA, 22 bp, Artificial Sequence
  chemically synthesized
accaaagttgaaatgaaggaaa

SEQ ID NO: 149918 - DNA, 22 bp, Artificial Sequence
  chemically synthesized
aaatgaaggaaaaaatgttaag

SEQ ID NO: 149919 - DNA, 22 bp, Artificial Sequence
  chemically synthesized
agggcagccagagagaaaggtc

SEQ ID NO: 149920 - DNA, 22 bp, Artificial Sequence
  chemically synthesized
cccacaaagggaagcccatcag

SEQ ID NO: 149921 - DNA, 22 bp, Artificial Sequence
  chemically synthesized
acagctgatctatcggcagaaa

SEQ ID NO: 149922 - DNA, 22 bp, Artificial Sequence
  chemically synthesized
atctatcggcagaaactctaca

SEQ ID NO: 149923 - DNA, 22 bp, Artificial Sequence
  chemically synthesized
tcggcagaaactctacaagcca

SEQ ID NO: 149924 - DNA, 22 bp, Artificial Sequence
  chemically synthesized
tacaagccagaagaaagtgggg

SEQ ID NO: 149925 - DNA, 22 bp, Artificial Sequence
  chemically synthesized
caagccagaagaaagtgggggc

SEQ ID NO: 149926 - DNA, 22 bp, Artificial Sequence
  chemically synthesized
aacattgttaaagaaaagaatt

SEQ ID NO: 149927 - DNA, 22 bp, Artificial Sequence
  chemically synthesized
ttaaagaaaagaattttcaacc

SEQ ID NO: 149928 - DNA, 22 bp, Artificial Sequence
  chemically synthesized
aagaaaagaattttcaacccag

SEQ ID NO: 149929 - DNA, 22 bp, Artificial Sequence
  chemically synthesized
tcaacccagaatttcatatcca

SEQ ID NO: 149930 - DNA, 22 bp, Artificial Sequence
  chemically synthesized
caacccagaatttcatatccag

SEQ ID NO: 149931 - DNA, 22 bp, Artificial Sequence
  chemically synthesized
aacccagaatttcatatccagc

SEQ ID NO: 149932 - DNA, 22 bp, Artificial Sequence
  chemically synthesized
catatccagccaaactaagctt

SEQ ID NO: 149933 - DNA, 22 bp, Artificial Sequence
  chemically synthesized
atatccagccaaactaagcttc

SEQ ID NO: 149934 - DNA, 22 bp, Artificial Sequence
  chemically synthesized
agcttcataagtgaaggagaaa

SEQ ID NO: 149935 - DNA, 22 bp, Artificial Sequence
  chemically synthesized
cataagtgaaggagaaataaaa

SEQ ID NO: 149936 - DNA, 22 bp, Artificial Sequence
  chemically synthesized
ataagtgaaggagaaataaaat

SEQ ID NO: 149937 - DNA, 22 bp, Artificial Sequence
  chemically synthesized
tacagacaagcaaatgctgaga

SEQ ID NO: 149938 - DNA, 22 bp, Artificial Sequence
  chemically synthesized
acagacaagcaaatgctgagag

SEQ ID NO: 149939 - DNA, 22 bp, Artificial Sequence
  chemically synthesized
cagacaagcaaatgctgagaga

SEQ ID NO: 149940 - DNA, 22 bp, Artificial Sequence
  chemically synthesized
agagattttgtcaccaccaggc

SEQ ID NO: 149941 - DNA, 22 bp, Artificial Sequence
  chemically synthesized
tgtcaccaccaggcctgcccta

SEQ ID NO: 149942 - DNA, 22 bp, Artificial Sequence
  chemically synthesized
gtcaccaccaggcctgccctac

SEQ ID NO: 149943 - DNA, 22 bp, Artificial Sequence
  chemically synthesized
tcaccaccaggcctgccctaca

SEQ ID NO: 149944 - DNA, 22 bp, Artificial Sequence
  chemically synthesized
ccctacaagagctcctgaagga

SEQ ID NO: 149945 - DNA, 22 bp, Artificial Sequence
  chemically synthesized
caagagctcctgaaggaagcac

SEQ ID NO: 149946 - DNA, 22 bp, Artificial Sequence
  chemically synthesized
ctgaaggaagcactaaacatgg

SEQ ID NO: 149947 - DNA, 22 bp, Artificial Sequence
  chemically synthesized
aaggaagcactaaacatggaaa

SEQ ID NO: 149948 - DNA, 22 bp, Artificial Sequence
  chemically synthesized
aacatggaaaggaacaactagt

SEQ ID NO: 149949 - DNA, 22 bp, Artificial Sequence
  chemically synthesized
gtatcagccactgcaaaaacat

SEQ ID NO: 149950 - DNA, 22 bp, Artificial Sequence
  chemically synthesized
caaaaacatgccaaattgtaaa

SEQ ID NO: 149951 - DNA, 22 bp, Artificial Sequence
  chemically synthesized
taaagaccatcaaggctaggaa

SEQ ID NO: 149952 - DNA, 22 bp, Artificial Sequence
  chemically synthesized
ggaagaaactgcatcaacgagc

SEQ ID NO: 149953 - DNA, 22 bp, Artificial Sequence
  chemically synthesized
catcaacgagcaaaataaccag

SEQ ID NO: 149954 - DNA, 22 bp, Artificial Sequence
  chemically synthesized
acatcataatgacaggatcaaa

SEQ ID NO: 149955 - DNA, 22 bp, Artificial Sequence
  chemically synthesized
atacataacaatactcacctta

SEQ ID NO: 149956 - DNA, 22 bp, Artificial Sequence
  chemically synthesized
accttaaatgtaaataggctaa

SEQ ID NO: 149957 - DNA, 22 bp, Artificial Sequence
  chemically synthesized
aaatgtaaataggctaaatgct

SEQ ID NO: 149958 - DNA, 22 bp, Artificial Sequence
  chemically synthesized
aatgtaaataggctaaatgctc

SEQ ID NO: 149959 - DNA, 22 bp, Artificial Sequence
  chemically synthesized
aatgctccaattaaaagacaca

SEQ ID NO: 149960 - DNA, 22 bp, Artificial Sequence
  chemically synthesized
caattaaaagacacagactggc

SEQ ID NO: 149961 - DNA, 22 bp, Artificial Sequence
  chemically synthesized
aaagacacagactggcaaattg

SEQ ID NO: 149962 - DNA, 22 bp, Artificial Sequence
  chemically synthesized
gcaaattggataaggagtcaag

SEQ ID NO: 149963 - DNA, 22 bp, Artificial Sequence
  chemically synthesized
gataaggagtcaagacccatct

SEQ ID NO: 149964 - DNA, 22 bp, Artificial Sequence
  chemically synthesized
tgttctgtattcaggaaaccca

SEQ ID NO: 149965 - DNA, 22 bp, Artificial Sequence
  chemically synthesized
tgtattcaggaaacccatctca

SEQ ID NO: 149966 - DNA, 22 bp, Artificial Sequence
  chemically synthesized
tattcaggaaacccatctcacg

SEQ ID NO: 149967 - DNA, 22 bp, Artificial Sequence
  chemically synthesized
aggaaacccatctcacgtgcag

SEQ ID NO: 149968 - DNA, 22 bp, Artificial Sequence
  chemically synthesized
acgtgcagagacacacataggc

SEQ ID NO: 149969 - DNA, 22 bp, Artificial Sequence
  chemically synthesized
gaaataaaaggatggaggaata

SEQ ID NO: 149970 - DNA, 22 bp, Artificial Sequence
  chemically synthesized
ccaagcaaatggaaaacaaaaa

SEQ ID NO: 149971 - DNA, 22 bp, Artificial Sequence
  chemically synthesized
caatcctagtctctgataaaac

SEQ ID NO: 149972 - DNA, 22 bp, Artificial Sequence
  chemically synthesized
gtctctgataaaacagatttta

SEQ ID NO: 149973 - DNA, 22 bp, Artificial Sequence
  chemically synthesized
tgataaaacagattttaaacca

SEQ ID NO: 149974 - DNA, 22 bp, Artificial Sequence
  chemically synthesized
ataaaacagattttaaaccaac

SEQ ID NO: 149975 - DNA, 22 bp, Artificial Sequence
  chemically synthesized
taaaccaacaaagatcaaaaga

SEQ ID NO: 149976 - DNA, 22 bp, Artificial Sequence
  chemically synthesized
aaaccaacaaagatcaaaagag

SEQ ID NO: 149977 - DNA, 22 bp, Artificial Sequence
  chemically synthesized
aaccaacaaagatcaaaagaga

SEQ ID NO: 149978 - DNA, 22 bp, Artificial Sequence
  chemically synthesized
cataatggcaaagggatctatt

SEQ ID NO: 149979 - DNA, 22 bp, Artificial Sequence
  chemically synthesized
ttcaagaagaagaactaactat

SEQ ID NO: 149980 - DNA, 22 bp, Artificial Sequence
  chemically synthesized
aagaagaagaactaactatact

SEQ ID NO: 149981 - DNA, 22 bp, Artificial Sequence
  chemically synthesized
actatactaaatatatatgcac

SEQ ID NO: 149982 - DNA, 22 bp, Artificial Sequence
  chemically synthesized
tactaaatatatatgcacccaa

SEQ ID NO: 149983 - DNA, 22 bp, Artificial Sequence
  chemically synthesized
aatatatatgcacccaatacag

SEQ ID NO: 149984 - DNA, 22 bp, Artificial Sequence
  chemically synthesized
ataaaacaagtcctgagtgacc

SEQ ID NO: 149985 - DNA, 22 bp, Artificial Sequence
  chemically synthesized
agtgacctacaaagagacttag

SEQ ID NO: 149986 - DNA, 22 bp, Artificial Sequence
  chemically synthesized
caaagagacttagatgcccaca

SEQ ID NO: 149987 - DNA, 22 bp, Artificial Sequence
  chemically synthesized
agatgcccacacaataataatg

SEQ ID NO: 149988 - DNA, 22 bp, Artificial Sequence
  chemically synthesized
gatgcccacacaataataatgg

SEQ ID NO: 149989 - DNA, 22 bp, Artificial Sequence
  chemically synthesized
taacaccccactgtcaacatta

SEQ ID NO: 149990 - DNA, 22 bp, Artificial Sequence
  chemically synthesized
aacaccccactgtcaacattag

SEQ ID NO: 149991 - DNA, 22 bp, Artificial Sequence
  chemically synthesized
acaccccactgtcaacattaga

SEQ ID NO: 149992 - DNA, 22 bp, Artificial Sequence
  chemically synthesized
tcaacattagacagatcaacga

SEQ ID NO: 149993 - DNA, 22 bp, Artificial Sequence
  chemically synthesized
gacagatcaacgagacagaaag

SEQ ID NO: 149994 - DNA, 22 bp, Artificial Sequence
  chemically synthesized
acaaggatatccaggaattgga

SEQ ID NO: 149995 - DNA, 22 bp, Artificial Sequence
  chemically synthesized
gactcagctctgcaccaagcag

SEQ ID NO: 149996 - DNA, 22 bp, Artificial Sequence
  chemically synthesized
agctctgcaccaagcagaccta

SEQ ID NO: 149997 - DNA, 22 bp, Artificial Sequence
  chemically synthesized
tgcaccaagcagacctaataga

SEQ ID NO: 149998 - DNA, 22 bp, Artificial Sequence
  chemically synthesized
caccaagcagacctaatagaca

SEQ ID NO: 149999 - DNA, 22 bp, Artificial Sequence
  chemically synthesized
atagacatctacagaactctcc

SEQ ID NO: 150000 - DNA, 22 bp, Artificial Sequence
  chemically synthesized
cagaactctccaccccaaatca

SEQ ID NO: 150001 - DNA, 22 bp, Artificial Sequence
  chemically synthesized
tccaccccaaatcaacagaata

SEQ ID NO: 150002 - DNA, 22 bp, Artificial Sequence
  chemically synthesized
caccccaaatcaacagaatata

SEQ ID NO: 150003 - DNA, 22 bp, Artificial Sequence
  chemically synthesized
ttttcagcaccacaccacacct

SEQ ID NO: 150004 - DNA, 22 bp, Artificial Sequence
  chemically synthesized
ttcagcaccacaccacacctat

SEQ ID NO: 150005 - DNA, 22 bp, Artificial Sequence
  chemically synthesized
tcagcaccacaccacacctatt

SEQ ID NO: 150006 - DNA, 22 bp, Artificial Sequence
  chemically synthesized
cagcaccacaccacacctattc

SEQ ID NO: 150007 - DNA, 22 bp, Artificial Sequence
  chemically synthesized
agcaccacaccacacctattcc

SEQ ID NO: 150008 - DNA, 22 bp, Artificial Sequence
  chemically synthesized
ttccaaaactgaccacatagtt

SEQ ID NO: 150009 - DNA, 22 bp, Artificial Sequence
  chemically synthesized
caaaactgaccacatagttgga

SEQ ID NO: 150010 - DNA, 22 bp, Artificial Sequence
  chemically synthesized
accacatagttggaagtaaagc

SEQ ID NO: 150011 - DNA, 22 bp, Artificial Sequence
  chemically synthesized
gaagtaaagctctcctcagcaa

SEQ ID NO: 150012 - DNA, 22 bp, Artificial Sequence
  chemically synthesized
tcctcagcaaatgtaaaagaac

SEQ ID NO: 150013 - DNA, 22 bp, Artificial Sequence
  chemically synthesized
ctcagcaaatgtaaaagaacag

SEQ ID NO: 150014 - DNA, 22 bp, Artificial Sequence
  chemically synthesized
agcaaatgtaaaagaacagaaa

SEQ ID NO: 150015 - DNA, 22 bp, Artificial Sequence
  chemically synthesized
taacaaactgtctctcagacca

SEQ ID NO: 150016 - DNA, 22 bp, Artificial Sequence
  chemically synthesized
tctctcagaccacagtgcaatc

SEQ ID NO: 150017 - DNA, 22 bp, Artificial Sequence
  chemically synthesized
tcagaccacagtgcaatcaaac

SEQ ID NO: 150018 - DNA, 22 bp, Artificial Sequence
  chemically synthesized
agaccacagtgcaatcaaacta

SEQ ID NO: 150019 - DNA, 22 bp, Artificial Sequence
  chemically synthesized
gaactcaggattaagaaactca

SEQ ID NO: 150020 - DNA, 22 bp, Artificial Sequence
  chemically synthesized
aggattaagaaactcactcaaa

SEQ ID NO: 150021 - DNA, 22 bp, Artificial Sequence
  chemically synthesized
agaaactcactcaaaaccactc

SEQ ID NO: 150022 - DNA, 22 bp, Artificial Sequence
  chemically synthesized
actcaaaaccactcagctacat

SEQ ID NO: 150023 - DNA, 22 bp, Artificial Sequence
  chemically synthesized
aaaaccactcagctacatggaa

SEQ ID NO: 150024 - DNA, 22 bp, Artificial Sequence
  chemically synthesized
agctacatggaaactgaacagc

SEQ ID NO: 150025 - DNA, 22 bp, Artificial Sequence
  chemically synthesized
catggaaactgaacagcctgct

SEQ ID NO: 150026 - DNA, 22 bp, Artificial Sequence
  chemically synthesized
aacagcctgctcctgaatgact

SEQ ID NO: 150027 - DNA, 22 bp, Artificial Sequence
  chemically synthesized
ctcctgaatgactactgggtac

SEQ ID NO: 150028 - DNA, 22 bp, Artificial Sequence
  chemically synthesized
ctgaatgactactgggtacata

SEQ ID NO: 150029 - DNA, 22 bp, Artificial Sequence
  chemically synthesized
aatgactactgggtacataaca

SEQ ID NO: 150030 - DNA, 22 bp, Artificial Sequence
  chemically synthesized
ctgggtacataacaaaatgaag

SEQ ID NO: 150031 - DNA, 22 bp, Artificial Sequence
  chemically synthesized
ggtacataacaaaatgaaggca

SEQ ID NO: 150032 - DNA, 22 bp, Artificial Sequence
  chemically synthesized
tttgaaaccaacgagaacaaag

SEQ ID NO: 150033 - DNA, 22 bp, Artificial Sequence
  chemically synthesized
tgaaaccaacgagaacaaagac

SEQ ID NO: 150034 - DNA, 22 bp, Artificial Sequence
  chemically synthesized
gaaaccaacgagaacaaagaca

SEQ ID NO: 150035 - DNA, 22 bp, Artificial Sequence
  chemically synthesized
aaaccaacgagaacaaagacac

SEQ ID NO: 150036 - DNA, 22 bp, Artificial Sequence
  chemically synthesized
tgagacacattcaaagcagtgt

SEQ ID NO: 150037 - DNA, 22 bp, Artificial Sequence
  chemically synthesized
agacacattcaaagcagtgtgt

SEQ ID NO: 150038 - DNA, 22 bp, Artificial Sequence
  chemically synthesized
aaagcagtgtgtagagggaaat

SEQ ID NO: 150039 - DNA, 22 bp, Artificial Sequence
  chemically synthesized
atagcactaaatgcccacaagg

SEQ ID NO: 150040 - DNA, 22 bp, Artificial Sequence
  chemically synthesized
tagcactaaatgcccacaaggg

SEQ ID NO: 150041 - DNA, 22 bp, Artificial Sequence
  chemically synthesized
aatgcccacaagggaaagcagg

SEQ ID NO: 150042 - DNA, 22 bp, Artificial Sequence
  chemically synthesized
aaattgacaccctaacatcaca

SEQ ID NO: 150043 - DNA, 22 bp, Artificial Sequence
  chemically synthesized
acaccctaacatcacaattaaa

SEQ ID NO: 150044 - DNA, 22 bp, Artificial Sequence
  chemically synthesized
acatcacaattaaaaaactaga

SEQ ID NO: 150045 - DNA, 22 bp, Artificial Sequence
  chemically synthesized
aaaaactagagaagcaggagca

SEQ ID NO: 150046 - DNA, 22 bp, Artificial Sequence
  chemically synthesized
gagaagcaggagcaaacacatt

SEQ ID NO: 150047 - DNA, 22 bp, Artificial Sequence
  chemically synthesized
aaaagctaacagaagacaagaa

SEQ ID NO: 150048 - DNA, 22 bp, Artificial Sequence
  chemically synthesized
acagaagacaagaaataactaa

SEQ ID NO: 150049 - DNA, 22 bp, Artificial Sequence
  chemically synthesized
agatcagagcagaagtgaagga

SEQ ID NO: 150050 - DNA, 22 bp, Artificial Sequence
  chemically synthesized
caaaaaaatcaatgaatccaga

SEQ ID NO: 150051 - DNA, 22 bp, Artificial Sequence
  chemically synthesized
aaaaaaatcaatgaatccagaa

SEQ ID NO: 150052 - DNA, 22 bp, Artificial Sequence
  chemically synthesized
tttttttgaaaagatcaacaaa

SEQ ID NO: 150053 - DNA, 22 bp, Artificial Sequence
  chemically synthesized
ttttgaaaagatcaacaaaatt

SEQ ID NO: 150054 - DNA, 22 bp, Artificial Sequence
  chemically synthesized
tttgaaaagatcaacaaaattg

SEQ ID NO: 150055 - DNA, 22 bp, Artificial Sequence
  chemically synthesized
ttgaaaagatcaacaaaattga

SEQ ID NO: 150056 - DNA, 22 bp, Artificial Sequence
  chemically synthesized
tgaaaagatcaacaaaattgat

SEQ ID NO: 150057 - DNA, 22 bp, Artificial Sequence
  chemically synthesized
gaaaagatcaacaaaattgata

SEQ ID NO: 150058 - DNA, 22 bp, Artificial Sequence
  chemically synthesized
aaaagatcaacaaaattgatag

SEQ ID NO: 150059 - DNA, 22 bp, Artificial Sequence
  chemically synthesized
atagactgctagcaagactaat

SEQ ID NO: 150060 - DNA, 22 bp, Artificial Sequence
  chemically synthesized
ctagcaagactaataaagaaga

SEQ ID NO: 150061 - DNA, 22 bp, Artificial Sequence
  chemically synthesized
gcaagactaataaagaagaaaa

SEQ ID NO: 150062 - DNA, 22 bp, Artificial Sequence
  chemically synthesized
ataaagaagaaaagagagaaga

SEQ ID NO: 150063 - DNA, 22 bp, Artificial Sequence
  chemically synthesized
atcccacagaaatacaaactac

SEQ ID NO: 150064 - DNA, 22 bp, Artificial Sequence
  chemically synthesized
ccgtcagagaatactataaaca

SEQ ID NO: 150065 - DNA, 22 bp, Artificial Sequence
  chemically synthesized
taaacacctctacgcaaataaa

SEQ ID NO: 150066 - DNA, 22 bp, Artificial Sequence
  chemically synthesized
tacgcaaataaactagaaaatc

SEQ ID NO: 150067 - DNA, 22 bp, Artificial Sequence
  chemically synthesized
cgcaaataaactagaaaatcta

SEQ ID NO: 150068 - DNA, 22 bp, Artificial Sequence
  chemically synthesized
gaaaatctagaagaaatggata

SEQ ID NO: 150069 - DNA, 22 bp, Artificial Sequence
  chemically synthesized
gaagaaatggataaattcctcg

SEQ ID NO: 150070 - DNA, 22 bp, Artificial Sequence
  chemically synthesized
ctcgacacatacactctgccaa

SEQ ID NO: 150071 - DNA, 22 bp, Artificial Sequence
  chemically synthesized
gacacatacactctgccaagac

SEQ ID NO: 150072 - DNA, 22 bp, Artificial Sequence
  chemically synthesized
tgccaagactaaaccaggaaga

SEQ ID NO: 150073 - DNA, 22 bp, Artificial Sequence
  chemically synthesized
ccaagactaaaccaggaagaag

SEQ ID NO: 150074 - DNA, 22 bp, Artificial Sequence
  chemically synthesized
aaccaggaagaagttgtatctc

SEQ ID NO: 150075 - DNA, 22 bp, Artificial Sequence
  chemically synthesized
tatctctgaatagaccaataac

SEQ ID NO: 150076 - DNA, 22 bp, Artificial Sequence
  chemically synthesized
tgaatagaccaataacaggctc

SEQ ID NO: 150077 - DNA, 22 bp, Artificial Sequence
  chemically synthesized
aatagaccaataacaggctctg

SEQ ID NO: 150078 - DNA, 22 bp, Artificial Sequence
  chemically synthesized
tgaaattgaggcaataattaat

SEQ ID NO: 150079 - DNA, 22 bp, Artificial Sequence
  chemically synthesized
aaattgaggcaataattaatag

SEQ ID NO: 150080 - DNA, 22 bp, Artificial Sequence
  chemically synthesized
aggcaataattaatagcttatc

SEQ ID NO: 150081 - DNA, 22 bp, Artificial Sequence
  chemically synthesized
atagcttatcaaccaaaaaaag

SEQ ID NO: 150082 - DNA, 22 bp, Artificial Sequence
  chemically synthesized
atcaaccaaaaaaagtccggga

SEQ ID NO: 150083 - DNA, 22 bp, Artificial Sequence
  chemically synthesized
tcaaccaaaaaaagtccgggac

SEQ ID NO: 150084 - DNA, 22 bp, Artificial Sequence
  chemically synthesized
atagccgaattctaccagaggt

SEQ ID NO: 150085 - DNA, 22 bp, Artificial Sequence
  chemically synthesized
taccagaggtacaaggaggagc

SEQ ID NO: 150086 - DNA, 22 bp, Artificial Sequence
  chemically synthesized
ccagaggtacaaggaggagctg

SEQ ID NO: 150087 - DNA, 22 bp, Artificial Sequence
  chemically synthesized
gtaccattccttctgaaactat

SEQ ID NO: 150088 - DNA, 22 bp, Artificial Sequence
  chemically synthesized
cttctgaaactattccaatcaa

SEQ ID NO: 150089 - DNA, 22 bp, Artificial Sequence
  chemically synthesized
ctgaaactattccaatcaatag

SEQ ID NO: 150090 - DNA, 22 bp, Artificial Sequence
  chemically synthesized
tgaaactattccaatcaataga

SEQ ID NO: 150091 - DNA, 22 bp, Artificial Sequence
  chemically synthesized
aaactattccaatcaatagaaa

SEQ ID NO: 150092 - DNA, 22 bp, Artificial Sequence
  chemically synthesized
ttccaatcaatagaaaaagagg

SEQ ID NO: 150093 - DNA, 22 bp, Artificial Sequence
  chemically synthesized
caatcaatagaaaaagagggaa

SEQ ID NO: 150094 - DNA, 22 bp, Artificial Sequence
  chemically synthesized
cctaactcattttatgaggcca

SEQ ID NO: 150095 - DNA, 22 bp, Artificial Sequence
  chemically synthesized
actcattttatgaggccagcat

SEQ ID NO: 150096 - DNA, 22 bp, Artificial Sequence
  chemically synthesized
attttatgaggccagcatcatc

SEQ ID NO: 150097 - DNA, 22 bp, Artificial Sequence
  chemically synthesized
tatgaggccagcatcatcctga

SEQ ID NO: 150098 - DNA, 22 bp, Artificial Sequence
  chemically synthesized
atgaggccagcatcatcctgat

SEQ ID NO: 150099 - DNA, 22 bp, Artificial Sequence
  chemically synthesized
tgaggccagcatcatcctgata

SEQ ID NO: 150100 - DNA, 22 bp, Artificial Sequence
  chemically synthesized
ataccaaagcctgacagagaca

SEQ ID NO: 150101 - DNA, 22 bp, Artificial Sequence
  chemically synthesized
acagagacacaacaaaaaaaga

SEQ ID NO: 150102 - DNA, 22 bp, Artificial Sequence
  chemically synthesized
caccaatatccttgatgaacat

SEQ ID NO: 150103 - DNA, 22 bp, Artificial Sequence
  chemically synthesized
gatgaacattgatgcaaaaatc

SEQ ID NO: 150104 - DNA, 22 bp, Artificial Sequence
  chemically synthesized
atgaacattgatgcaaaaatcc

SEQ ID NO: 150105 - DNA, 22 bp, Artificial Sequence
  chemically synthesized
atgcaaaaatcctcaataaaat

SEQ ID NO: 150106 - DNA, 22 bp, Artificial Sequence
  chemically synthesized
aataaaatactggcaaactgat

SEQ ID NO: 150107 - DNA, 22 bp, Artificial Sequence
  chemically synthesized
gcaaactgatccaccatgatca

SEQ ID NO: 150108 - DNA, 22 bp, Artificial Sequence
  chemically synthesized
atccaccatgatcaagtgggct

SEQ ID NO: 150109 - DNA, 22 bp, Artificial Sequence
  chemically synthesized
catccctgccatgcaaggctgg

SEQ ID NO: 150110 - DNA, 22 bp, Artificial Sequence
  chemically synthesized
atccctgccatgcaaggctggt

SEQ ID NO: 150111 - DNA, 22 bp, Artificial Sequence
  chemically synthesized
ccatgcaaggctggttcaacat

SEQ ID NO: 150112 - DNA, 22 bp, Artificial Sequence
  chemically synthesized
gttcaacatacgaaaatcaata

SEQ ID NO: 150113 - DNA, 22 bp, Artificial Sequence
  chemically synthesized
aacatacgaaaatcaataaaca

SEQ ID NO: 150114 - DNA, 22 bp, Artificial Sequence
  chemically synthesized
tctcaatagatgcagaaaaggc

SEQ ID NO: 150115 - DNA, 22 bp, Artificial Sequence
  chemically synthesized
aatagatgcagaaaaggccttt

SEQ ID NO: 150116 - DNA, 22 bp, Artificial Sequence
  chemically synthesized
tgacaaaattcaacaacgcttc

SEQ ID NO: 150117 - DNA, 22 bp, Artificial Sequence
  chemically synthesized
gacaaaattcaacaacgcttca

SEQ ID NO: 150118 - DNA, 22 bp, Artificial Sequence
  chemically synthesized
acaaaattcaacaacgcttcat

SEQ ID NO: 150119 - DNA, 22 bp, Artificial Sequence
  chemically synthesized
aacaacgcttcatgctaaaaac

SEQ ID NO: 150120 - DNA, 22 bp, Artificial Sequence
  chemically synthesized
catgctaaaaactctcaataaa

SEQ ID NO: 150121 - DNA, 22 bp, Artificial Sequence
  chemically synthesized
atgctaaaaactctcaataaat

SEQ ID NO: 150122 - DNA, 22 bp, Artificial Sequence
  chemically synthesized
aaaactctcaataaattaggta

SEQ ID NO: 150123 - DNA, 22 bp, Artificial Sequence
  chemically synthesized
tcaataaattaggtattgatgg

SEQ ID NO: 150124 - DNA, 22 bp, Artificial Sequence
  chemically synthesized
aataaattaggtattgatggga

SEQ ID NO: 150125 - DNA, 22 bp, Artificial Sequence
  chemically synthesized
ggtattgatgggacatatctca

SEQ ID NO: 150126 - DNA, 22 bp, Artificial Sequence
  chemically synthesized
atgggacatatctcaaaataat

SEQ ID NO: 150127 - DNA, 22 bp, Artificial Sequence
  chemically synthesized
aaaataataagagctatctatg

SEQ ID NO: 150128 - DNA, 22 bp, Artificial Sequence
  chemically synthesized
tctatgacaaacccacagccaa

SEQ ID NO: 150129 - DNA, 22 bp, Artificial Sequence
  chemically synthesized
tgacaaacccacagccaatatc

SEQ ID NO: 150130 - DNA, 22 bp, Artificial Sequence
  chemically synthesized
agtggacaaaaactggaagcat

SEQ ID NO: 150131 - DNA, 22 bp, Artificial Sequence
  chemically synthesized
gaagcattccctttgaaaactg

SEQ ID NO: 150132 - DNA, 22 bp, Artificial Sequence
  chemically synthesized
cctttgaaaactggcacaaggc

SEQ ID NO: 150133 - DNA, 22 bp, Artificial Sequence
  chemically synthesized
tgaaaactggcacaaggcaggg

SEQ ID NO: 150134 - DNA, 22 bp, Artificial Sequence
  chemically synthesized
gaaaactggcacaaggcaggga

SEQ ID NO: 150135 - DNA, 22 bp, Artificial Sequence
  chemically synthesized
aaaactggcacaaggcagggat

SEQ ID NO: 150136 - DNA, 22 bp, Artificial Sequence
  chemically synthesized
gcacaaggcagggatgccctct

SEQ ID NO: 150137 - DNA, 22 bp, Artificial Sequence
  chemically synthesized
tctcaccactcctattcaacat

SEQ ID NO: 150138 - DNA, 22 bp, Artificial Sequence
  chemically synthesized
tcaccactcctattcaacatag

SEQ ID NO: 150139 - DNA, 22 bp, Artificial Sequence
  chemically synthesized
accactcctattcaacatagtg

SEQ ID NO: 150140 - DNA, 22 bp, Artificial Sequence
  chemically synthesized
ctattcaacatagtgttgtaag

SEQ ID NO: 150141 - DNA, 22 bp, Artificial Sequence
  chemically synthesized
ttcaacatagtgttgtaagttc

SEQ ID NO: 150142 - DNA, 22 bp, Artificial Sequence
  chemically synthesized
aacatagtgttgtaagttctgg

SEQ ID NO: 150143 - DNA, 22 bp, Artificial Sequence
  chemically synthesized
taagttctggccagggcaatca

SEQ ID NO: 150144 - DNA, 22 bp, Artificial Sequence
  chemically synthesized
tggccagggcaatcaggcagga

SEQ ID NO: 150145 - DNA, 22 bp, Artificial Sequence
  chemically synthesized
gccagggcaatcaggcaggaga

SEQ ID NO: 150146 - DNA, 22 bp, Artificial Sequence
  chemically synthesized
aattaggaaaagaggaagtgaa

SEQ ID NO: 150147 - DNA, 22 bp, Artificial Sequence
  chemically synthesized
ggaaaagaggaagtgaaattgt

SEQ ID NO: 150148 - DNA, 22 bp, Artificial Sequence
  chemically synthesized
tccctgtttgcagatgacatga

SEQ ID NO: 150149 - DNA, 22 bp, Artificial Sequence
  chemically synthesized
tttgcagatgacatgattgtat

SEQ ID NO: 150150 - DNA, 22 bp, Artificial Sequence
  chemically synthesized
gcagatgacatgattgtatatc

SEQ ID NO: 150151 - DNA, 22 bp, Artificial Sequence
  chemically synthesized
cagatgacatgattgtatatct

SEQ ID NO: 150152 - DNA, 22 bp, Artificial Sequence
  chemically synthesized
tatatctagaaaaccccattgt

SEQ ID NO: 150153 - DNA, 22 bp, Artificial Sequence
  chemically synthesized
gaaaaccccattgtctcagccc

SEQ ID NO: 150154 - DNA, 22 bp, Artificial Sequence
  chemically synthesized
tctcagcccaaaatctccttaa

SEQ ID NO: 150155 - DNA, 22 bp, Artificial Sequence
  chemically synthesized
agcccaaaatctccttaagctg

SEQ ID NO: 150156 - DNA, 22 bp, Artificial Sequence
  chemically synthesized
cttaagctgataagcaacttca

SEQ ID NO: 150157 - DNA, 22 bp, Artificial Sequence
  chemically synthesized
aagctgataagcaacttcagca

SEQ ID NO: 150158 - DNA, 22 bp, Artificial Sequence
  chemically synthesized
agctgataagcaacttcagcaa

SEQ ID NO: 150159 - DNA, 22 bp, Artificial Sequence
  chemically synthesized
ataagcaacttcagcaaagtct

SEQ ID NO: 150160 - DNA, 22 bp, Artificial Sequence
  chemically synthesized
cagcaaagtctcaggatataaa

SEQ ID NO: 150161 - DNA, 22 bp, Artificial Sequence
  chemically synthesized
agcaaagtctcaggatataaaa

SEQ ID NO: 150162 - DNA, 22 bp, Artificial Sequence
  chemically synthesized
aggatataaaatcagtgtgcaa

SEQ ID NO: 150163 - DNA, 22 bp, Artificial Sequence
  chemically synthesized
ctatgcaccaataacagacaaa

SEQ ID NO: 150164 - DNA, 22 bp, Artificial Sequence
  chemically synthesized
tgcaccaataacagacaaacag

SEQ ID NO: 150165 - DNA, 22 bp, Artificial Sequence
  chemically synthesized
ccattcacaattgcttcaaaga

SEQ ID NO: 150166 - DNA, 22 bp, Artificial Sequence
  chemically synthesized
acaattgcttcaaagagaataa

SEQ ID NO: 150167 - DNA, 22 bp, Artificial Sequence
  chemically synthesized
cttcaaagagaataaaatacct

SEQ ID NO: 150168 - DNA, 22 bp, Artificial Sequence
  chemically synthesized
caaagagaataaaatacctagg

SEQ ID NO: 150169 - DNA, 22 bp, Artificial Sequence
  chemically synthesized
aaagagaataaaatacctagga

SEQ ID NO: 150170 - DNA, 22 bp, Artificial Sequence
  chemically synthesized
ggaatccaacttacaagggatg

SEQ ID NO: 150171 - DNA, 22 bp, Artificial Sequence
  chemically synthesized
acaagggatgtgaaggacctct

SEQ ID NO: 150172 - DNA, 22 bp, Artificial Sequence
  chemically synthesized
caagggatgtgaaggacctctt

SEQ ID NO: 150173 - DNA, 22 bp, Artificial Sequence
  chemically synthesized
ttcaaggagaactacaaaccac

SEQ ID NO: 150174 - DNA, 22 bp, Artificial Sequence
  chemically synthesized
caaggagaactacaaaccactg

SEQ ID NO: 150175 - DNA, 22 bp, Artificial Sequence
  chemically synthesized
aaggagaactacaaaccactgc

SEQ ID NO: 150176 - DNA, 22 bp, Artificial Sequence
  chemically synthesized
caaaccactgctcaatgaaata

SEQ ID NO: 150177 - DNA, 22 bp, Artificial Sequence
  chemically synthesized
ctcaatgaaataaaagaggata

SEQ ID NO: 150178 - DNA, 22 bp, Artificial Sequence
  chemically synthesized
aatgaaataaaagaggatacaa

SEQ ID NO: 150179 - DNA, 22 bp, Artificial Sequence
  chemically synthesized
catgctcatgggtaggaagaat

SEQ ID NO: 150180 - DNA, 22 bp, Artificial Sequence
  chemically synthesized
atgggtaggaagaatcaatatc

SEQ ID NO: 150181 - DNA, 22 bp, Artificial Sequence
  chemically synthesized
cccaaggtaatttatagattca

SEQ ID NO: 150182 - DNA, 22 bp, Artificial Sequence
  chemically synthesized
atagattcaatgccatccccat

SEQ ID NO: 150183 - DNA, 22 bp, Artificial Sequence
  chemically synthesized
tagattcaatgccatccccatc

SEQ ID NO: 150184 - DNA, 22 bp, Artificial Sequence
  chemically synthesized
aatgccatccccatcaagctac

SEQ ID NO: 150185 - DNA, 22 bp, Artificial Sequence
  chemically synthesized
ccaatgactttcttcacagaac

SEQ ID NO: 150186 - DNA, 22 bp, Artificial Sequence
  chemically synthesized
tcttcacagaactggaaaaaac

SEQ ID NO: 150187 - DNA, 22 bp, Artificial Sequence
  chemically synthesized
cttcacagaactggaaaaaact

SEQ ID NO: 150188 - DNA, 22 bp, Artificial Sequence
  chemically synthesized
ttcacagaactggaaaaaacta

SEQ ID NO: 150189 - DNA, 22 bp, Artificial Sequence
  chemically synthesized
cacagaactggaaaaaactact

SEQ ID NO: 150190 - DNA, 22 bp, Artificial Sequence
  chemically synthesized
acagaactggaaaaaactactt

SEQ ID NO: 150191 - DNA, 22 bp, Artificial Sequence
  chemically synthesized
gaaaaaactactttaaagttca

SEQ ID NO: 150192 - DNA, 22 bp, Artificial Sequence
  chemically synthesized
ctttaaagttcatatggaacca

SEQ ID NO: 150193 - DNA, 22 bp, Artificial Sequence
  chemically synthesized
taaagttcatatggaaccaaaa

SEQ ID NO: 150194 - DNA, 22 bp, Artificial Sequence
  chemically synthesized
aaagttcatatggaaccaaaaa

SEQ ID NO: 150195 - DNA, 22 bp, Artificial Sequence
  chemically synthesized
aagttcatatggaaccaaaaaa

SEQ ID NO: 150196 - DNA, 22 bp, Artificial Sequence
  chemically synthesized
atatggaaccaaaaaagagccc

SEQ ID NO: 150197 - DNA, 22 bp, Artificial Sequence
  chemically synthesized
agccaaaagaacaaagctggag

SEQ ID NO: 150198 - DNA, 22 bp, Artificial Sequence
  chemically synthesized
gaggcatcacgctacctgactt

SEQ ID NO: 150199 - DNA, 22 bp, Artificial Sequence
  chemically synthesized
cctgacttcaaactatactaca

SEQ ID NO: 150200 - DNA, 22 bp, Artificial Sequence
  chemically synthesized
acttcaaactatactacaatgc

SEQ ID NO: 150201 - DNA, 22 bp, Artificial Sequence
  chemically synthesized
caaactatactacaatgctacg

SEQ ID NO: 150202 - DNA, 22 bp, Artificial Sequence
  chemically synthesized
aaactatactacaatgctacgg

SEQ ID NO: 150203 - DNA, 22 bp, Artificial Sequence
  chemically synthesized
tactacaatgctacggtaacca

SEQ ID NO: 150204 - DNA, 22 bp, Artificial Sequence
  chemically synthesized
caatgctacggtaaccaaaaca

SEQ ID NO: 150205 - DNA, 22 bp, Artificial Sequence
  chemically synthesized
cggtaaccaaaacagcatggta

SEQ ID NO: 150206 - DNA, 22 bp, Artificial Sequence
  chemically synthesized
gtaccaaaacagagatctagac

SEQ ID NO: 150207 - DNA, 22 bp, Artificial Sequence
  chemically synthesized
gaccaatggaacagaacagagc

SEQ ID NO: 150208 - DNA, 22 bp, Artificial Sequence
  chemically synthesized
agaaataatgccgcatatctac

SEQ ID NO: 150209 - DNA, 22 bp, Artificial Sequence
  chemically synthesized
caactatctgatctttgacaaa

SEQ ID NO: 150210 - DNA, 22 bp, Artificial Sequence
  chemically synthesized
tctgatctttgacaaacctgag

SEQ ID NO: 150211 - DNA, 22 bp, Artificial Sequence
  chemically synthesized
atctttgacaaacctgagagaa

SEQ ID NO: 150212 - DNA, 22 bp, Artificial Sequence
  chemically synthesized
tgacaaacctgagagaaacaag

SEQ ID NO: 150213 - DNA, 22 bp, Artificial Sequence
  chemically synthesized
gacaaacctgagagaaacaagc

SEQ ID NO: 150214 - DNA, 22 bp, Artificial Sequence
  chemically synthesized
acaaacctgagagaaacaagca

SEQ ID NO: 150215 - DNA, 22 bp, Artificial Sequence
  chemically synthesized
agagaaacaagcaatggggaaa

SEQ ID NO: 150216 - DNA, 22 bp, Artificial Sequence
  chemically synthesized
cctatttaataaatggtgctgg

SEQ ID NO: 150217 - DNA, 22 bp, Artificial Sequence
  chemically synthesized
tttaataaatggtgctgggaaa

SEQ ID NO: 150218 - DNA, 22 bp, Artificial Sequence
  chemically synthesized
aataaatggtgctgggaaaact

SEQ ID NO: 150219 - DNA, 22 bp, Artificial Sequence
  chemically synthesized
ataaatggtgctgggaaaactg

SEQ ID NO: 150220 - DNA, 22 bp, Artificial Sequence
  chemically synthesized
ggaaaactggctagccatatgt

SEQ ID NO: 150221 - DNA, 22 bp, Artificial Sequence
  chemically synthesized
gctagccatatgtagaaagctg

SEQ ID NO: 150222 - DNA, 22 bp, Artificial Sequence
  chemically synthesized
gccatatgtagaaagctgaaac

SEQ ID NO: 150223 - DNA, 22 bp, Artificial Sequence
  chemically synthesized
aaactggatcccttccttacac

SEQ ID NO: 150224 - DNA, 22 bp, Artificial Sequence
  chemically synthesized
gatcccttccttacaccttata

SEQ ID NO: 150225 - DNA, 22 bp, Artificial Sequence
  chemically synthesized
ccttacaccttatacaaaaatt

SEQ ID NO: 150226 - DNA, 22 bp, Artificial Sequence
  chemically synthesized
cttacaccttatacaaaaatta

SEQ ID NO: 150227 - DNA, 22 bp, Artificial Sequence
  chemically synthesized
acaccttatacaaaaattaatt

SEQ ID NO: 150228 - DNA, 22 bp, Artificial Sequence
  chemically synthesized
caccttatacaaaaattaattc

SEQ ID NO: 150229 - DNA, 22 bp, Artificial Sequence
  chemically synthesized
atacaaaaattaattcaagatg

SEQ ID NO: 150230 - DNA, 22 bp, Artificial Sequence
  chemically synthesized
tacaaaaattaattcaagatgg

SEQ ID NO: 150231 - DNA, 22 bp, Artificial Sequence
  chemically synthesized
attcaagatggattaaagactt

SEQ ID NO: 150232 - DNA, 22 bp, Artificial Sequence
  chemically synthesized
aagatggattaaagacttacat

SEQ ID NO: 150233 - DNA, 22 bp, Artificial Sequence
  chemically synthesized
aagacttacatgttagacctaa

SEQ ID NO: 150234 - DNA, 22 bp, Artificial Sequence
  chemically synthesized
acatgttagacctaaaaccata

SEQ ID NO: 150235 - DNA, 22 bp, Artificial Sequence
  chemically synthesized
catgttagacctaaaaccataa

SEQ ID NO: 150236 - DNA, 22 bp, Artificial Sequence
  chemically synthesized
gacctaaaaccataaaaaccct

SEQ ID NO: 150237 - DNA, 22 bp, Artificial Sequence
  chemically synthesized
aaaccataaaaaccctagaaaa

SEQ ID NO: 150238 - DNA, 22 bp, Artificial Sequence
  chemically synthesized
gaaaaaaacctaggcaatacca

SEQ ID NO: 150239 - DNA, 22 bp, Artificial Sequence
  chemically synthesized
ggcaataccattcaggacatag

SEQ ID NO: 150240 - DNA, 22 bp, Artificial Sequence
  chemically synthesized
aggacataggcatgggcaagga

SEQ ID NO: 150241 - DNA, 22 bp, Artificial Sequence
  chemically synthesized
catgtctaaaacaccaaaagca

SEQ ID NO: 150242 - DNA, 22 bp, Artificial Sequence
  chemically synthesized
atgtctaaaacaccaaaagcaa

SEQ ID NO: 150243 - DNA, 22 bp, Artificial Sequence
  chemically synthesized
aaacaccaaaagcaatggcaac

SEQ ID NO: 150244 - DNA, 22 bp, Artificial Sequence
  chemically synthesized
attaaactaaagagcttctgca

SEQ ID NO: 150245 - DNA, 22 bp, Artificial Sequence
  chemically synthesized
aactaaagagcttctgcacagc

SEQ ID NO: 150246 - DNA, 22 bp, Artificial Sequence
  chemically synthesized
aagagcttctgcacagctaaag

SEQ ID NO: 150247 - DNA, 22 bp, Artificial Sequence
  chemically synthesized
ctgcacagctaaagaaactacc

SEQ ID NO: 150248 - DNA, 22 bp, Artificial Sequence
  chemically synthesized
tgcacagctaaagaaactacca

SEQ ID NO: 150249 - DNA, 22 bp, Artificial Sequence
  chemically synthesized
cacagctaaagaaactaccatc

SEQ ID NO: 150250 - DNA, 22 bp, Artificial Sequence
  chemically synthesized
aagaaactaccatcagagtgaa

SEQ ID NO: 150251 - DNA, 22 bp, Artificial Sequence
  chemically synthesized
ccatcagagtgaacaggcaacc

SEQ ID NO: 150252 - DNA, 22 bp, Artificial Sequence
  chemically synthesized
caaaatgggagaaaatttttgc

SEQ ID NO: 150253 - DNA, 22 bp, Artificial Sequence
  chemically synthesized
ttgcaatctactcatctgacaa

SEQ ID NO: 150254 - DNA, 22 bp, Artificial Sequence
  chemically synthesized
tgcaatctactcatctgacaaa

SEQ ID NO: 150255 - DNA, 22 bp, Artificial Sequence
  chemically synthesized
gcaatctactcatctgacaaag

SEQ ID NO: 150256 - DNA, 22 bp, Artificial Sequence
  chemically synthesized
caatctactcatctgacaaagg

SEQ ID NO: 150257 - DNA, 22 bp, Artificial Sequence
  chemically synthesized
ctcatctgacaaagggctaata

SEQ ID NO: 150258 - DNA, 22 bp, Artificial Sequence
  chemically synthesized
atctgacaaagggctaatatcc

SEQ ID NO: 150259 - DNA, 22 bp, Artificial Sequence
  chemically synthesized
acaaagggctaatatccagaat

SEQ ID NO: 150260 - DNA, 22 bp, Artificial Sequence
  chemically synthesized
atatccagaatctacaatgaac

SEQ ID NO: 150261 - DNA, 22 bp, Artificial Sequence
  chemically synthesized
caatgaactcaaacaaatttac

SEQ ID NO: 150262 - DNA, 22 bp, Artificial Sequence
  chemically synthesized
aaacaaatttacaagaaaaaac

SEQ ID NO: 150263 - DNA, 22 bp, Artificial Sequence
  chemically synthesized
acaagaaaaaacaaacaacccc

SEQ ID NO: 150264 - DNA, 22 bp, Artificial Sequence
  chemically synthesized
caagaaaaaacaaacaacccca

SEQ ID NO: 150265 - DNA, 22 bp, Artificial Sequence
  chemically synthesized
cgcaaaagaagacatttatgta

SEQ ID NO: 150266 - DNA, 22 bp, Artificial Sequence
  chemically synthesized
gcaaaagaagacatttatgtaa

SEQ ID NO: 150267 - DNA, 22 bp, Artificial Sequence
  chemically synthesized
atgtaatcaaaaaacacatgaa

SEQ ID NO: 150268 - DNA, 22 bp, Artificial Sequence
  chemically synthesized
tgtaatcaaaaaacacatgaaa

SEQ ID NO: 150269 - DNA, 22 bp, Artificial Sequence
  chemically synthesized
atcatcactagccatcagagaa

SEQ ID NO: 150270 - DNA, 22 bp, Artificial Sequence
  chemically synthesized
gccatcagagaaatgcaaatca

SEQ ID NO: 150271 - DNA, 22 bp, Artificial Sequence
  chemically synthesized
acaccagttagaatggcgatca

SEQ ID NO: 150272 - DNA, 22 bp, Artificial Sequence
  chemically synthesized
gaatggcgatcattaaaaagtc

SEQ ID NO: 150273 - DNA, 22 bp, Artificial Sequence
  chemically synthesized
aaaagtcaggaaacaacaggtg

SEQ ID NO: 150274 - DNA, 22 bp, Artificial Sequence
  chemically synthesized
gagaggatgtggagaaacagga

SEQ ID NO: 150275 - DNA, 22 bp, Artificial Sequence
  chemically synthesized
ttacactgttggtgggactgta

SEQ ID NO: 150276 - DNA, 22 bp, Artificial Sequence
  chemically synthesized
tacactgttggtgggactgtaa

SEQ ID NO: 150277 - DNA, 22 bp, Artificial Sequence
  chemically synthesized
acactgttggtgggactgtaaa

SEQ ID NO: 150278 - DNA, 22 bp, Artificial Sequence
  chemically synthesized
cactgttggtgggactgtaaac

SEQ ID NO: 150279 - DNA, 22 bp, Artificial Sequence
  chemically synthesized
ttggtgggactgtaaactagtt

SEQ ID NO: 150280 - DNA, 22 bp, Artificial Sequence
  chemically synthesized
gtgggactgtaaactagttcaa

SEQ ID NO: 150281 - DNA, 22 bp, Artificial Sequence
  chemically synthesized
taaactagttcaaccattgcgg

SEQ ID NO: 150282 - DNA, 22 bp, Artificial Sequence
  chemically synthesized
gttcaaccattgcggaagtcag

SEQ ID NO: 150283 - DNA, 22 bp, Artificial Sequence
  chemically synthesized
aaccattgcggaagtcagtgtg

SEQ ID NO: 150284 - DNA, 22 bp, Artificial Sequence
  chemically synthesized
cggaagtcagtgtggcaattcc

SEQ ID NO: 150285 - DNA, 22 bp, Artificial Sequence
  chemically synthesized
ctcaggaatctagaactagaaa

SEQ ID NO: 150286 - DNA, 22 bp, Artificial Sequence
  chemically synthesized
aggaatctagaactagaaatac

SEQ ID NO: 150287 - DNA, 22 bp, Artificial Sequence
  chemically synthesized
gaactagaaataccatttgacc

SEQ ID NO: 150288 - DNA, 22 bp, Artificial Sequence
  chemically synthesized
gaaataccatttgacccagcca

SEQ ID NO: 150289 - DNA, 22 bp, Artificial Sequence
  chemically synthesized
gacccagccatcccattactgg

SEQ ID NO: 150290 - DNA, 22 bp, Artificial Sequence
  chemically synthesized
acccagccatcccattactggg

SEQ ID NO: 150291 - DNA, 22 bp, Artificial Sequence
  chemically synthesized
ctgggtacatacccaaaggatt

SEQ ID NO: 150292 - DNA, 22 bp, Artificial Sequence
  chemically synthesized
ggtacatacccaaaggattata

SEQ ID NO: 150293 - DNA, 22 bp, Artificial Sequence
  chemically synthesized
taaatcatgctgctataaagac

SEQ ID NO: 150294 - DNA, 22 bp, Artificial Sequence
  chemically synthesized
ctataaagacacatgcacacgt

SEQ ID NO: 150295 - DNA, 22 bp, Artificial Sequence
  chemically synthesized
taaagacacatgcacacgtatg

SEQ ID NO: 150296 - DNA, 22 bp, Artificial Sequence
  chemically synthesized
attgcagcactattcacaatag

SEQ ID NO: 150297 - DNA, 22 bp, Artificial Sequence
  chemically synthesized
ttgcagcactattcacaatagc

SEQ ID NO: 150298 - DNA, 22 bp, Artificial Sequence
  chemically synthesized
cagcactattcacaatagcaaa

SEQ ID NO: 150299 - DNA, 22 bp, Artificial Sequence
  chemically synthesized
ttcacaatagcaaagacttgga

SEQ ID NO: 150300 - DNA, 22 bp, Artificial Sequence
  chemically synthesized
acaatagcaaagacttggaacc

SEQ ID NO: 150301 - DNA, 22 bp, Artificial Sequence
  chemically synthesized
ggaaccaacccaaatgtccaac

SEQ ID NO: 150302 - DNA, 22 bp, Artificial Sequence
  chemically synthesized
gaaccaacccaaatgtccaaca

SEQ ID NO: 150303 - DNA, 22 bp, Artificial Sequence
  chemically synthesized
gattaagaaaatgtggcacata

SEQ ID NO: 150304 - DNA, 22 bp, Artificial Sequence
  chemically synthesized
agaaaatgtggcacatatacac

SEQ ID NO: 150305 - DNA, 22 bp, Artificial Sequence
  chemically synthesized
tgcagccataaaaaatgatgag

SEQ ID NO: 150306 - DNA, 22 bp, Artificial Sequence
  chemically synthesized
atgtcctttgtagggacatgga

SEQ ID NO: 150307 - DNA, 22 bp, Artificial Sequence
  chemically synthesized
tgtagggacatggatgaagctg

SEQ ID NO: 150308 - DNA, 22 bp, Artificial Sequence
  chemically synthesized
gtagggacatggatgaagctgg

SEQ ID NO: 150309 - DNA, 22 bp, Artificial Sequence
  chemically synthesized
tagggacatggatgaagctgga

SEQ ID NO: 150310 - DNA, 22 bp, Artificial Sequence
  chemically synthesized
gaaactatcattctcagcaaac

SEQ ID NO: 150311 - DNA, 22 bp, Artificial Sequence
  chemically synthesized
tcattctcagcaaactatcaca

SEQ ID NO: 150312 - DNA, 22 bp, Artificial Sequence
  chemically synthesized
tcagcaaactatcacaaggaga

SEQ ID NO: 150313 - DNA, 22 bp, Artificial Sequence
  chemically synthesized
agcaaactatcacaaggagaat

SEQ ID NO: 150314 - DNA, 22 bp, Artificial Sequence
  chemically synthesized
tcacaaggagaataaaccaaac

SEQ ID NO: 150315 - DNA, 22 bp, Artificial Sequence
  chemically synthesized
tcactcataggtgggaattgaa

SEQ ID NO: 150316 - DNA, 22 bp, Artificial Sequence
  chemically synthesized
actcataggtgggaattgaaca

SEQ ID NO: 150317 - DNA, 22 bp, Artificial Sequence
  chemically synthesized
ataggtgggaattgaacaatga

SEQ ID NO: 150318 - DNA, 22 bp, Artificial Sequence
  chemically synthesized
aacaatgagaacacatggacac

SEQ ID NO: 150319 - DNA, 22 bp, Artificial Sequence
  chemically synthesized
tggggactgttatggggtgggg

SEQ ID NO: 150320 - DNA, 22 bp, Artificial Sequence
  chemically synthesized
gggactgttatggggtgggggg

SEQ ID NO: 150321 - DNA, 22 bp, Artificial Sequence
  chemically synthesized
ttatggggtggggggcaggggc

SEQ ID NO: 150322 - DNA, 22 bp, Artificial Sequence
  chemically synthesized
tggggtggggggcaggggcagg

SEQ ID NO: 150323 - DNA, 22 bp, Artificial Sequence
  chemically synthesized
ggagatatacctaatgctaaat

SEQ ID NO: 150324 - DNA, 22 bp, Artificial Sequence
  chemically synthesized
atgctaaatgacgagttaatgg

SEQ ID NO: 150325 - DNA, 22 bp, Artificial Sequence
  chemically synthesized
aatgacgagttaatgggtgcag

SEQ ID NO: 150326 - DNA, 22 bp, Artificial Sequence
  chemically synthesized
atgggtgcagcacaccaacatg

SEQ ID NO: 150327 - DNA, 22 bp, Artificial Sequence
  chemically synthesized
catgttgtgcacatgtacccta

SEQ ID NO: 150328 - DNA, 22 bp, Artificial Sequence
  chemically synthesized
tgcacatgtaccctaaaacttg

SEQ ID NO: 150329 - DNA, 22 bp, Artificial Sequence
  chemically synthesized
aaacttgaagtataataataaa

SEQ ID NO: 150330 - DNA, 22 bp, Artificial Sequence
  chemically synthesized
gaagtataataataaaaaaaag

SEQ ID NO: 150331 - DNA, 22 bp, Artificial Sequence
  chemically synthesized
aagtataataataaaaaaaagt

SEQ ID NO: 150332 - DNA, 22 bp, Artificial Sequence
  chemically synthesized
tcctattaaaactgatctcaca

SEQ ID NO: 150333 - DNA, 22 bp, Artificial Sequence
  chemically synthesized
ttaaaactgatctcacacatcc

SEQ ID NO: 150334 - DNA, 22 bp, Artificial Sequence
  chemically synthesized
aaactgatctcacacatccgta

SEQ ID NO: 150335 - DNA, 22 bp, Artificial Sequence
  chemically synthesized
atctcacacatccgtagagcca

SEQ ID NO: 150336 - DNA, 22 bp, Artificial Sequence
  chemically synthesized
acacatccgtagagccattatc

SEQ ID NO: 150337 - DNA, 22 bp, Artificial Sequence
  chemically synthesized
tcaagtctttctctttgaaata

SEQ ID NO: 150338 - DNA, 22 bp, Artificial Sequence
  chemically synthesized
tctctttgaaatagacagaaat

SEQ ID NO: 150339 - DNA, 22 bp, Artificial Sequence
  chemically synthesized
ctctttgaaatagacagaaatt

SEQ ID NO: 150340 - DNA, 22 bp, Artificial Sequence
  chemically synthesized
tctttgaaatagacagaaattt

SEQ ID NO: 150341 - DNA, 22 bp, Artificial Sequence
  chemically synthesized
tttgaaatagacagaaatttag

SEQ ID NO: 150342 - DNA, 22 bp, Artificial Sequence
  chemically synthesized
tgaaatagacagaaatttagtg

SEQ ID NO: 150343 - DNA, 22 bp, Artificial Sequence
  chemically synthesized
gaaatagacagaaatttagtgt

SEQ ID NO: 150344 - DNA, 22 bp, Artificial Sequence
  chemically synthesized
aaatagacagaaatttagtgtt

SEQ ID NO: 150345 - DNA, 22 bp, Artificial Sequence
  chemically synthesized
agtgttttctcagtcagttaac

SEQ ID NO: 150346 - DNA, 22 bp, Artificial Sequence
  chemically synthesized
gtgttttctcagtcagttaaca

SEQ ID NO: 150347 - DNA, 22 bp, Artificial Sequence
  chemically synthesized
tctcagtcagttaacattcctt

SEQ ID NO: 150348 - DNA, 22 bp, Artificial Sequence
  chemically synthesized
ctcagtcagttaacattccttc

SEQ ID NO: 150349 - DNA, 22 bp, Artificial Sequence
  chemically synthesized
tcagtcagttaacattccttca

SEQ ID NO: 150350 - DNA, 22 bp, Artificial Sequence
  chemically synthesized
agtcagttaacattccttcaac

SEQ ID NO: 150351 - DNA, 22 bp, Artificial Sequence
  chemically synthesized
acattccttcaactagattagt

SEQ ID NO: 150352 - DNA, 22 bp, Artificial Sequence
  chemically synthesized
cttcaactagattagttgtgac

SEQ ID NO: 150353 - DNA, 22 bp, Artificial Sequence
  chemically synthesized
caactagattagttgtgacaaa

SEQ ID NO: 150354 - DNA, 22 bp, Artificial Sequence
  chemically synthesized
aactagattagttgtgacaaaa

SEQ ID NO: 150355 - DNA, 22 bp, Artificial Sequence
  chemically synthesized
gattagttgtgacaaaatttca

SEQ ID NO: 150356 - DNA, 22 bp, Artificial Sequence
  chemically synthesized
gttgtgacaaaatttcaggcct

SEQ ID NO: 150357 - DNA, 22 bp, Artificial Sequence
  chemically synthesized
tgacaaaatttcaggccttgct

SEQ ID NO: 150358 - DNA, 22 bp, Artificial Sequence
  chemically synthesized
caggccttgctcaactctaacc

SEQ ID NO: 150359 - DNA, 22 bp, Artificial Sequence
  chemically synthesized
aggccttgctcaactctaacct

SEQ ID NO: 150360 - DNA, 22 bp, Artificial Sequence
  chemically synthesized
gctcaactctaacctcagtctc

SEQ ID NO: 150361 - DNA, 22 bp, Artificial Sequence
  chemically synthesized
ctcaactctaacctcagtctct

SEQ ID NO: 150362 - DNA, 22 bp, Artificial Sequence
  chemically synthesized
aactctaacctcagtctctcca

SEQ ID NO: 150363 - DNA, 22 bp, Artificial Sequence
  chemically synthesized
taacctcagtctctccatatat

SEQ ID NO: 150364 - DNA, 22 bp, Artificial Sequence
  chemically synthesized
acctcagtctctccatatattt

SEQ ID NO: 150365 - DNA, 22 bp, Artificial Sequence
  chemically synthesized
agtctctccatatatttctgag

SEQ ID NO: 150366 - DNA, 22 bp, Artificial Sequence
  chemically synthesized
tccatatatttctgagagtctt

SEQ ID NO: 150367 - DNA, 22 bp, Artificial Sequence
  chemically synthesized
catatatttctgagagtcttcc

SEQ ID NO: 150368 - DNA, 22 bp, Artificial Sequence
  chemically synthesized
ctgagagtcttccttcttattt

SEQ ID NO: 150369 - DNA, 22 bp, Artificial Sequence
  chemically synthesized
tgagagtcttccttcttatttg

SEQ ID NO: 150370 - DNA, 22 bp, Artificial Sequence
  chemically synthesized
agagtcttccttcttatttgtt

SEQ ID NO: 150371 - DNA, 22 bp, Artificial Sequence
  chemically synthesized
ccttcttatttgtttataagaa

SEQ ID NO: 150372 - DNA, 22 bp, Artificial Sequence
  chemically synthesized
cttcttatttgtttataagaat

SEQ ID NO: 150373 - DNA, 22 bp, Artificial Sequence
  chemically synthesized
cttatttgtttataagaattta

SEQ ID NO: 150374 - DNA, 22 bp, Artificial Sequence
  chemically synthesized
ttatttgtttataagaatttag

SEQ ID NO: 150375 - DNA, 22 bp, Artificial Sequence
  chemically synthesized
atttgtttataagaatttagta

SEQ ID NO: 150376 - DNA, 22 bp, Artificial Sequence
  chemically synthesized
tttgtttataagaatttagtaa

SEQ ID NO: 150377 - DNA, 22 bp, Artificial Sequence
  chemically synthesized
gtttataagaatttagtaaatg

SEQ ID NO: 150378 - DNA, 22 bp, Artificial Sequence
  chemically synthesized
tttataagaatttagtaaatgg

SEQ ID NO: 150379 - DNA, 22 bp, Artificial Sequence
  chemically synthesized
ataagaatttagtaaatggcaa

SEQ ID NO: 150380 - DNA, 22 bp, Artificial Sequence
  chemically synthesized
taagaatttagtaaatggcaat

SEQ ID NO: 150381 - DNA, 22 bp, Artificial Sequence
  chemically synthesized
agtaaatggcaatattgagaag

SEQ ID NO: 150382 - DNA, 22 bp, Artificial Sequence
  chemically synthesized
gtaaatggcaatattgagaagt

SEQ ID NO: 150383 - DNA, 22 bp, Artificial Sequence
  chemically synthesized
agaagtagaaaattttggagac

SEQ ID NO: 150384 - DNA, 22 bp, Artificial Sequence
  chemically synthesized
tggagacttgtttttcatgaac

SEQ ID NO: 150385 - DNA, 22 bp, Artificial Sequence
  chemically synthesized
ggagacttgtttttcatgaacc

SEQ ID NO: 150386 - DNA, 22 bp, Artificial Sequence
  chemically synthesized
gagacttgtttttcatgaacca

SEQ ID NO: 150387 - DNA, 22 bp, Artificial Sequence
  chemically synthesized
gtttttcatgaaccagaacaat

SEQ ID NO: 150388 - DNA, 22 bp, Artificial Sequence
  chemically synthesized
tttttcatgaaccagaacaatc

SEQ ID NO: 150389 - DNA, 22 bp, Artificial Sequence
  chemically synthesized
ttcatgaaccagaacaatctca

SEQ ID NO: 150390 - DNA, 22 bp, Artificial Sequence
  chemically synthesized
tcatgaaccagaacaatctcaa

SEQ ID NO: 150391 - DNA, 22 bp, Artificial Sequence
  chemically synthesized
catgaaccagaacaatctcaaa

SEQ ID NO: 150392 - DNA, 22 bp, Artificial Sequence
  chemically synthesized
atgaaccagaacaatctcaaag

SEQ ID NO: 150393 - DNA, 22 bp, Artificial Sequence
  chemically synthesized
aaagcagcaatactaaacagga

SEQ ID NO: 150394 - DNA, 22 bp, Artificial Sequence
  chemically synthesized
aacaggagccaagcctagaata

SEQ ID NO: 150395 - DNA, 22 bp, Artificial Sequence
  chemically synthesized
gaataaagttgaatttctggaa

SEQ ID NO: 150396 - DNA, 22 bp, Artificial Sequence
  chemically synthesized
aatttctggaatcaacaagcta

SEQ ID NO: 150397 - DNA, 22 bp, Artificial Sequence
  chemically synthesized
ctggaatcaacaagctagggga

SEQ ID NO: 150398 - DNA, 22 bp, Artificial Sequence
  chemically synthesized
tggaatcaacaagctaggggaa

SEQ ID NO: 150399 - DNA, 22 bp, Artificial Sequence
  chemically synthesized
gaatcaacaagctaggggaaag

SEQ ID NO: 150400 - DNA, 22 bp, Artificial Sequence
  chemically synthesized
ggggaaagtctcccattaagtc

SEQ ID NO: 150401 - DNA, 22 bp, Artificial Sequence
  chemically synthesized
ccattaagtcaaatatttgaca

SEQ ID NO: 150402 - DNA, 22 bp, Artificial Sequence
  chemically synthesized
agtcaaatatttgacaactggg

SEQ ID NO: 150403 - DNA, 22 bp, Artificial Sequence
  chemically synthesized
gacaactgggaggtcaagtcag

SEQ ID NO: 150404 - DNA, 22 bp, Artificial Sequence
  chemically synthesized
acaactgggaggtcaagtcaga

SEQ ID NO: 150405 - DNA, 22 bp, Artificial Sequence
  chemically synthesized
ggaggtcaagtcagaggtgaaa

SEQ ID NO: 150406 - DNA, 22 bp, Artificial Sequence
  chemically synthesized
aagataacaagaggtctgaaaa

SEQ ID NO: 150407 - DNA, 22 bp, Artificial Sequence
  chemically synthesized
aaaacaaagtgaccaattaaaa

SEQ ID NO: 150408 - DNA, 22 bp, Artificial Sequence
  chemically synthesized
aaataaaaagaaagagccaagc

SEQ ID NO: 150409 - DNA, 22 bp, Artificial Sequence
  chemically synthesized
ggcacagtggcttgcatctgta

SEQ ID NO: 150410 - DNA, 22 bp, Artificial Sequence
  chemically synthesized
gcatctgtagtcccagtaaccc

SEQ ID NO: 150411 - DNA, 22 bp, Artificial Sequence
  chemically synthesized
catctgtagtcccagtaaccca

SEQ ID NO: 150412 - DNA, 22 bp, Artificial Sequence
  chemically synthesized
tagtcccagtaacccaggaggc

SEQ ID NO: 150413 - DNA, 22 bp, Artificial Sequence
  chemically synthesized
aagtgataggatcacttgagcc

SEQ ID NO: 150414 - DNA, 22 bp, Artificial Sequence
  chemically synthesized
gagcccaggatttcagggttgc

SEQ ID NO: 150415 - DNA, 22 bp, Artificial Sequence
  chemically synthesized
agcccaggatttcagggttgca

SEQ ID NO: 150416 - DNA, 22 bp, Artificial Sequence
  chemically synthesized
cagggttgcagtgagcaataat

SEQ ID NO: 150417 - DNA, 22 bp, Artificial Sequence
  chemically synthesized
agggttgcagtgagcaataatg

SEQ ID NO: 150418 - DNA, 22 bp, Artificial Sequence
  chemically synthesized
cagtgagcaataatgacaccac

SEQ ID NO: 150419 - DNA, 22 bp, Artificial Sequence
  chemically synthesized
ctctctagccttggtgactgag

SEQ ID NO: 150420 - DNA, 22 bp, Artificial Sequence
  chemically synthesized
tctagccttggtgactgagatc

SEQ ID NO: 150421 - DNA, 22 bp, Artificial Sequence
  chemically synthesized
tagccttggtgactgagatcct

SEQ ID NO: 150422 - DNA, 22 bp, Artificial Sequence
  chemically synthesized
gccttggtgactgagatcctgt

SEQ ID NO: 150423 - DNA, 22 bp, Artificial Sequence
  chemically synthesized
ggtgactgagatcctgtctctg

SEQ ID NO: 150424 - DNA, 22 bp, Artificial Sequence
  chemically synthesized
gtgactgagatcctgtctctga

SEQ ID NO: 150425 - DNA, 22 bp, Artificial Sequence
  chemically synthesized
agatcctgtctctgaggaaaaa

SEQ ID NO: 150426 - DNA, 22 bp, Artificial Sequence
  chemically synthesized
tctctgaggaaaaacaaacaaa

SEQ ID NO: 150427 - DNA, 22 bp, Artificial Sequence
  chemically synthesized
tgaggaaaaacaaacaaacaag

SEQ ID NO: 150428 - DNA, 22 bp, Artificial Sequence
  chemically synthesized
aggaaaaacaaacaaacaagca

SEQ ID NO: 150429 - DNA, 22 bp, Artificial Sequence
  chemically synthesized
agaacatagaagttttgttacg

SEQ ID NO: 150430 - DNA, 22 bp, Artificial Sequence
  chemically synthesized
tgttacggtgatgatattctcc

SEQ ID NO: 150431 - DNA, 22 bp, Artificial Sequence
  chemically synthesized
gttacggtgatgatattctcca

SEQ ID NO: 150432 - DNA, 22 bp, Artificial Sequence
  chemically synthesized
ttacggtgatgatattctccaa

SEQ ID NO: 150433 - DNA, 22 bp, Artificial Sequence
  chemically synthesized
cggtgatgatattctccaacac

SEQ ID NO: 150434 - DNA, 22 bp, Artificial Sequence
  chemically synthesized
tccaacacaggtctgaacccct

SEQ ID NO: 150435 - DNA, 22 bp, Artificial Sequence
  chemically synthesized
caacacaggtctgaaccccttg

SEQ ID NO: 150436 - DNA, 22 bp, Artificial Sequence
  chemically synthesized
aaccccttgcagtgcctcgggg

SEQ ID NO: 150437 - DNA, 22 bp, Artificial Sequence
  chemically synthesized
gcagtgcctcggggctgtttct

SEQ ID NO: 150438 - DNA, 22 bp, Artificial Sequence
  chemically synthesized
cagtgcctcggggctgtttctc

SEQ ID NO: 150439 - DNA, 22 bp, Artificial Sequence
  chemically synthesized
ggggctgtttctccagtggatt

SEQ ID NO: 150440 - DNA, 22 bp, Artificial Sequence
  chemically synthesized
tttctccagtggattcttgggt

SEQ ID NO: 150441 - DNA, 22 bp, Artificial Sequence
  chemically synthesized
ctccagtggattcttgggttct

SEQ ID NO: 150442 - DNA, 22 bp, Artificial Sequence
  chemically synthesized
tccagtggattcttgggttctt

SEQ ID NO: 150443 - DNA, 22 bp, Artificial Sequence
  chemically synthesized
cagtggattcttgggttcttca

SEQ ID NO: 150444 - DNA, 22 bp, Artificial Sequence
  chemically synthesized
ttgggttcttcacatcttctca

SEQ ID NO: 150445 - DNA, 22 bp, Artificial Sequence
  chemically synthesized
gggttcttcacatcttctcaac

SEQ ID NO: 150446 - DNA, 22 bp, Artificial Sequence
  chemically synthesized
ggttcttcacatcttctcaact

SEQ ID NO: 150447 - DNA, 22 bp, Artificial Sequence
  chemically synthesized
ttcacatcttctcaactttgtg

SEQ ID NO: 150448 - DNA, 22 bp, Artificial Sequence
  chemically synthesized
cacatcttctcaactttgtgaa

SEQ ID NO: 150449 - DNA, 22 bp, Artificial Sequence
  chemically synthesized
acatcttctcaactttgtgaaa

SEQ ID NO: 150450 - DNA, 22 bp, Artificial Sequence
  chemically synthesized
ctcaactttgtgaaaagatatt

SEQ ID NO: 150451 - DNA, 22 bp, Artificial Sequence
  chemically synthesized
tcaactttgtgaaaagatattc

SEQ ID NO: 150452 - DNA, 22 bp, Artificial Sequence
  chemically synthesized
aactttgtgaaaagatattcat

SEQ ID NO: 150453 - DNA, 22 bp, Artificial Sequence
  chemically synthesized
tgtgaaaagatattcatccaaa

SEQ ID NO: 150454 - DNA, 22 bp, Artificial Sequence
  chemically synthesized
gtgaaaagatattcatccaaag

SEQ ID NO: 150455 - DNA, 22 bp, Artificial Sequence
  chemically synthesized
tgaaaagatattcatccaaagg

SEQ ID NO: 150456 - DNA, 22 bp, Artificial Sequence
  chemically synthesized
atccaaaggtctcacctgtctt

SEQ ID NO: 150457 - DNA, 22 bp, Artificial Sequence
  chemically synthesized
acctgtcttattcagagcttgg

SEQ ID NO: 150458 - DNA, 22 bp, Artificial Sequence
  chemically synthesized
tcttattcagagcttggatttt

SEQ ID NO: 150459 - DNA, 22 bp, Artificial Sequence
  chemically synthesized
attcagagcttggattttggac

SEQ ID NO: 150460 - DNA, 22 bp, Artificial Sequence
  chemically synthesized
ttcagagcttggattttggact

SEQ ID NO: 150461 - DNA, 22 bp, Artificial Sequence
  chemically synthesized
agagcttggattttggactagc

SEQ ID NO: 150462 - DNA, 22 bp, Artificial Sequence
  chemically synthesized
ggattttggactagctttttct

SEQ ID NO: 150463 - DNA, 22 bp, Artificial Sequence
  chemically synthesized
gattttggactagctttttcta

SEQ ID NO: 150464 - DNA, 22 bp, Artificial Sequence
  chemically synthesized
tggactagctttttctatttct

SEQ ID NO: 150465 - DNA, 22 bp, Artificial Sequence
  chemically synthesized
ggactagctttttctatttctt

SEQ ID NO: 150466 - DNA, 22 bp, Artificial Sequence
  chemically synthesized
gactagctttttctatttcttg

SEQ ID NO: 150467 - DNA, 22 bp, Artificial Sequence
  chemically synthesized
gctttttctatttcttgggatt

SEQ ID NO: 150468 - DNA, 22 bp, Artificial Sequence
  chemically synthesized
tttctatttcttgggattctct

SEQ ID NO: 150469 - DNA, 22 bp, Artificial Sequence
  chemically synthesized
ttctatttcttgggattctcta

SEQ ID NO: 150470 - DNA, 22 bp, Artificial Sequence
  chemically synthesized
tctatttcttgggattctctag

SEQ ID NO: 150471 - DNA, 22 bp, Artificial Sequence
  chemically synthesized
ctatttcttgggattctctaga

SEQ ID NO: 150472 - DNA, 22 bp, Artificial Sequence
  chemically synthesized
tatttcttgggattctctagag

SEQ ID NO: 150473 - DNA, 22 bp, Artificial Sequence
  chemically synthesized
tttcttgggattctctagagcc

SEQ ID NO: 150474 - DNA, 22 bp, Artificial Sequence
  chemically synthesized
cttgggattctctagagccata

SEQ ID NO: 150475 - DNA, 22 bp, Artificial Sequence
  chemically synthesized
ttgggattctctagagccatat

SEQ ID NO: 150476 - DNA, 22 bp, Artificial Sequence
  chemically synthesized
gggattctctagagccatatat

SEQ ID NO: 150477 - DNA, 22 bp, Artificial Sequence
  chemically synthesized
ggattctctagagccatatatt

SEQ ID NO: 150478 - DNA, 22 bp, Artificial Sequence
  chemically synthesized
tctagagccatatattcagata

SEQ ID NO: 150479 - DNA, 22 bp, Artificial Sequence
  chemically synthesized
tagagccatatattcagatata

SEQ ID NO: 150480 - DNA, 22 bp, Artificial Sequence
  chemically synthesized
gagccatatattcagatataac

SEQ ID NO: 150481 - DNA, 22 bp, Artificial Sequence
  chemically synthesized
agatataacacagatataacca

SEQ ID NO: 150482 - DNA, 22 bp, Artificial Sequence
  chemically synthesized
tgtattctggggagggggacat

SEQ ID NO: 150483 - DNA, 22 bp, Artificial Sequence
  chemically synthesized
gtattctggggagggggacata

SEQ ID NO: 150484 - DNA, 22 bp, Artificial Sequence
  chemically synthesized
tattctggggagggggacatag

SEQ ID NO: 150485 - DNA, 22 bp, Artificial Sequence
  chemically synthesized
tggggagggggacatagagttg

SEQ ID NO: 150486 - DNA, 22 bp, Artificial Sequence
  chemically synthesized
gggagggggacatagagttgag

SEQ ID NO: 150487 - DNA, 22 bp, Artificial Sequence
  chemically synthesized
agagaaatacaggaatttatag

SEQ ID NO: 150488 - DNA, 22 bp, Artificial Sequence
  chemically synthesized
ataggactctactcaaagagcc

SEQ ID NO: 150489 - DNA, 22 bp, Artificial Sequence
  chemically synthesized
taggactctactcaaagagccc

SEQ ID NO: 150490 - DNA, 22 bp, Artificial Sequence
  chemically synthesized
tactcaaagagccctcaaataa

SEQ ID NO: 150491 - DNA, 22 bp, Artificial Sequence
  chemically synthesized
ctcaaagagccctcaaataaag

SEQ ID NO: 150492 - DNA, 22 bp, Artificial Sequence
  chemically synthesized
aaagagccctcaaataaagtac

SEQ ID NO: 150493 - DNA, 22 bp, Artificial Sequence
  chemically synthesized
aaataaagtacggctagtcttc

SEQ ID NO: 150494 - DNA, 22 bp, Artificial Sequence
  chemically synthesized
gtcttctttgcctaagacaatg

SEQ ID NO: 150495 - DNA, 22 bp, Artificial Sequence
  chemically synthesized
ctttgcctaagacaatgagcag

SEQ ID NO: 150496 - DNA, 22 bp, Artificial Sequence
  chemically synthesized
tttgcctaagacaatgagcagt

SEQ ID NO: 150497 - DNA, 22 bp, Artificial Sequence
  chemically synthesized
tgcctaagacaatgagcagtcc

SEQ ID NO: 150498 - DNA, 22 bp, Artificial Sequence
  chemically synthesized
gcctaagacaatgagcagtcca

SEQ ID NO: 150499 - DNA, 22 bp, Artificial Sequence
  chemically synthesized
cctaagacaatgagcagtccag

SEQ ID NO: 150500 - DNA, 22 bp, Artificial Sequence
  chemically synthesized
agacaatgagcagtccaggaag

SEQ ID NO: 150501 - DNA, 22 bp, Artificial Sequence
  chemically synthesized
tccatttcttttagattttcta

SEQ ID NO: 150502 - DNA, 22 bp, Artificial Sequence
  chemically synthesized
cttttagattttctagtttatg

SEQ ID NO: 150503 - DNA, 22 bp, Artificial Sequence
  chemically synthesized
ttttagattttctagtttatgt

SEQ ID NO: 150504 - DNA, 22 bp, Artificial Sequence
  chemically synthesized
ttagattttctagtttatgtac

SEQ ID NO: 150505 - DNA, 22 bp, Artificial Sequence
  chemically synthesized
tagattttctagtttatgtaca

SEQ ID NO: 150506 - DNA, 22 bp, Artificial Sequence
  chemically synthesized
agattttctagtttatgtacat

SEQ ID NO: 150507 - DNA, 22 bp, Artificial Sequence
  chemically synthesized
gattttctagtttatgtacata

SEQ ID NO: 150508 - DNA, 22 bp, Artificial Sequence
  chemically synthesized
tctagtttatgtacatagagat

SEQ ID NO: 150509 - DNA, 22 bp, Artificial Sequence
  chemically synthesized
ctagtttatgtacatagagatg

SEQ ID NO: 150510 - DNA, 22 bp, Artificial Sequence
  chemically synthesized
tagtttatgtacatagagatgt

SEQ ID NO: 150511 - DNA, 22 bp, Artificial Sequence
  chemically synthesized
gtttatgtacatagagatgttc

SEQ ID NO: 150512 - DNA, 22 bp, Artificial Sequence
  chemically synthesized
atgtacatagagatgttcatag

SEQ ID NO: 150513 - DNA, 22 bp, Artificial Sequence
  chemically synthesized
tgtacatagagatgttcatagt

SEQ ID NO: 150514 - DNA, 22 bp, Artificial Sequence
  chemically synthesized
atagtagtttttgatgattatt

SEQ ID NO: 150515 - DNA, 22 bp, Artificial Sequence
  chemically synthesized
ttgatgattatttgtatttctg

SEQ ID NO: 150516 - DNA, 22 bp, Artificial Sequence
  chemically synthesized
tgatgattatttgtatttctgt

SEQ ID NO: 150517 - DNA, 22 bp, Artificial Sequence
  chemically synthesized
gatgattatttgtatttctgtg

SEQ ID NO: 150518 - DNA, 22 bp, Artificial Sequence
  chemically synthesized
atgattatttgtatttctgtgg

SEQ ID NO: 150519 - DNA, 22 bp, Artificial Sequence
  chemically synthesized
tttgtatttctgtggggtgagt

SEQ ID NO: 150520 - DNA, 22 bp, Artificial Sequence
  chemically synthesized
gtatttctgtggggtgagtgat

SEQ ID NO: 150521 - DNA, 22 bp, Artificial Sequence
  chemically synthesized
tatttctgtggggtgagtgata

SEQ ID NO: 150522 - DNA, 22 bp, Artificial Sequence
  chemically synthesized
ctgtggggtgagtgataatatt

SEQ ID NO: 150523 - DNA, 22 bp, Artificial Sequence
  chemically synthesized
tgtggggtgagtgataatattc

SEQ ID NO: 150524 - DNA, 22 bp, Artificial Sequence
  chemically synthesized
tggggtgagtgataatattccc

SEQ ID NO: 150525 - DNA, 22 bp, Artificial Sequence
  chemically synthesized
cctttttcatttctaactgtgc

SEQ ID NO: 150526 - DNA, 22 bp, Artificial Sequence
  chemically synthesized
tttcatttctaactgtgcttat

SEQ ID NO: 150527 - DNA, 22 bp, Artificial Sequence
  chemically synthesized
ttcatttctaactgtgcttatt

SEQ ID NO: 150528 - DNA, 22 bp, Artificial Sequence
  chemically synthesized
tcatttctaactgtgcttattt

SEQ ID NO: 150529 - DNA, 22 bp, Artificial Sequence
  chemically synthesized
catttctaactgtgcttatttg

SEQ ID NO: 150530 - DNA, 22 bp, Artificial Sequence
  chemically synthesized
atttctaactgtgcttatttgg

SEQ ID NO: 150531 - DNA, 22 bp, Artificial Sequence
  chemically synthesized
ctaactgtgcttatttggatct

SEQ ID NO: 150532 - DNA, 22 bp, Artificial Sequence
  chemically synthesized
taactgtgcttatttggatctt

SEQ ID NO: 150533 - DNA, 22 bp, Artificial Sequence
  chemically synthesized
actgtgcttatttggatcttct

SEQ ID NO: 150534 - DNA, 22 bp, Artificial Sequence
  chemically synthesized
tgcttatttggatcttctctct

SEQ ID NO: 150535 - DNA, 22 bp, Artificial Sequence
  chemically synthesized
atttggatcttctctcttgtct

SEQ ID NO: 150536 - DNA, 22 bp, Artificial Sequence
  chemically synthesized
tttggatcttctctcttgtctt

SEQ ID NO: 150537 - DNA, 22 bp, Artificial Sequence
  chemically synthesized
ggatcttctctcttgtcttctt

SEQ ID NO: 150538 - DNA, 22 bp, Artificial Sequence
  chemically synthesized
gatcttctctcttgtcttcttt

SEQ ID NO: 150539 - DNA, 22 bp, Artificial Sequence
  chemically synthesized
ctctcttgtcttctttattagt

SEQ ID NO: 150540 - DNA, 22 bp, Artificial Sequence
  chemically synthesized
tctcttgtcttctttattagtc

SEQ ID NO: 150541 - DNA, 22 bp, Artificial Sequence
  chemically synthesized
tcttgtcttctttattagtcta

SEQ ID NO: 150542 - DNA, 22 bp, Artificial Sequence
  chemically synthesized
ttgtcttctttattagtctagc

SEQ ID NO: 150543 - DNA, 22 bp, Artificial Sequence
  chemically synthesized
gtcttctttattagtctagcta

SEQ ID NO: 150544 - DNA, 22 bp, Artificial Sequence
  chemically synthesized
tcttctttattagtctagctag

SEQ ID NO: 150545 - DNA, 22 bp, Artificial Sequence
  chemically synthesized
ctttattagtctagctagtgat

SEQ ID NO: 150546 - DNA, 22 bp, Artificial Sequence
  chemically synthesized
tttattagtctagctagtgatc

SEQ ID NO: 150547 - DNA, 22 bp, Artificial Sequence
  chemically synthesized
tattagtctagctagtgatcta

SEQ ID NO: 150548 - DNA, 22 bp, Artificial Sequence
  chemically synthesized
attagtctagctagtgatctac

SEQ ID NO: 150549 - DNA, 22 bp, Artificial Sequence
  chemically synthesized
ttagtctagctagtgatctacc

SEQ ID NO: 150550 - DNA, 22 bp, Artificial Sequence
  chemically synthesized
gtctagctagtgatctacctta

SEQ ID NO: 150551 - DNA, 22 bp, Artificial Sequence
  chemically synthesized
gctagtgatctaccttattaat

SEQ ID NO: 150552 - DNA, 22 bp, Artificial Sequence
  chemically synthesized
gtgatctaccttattaattttt

SEQ ID NO: 150553 - DNA, 22 bp, Artificial Sequence
  chemically synthesized
ccttattaattttttcacaaaa

SEQ ID NO: 150554 - DNA, 22 bp, Artificial Sequence
  chemically synthesized
attaattttttcacaaaaccag

SEQ ID NO: 150555 - DNA, 22 bp, Artificial Sequence
  chemically synthesized
ttaattttttcacaaaaccagc

SEQ ID NO: 150556 - DNA, 22 bp, Artificial Sequence
  chemically synthesized
attttttcacaaaaccagctct

SEQ ID NO: 150557 - DNA, 22 bp, Artificial Sequence
  chemically synthesized
tttcacaaaaccagctcttgga

SEQ ID NO: 150558 - DNA, 22 bp, Artificial Sequence
  chemically synthesized
ttcacaaaaccagctcttggac

SEQ ID NO: 150559 - DNA, 22 bp, Artificial Sequence
  chemically synthesized
tcacaaaaccagctcttggact

SEQ ID NO: 150560 - DNA, 22 bp, Artificial Sequence
  chemically synthesized
cacaaaaccagctcttggactc

SEQ ID NO: 150561 - DNA, 22 bp, Artificial Sequence
  chemically synthesized
acaaaaccagctcttggactca

SEQ ID NO: 150562 - DNA, 22 bp, Artificial Sequence
  chemically synthesized
ttggactcattaatcttttgaa

SEQ ID NO: 150563 - DNA, 22 bp, Artificial Sequence
  chemically synthesized
ggactcattaatcttttgaatg

SEQ ID NO: 150564 - DNA, 22 bp, Artificial Sequence
  chemically synthesized
gactcattaatcttttgaatgg

SEQ ID NO: 150565 - DNA, 22 bp, Artificial Sequence
  chemically synthesized
attaatcttttgaatggtattt

SEQ ID NO: 150566 - DNA, 22 bp, Artificial Sequence
  chemically synthesized
atcttttgaatggtattttgtg

SEQ ID NO: 150567 - DNA, 22 bp, Artificial Sequence
  chemically synthesized
ttgaatggtattttgtgtttta

SEQ ID NO: 150568 - DNA, 22 bp, Artificial Sequence
  chemically synthesized
tgaatggtattttgtgttttaa

SEQ ID NO: 150569 - DNA, 22 bp, Artificial Sequence
  chemically synthesized
gaatggtattttgtgttttaat

SEQ ID NO: 150570 - DNA, 22 bp, Artificial Sequence
  chemically synthesized
aatggtattttgtgttttaata

SEQ ID NO: 150571 - DNA, 22 bp, Artificial Sequence
  chemically synthesized
tgtgttttaatatccttcagtt

SEQ ID NO: 150572 - DNA, 22 bp, Artificial Sequence
  chemically synthesized
gtgttttaatatccttcagtta

SEQ ID NO: 150573 - DNA, 22 bp, Artificial Sequence
  chemically synthesized
tgttttaatatccttcagttag

SEQ ID NO: 150574 - DNA, 22 bp, Artificial Sequence
  chemically synthesized
taatatccttcagttagctttg

SEQ ID NO: 150575 - DNA, 22 bp, Artificial Sequence
  chemically synthesized
aatatccttcagttagctttga

SEQ ID NO: 150576 - DNA, 22 bp, Artificial Sequence
  chemically synthesized
atatccttcagttagctttgat

SEQ ID NO: 150577 - DNA, 22 bp, Artificial Sequence
  chemically synthesized
cagttagctttgatcttgttta

SEQ ID NO: 150578 - DNA, 22 bp, Artificial Sequence
  chemically synthesized
agttagctttgatcttgtttat

SEQ ID NO: 150579 - DNA, 22 bp, Artificial Sequence
  chemically synthesized
gctttgatcttgtttatttctt

SEQ ID NO: 150580 - DNA, 22 bp, Artificial Sequence
  chemically synthesized
tgatcttgtttatttcttgtct

SEQ ID NO: 150581 - DNA, 22 bp, Artificial Sequence
  chemically synthesized
gatcttgtttatttcttgtctt

SEQ ID NO: 150582 - DNA, 22 bp, Artificial Sequence
  chemically synthesized
atcttgtttatttcttgtcttc

SEQ ID NO: 150583 - DNA, 22 bp, Artificial Sequence
  chemically synthesized
gtttatttcttgtcttctgcta

SEQ ID NO: 150584 - DNA, 22 bp, Artificial Sequence
  chemically synthesized
tttatttcttgtcttctgctag

SEQ ID NO: 150585 - DNA, 22 bp, Artificial Sequence
  chemically synthesized
atttcttgtcttctgctagatt

SEQ ID NO: 150586 - DNA, 22 bp, Artificial Sequence
  chemically synthesized
tttcttgtcttctgctagattt

SEQ ID NO: 150587 - DNA, 22 bp, Artificial Sequence
  chemically synthesized
cttgtcttctgctagatttagg

SEQ ID NO: 150588 - DNA, 22 bp, Artificial Sequence
  chemically synthesized
ttgtcttctgctagatttaggg

SEQ ID NO: 150589 - DNA, 22 bp, Artificial Sequence
  chemically synthesized
gtcttctgctagatttagggtt

SEQ ID NO: 150590 - DNA, 22 bp, Artificial Sequence
  chemically synthesized
tcttctgctagatttagggttg

SEQ ID NO: 150591 - DNA, 22 bp, Artificial Sequence
  chemically synthesized
ctgctagatttagggttggttt

SEQ ID NO: 150592 - DNA, 22 bp, Artificial Sequence
  chemically synthesized
tgctagatttagggttggtttg

SEQ ID NO: 150593 - DNA, 22 bp, Artificial Sequence
  chemically synthesized
ctagatttagggttggtttgct

SEQ ID NO: 150594 - DNA, 22 bp, Artificial Sequence
  chemically synthesized
gatttagggttggtttgctctt

SEQ ID NO: 150595 - DNA, 22 bp, Artificial Sequence
  chemically synthesized
agggttggtttgctcttggttc

SEQ ID NO: 150596 - DNA, 22 bp, Artificial Sequence
  chemically synthesized
gggttggtttgctcttggttct

SEQ ID NO: 150597 - DNA, 22 bp, Artificial Sequence
  chemically synthesized
gtttgctcttggttctctggtt

SEQ ID NO: 150598 - DNA, 22 bp, Artificial Sequence
  chemically synthesized
gctcttggttctctggttcttt

SEQ ID NO: 150599 - DNA, 22 bp, Artificial Sequence
  chemically synthesized
ctcttggttctctggttctttt

SEQ ID NO: 150600 - DNA, 22 bp, Artificial Sequence
  chemically synthesized
ttggttctctggttcttttagt

SEQ ID NO: 150601 - DNA, 22 bp, Artificial Sequence
  chemically synthesized
ggttctctggttcttttagttg

SEQ ID NO: 150602 - DNA, 22 bp, Artificial Sequence
  chemically synthesized
gttctctggttcttttagttgt

SEQ ID NO: 150603 - DNA, 22 bp, Artificial Sequence
  chemically synthesized
tctggttcttttagttgtgaca

SEQ ID NO: 150604 - DNA, 22 bp, Artificial Sequence
  chemically synthesized
tggttcttttagttgtgacatt

SEQ ID NO: 150605 - DNA, 22 bp, Artificial Sequence
  chemically synthesized
gttcttttagttgtgacattag

SEQ ID NO: 150606 - DNA, 22 bp, Artificial Sequence
  chemically synthesized
ttttagttgtgacattaggttg

SEQ ID NO: 150607 - DNA, 22 bp, Artificial Sequence
  chemically synthesized
ttagttgtgacattaggttgtt

SEQ ID NO: 150608 - DNA, 22 bp, Artificial Sequence
  chemically synthesized
tagttgtgacattaggttgtta

SEQ ID NO: 150609 - DNA, 22 bp, Artificial Sequence
  chemically synthesized
agttgtgacattaggttgttaa

SEQ ID NO: 150610 - DNA, 22 bp, Artificial Sequence
  chemically synthesized
gttgtgacattaggttgttaat

SEQ ID NO: 150611 - DNA, 22 bp, Artificial Sequence
  chemically synthesized
tgacattaggttgttaatttga

SEQ ID NO: 150612 - DNA, 22 bp, Artificial Sequence
  chemically synthesized
ggttgttaatttgagggcttta

SEQ ID NO: 150613 - DNA, 22 bp, Artificial Sequence
  chemically synthesized
ttaatttgagggctttaagact

SEQ ID NO: 150614 - DNA, 22 bp, Artificial Sequence
  chemically synthesized
atttgagggctttaagactttt

SEQ ID NO: 150615 - DNA, 22 bp, Artificial Sequence
  chemically synthesized
gagggctttaagactttttgat

SEQ ID NO: 150616 - DNA, 22 bp, Artificial Sequence
  chemically synthesized
agggctttaagactttttgatg

SEQ ID NO: 150617 - DNA, 22 bp, Artificial Sequence
  chemically synthesized
taagactttttgatgtgggcat

SEQ ID NO: 150618 - DNA, 22 bp, Artificial Sequence
  chemically synthesized
aagactttttgatgtgggcatt

SEQ ID NO: 150619 - DNA, 22 bp, Artificial Sequence
  chemically synthesized
agactttttgatgtgggcattt

SEQ ID NO: 150620 - DNA, 22 bp, Artificial Sequence
  chemically synthesized
tttgatgtgggcatttagtgta

SEQ ID NO: 150621 - DNA, 22 bp, Artificial Sequence
  chemically synthesized
ttgatgtgggcatttagtgtat

SEQ ID NO: 150622 - DNA, 22 bp, Artificial Sequence
  chemically synthesized
tgatgtgggcatttagtgtata

SEQ ID NO: 150623 - DNA, 22 bp, Artificial Sequence
  chemically synthesized
gatgtgggcatttagtgtataa

SEQ ID NO: 150624 - DNA, 22 bp, Artificial Sequence
  chemically synthesized
atgtgggcatttagtgtataaa

SEQ ID NO: 150625 - DNA, 22 bp, Artificial Sequence
  chemically synthesized
agtgtataaatttctctcttaa

SEQ ID NO: 150626 - DNA, 22 bp, Artificial Sequence
  chemically synthesized
gtgtataaatttctctcttaac

SEQ ID NO: 150627 - DNA, 22 bp, Artificial Sequence
  chemically synthesized
ctctcttaacactgtctaagct

SEQ ID NO: 150628 - DNA, 22 bp, Artificial Sequence
  chemically synthesized
tctcttaacactgtctaagctg

SEQ ID NO: 150629 - DNA, 22 bp, Artificial Sequence
  chemically synthesized
tcttaacactgtctaagctgtg

SEQ ID NO: 150630 - DNA, 22 bp, Artificial Sequence
  chemically synthesized
ttaacactgtctaagctgtgtc

SEQ ID NO: 150631 - DNA, 22 bp, Artificial Sequence
  chemically synthesized
aacactgtctaagctgtgtccc

SEQ ID NO: 150632 - DNA, 22 bp, Artificial Sequence
  chemically synthesized
acactgtctaagctgtgtccca

SEQ ID NO: 150633 - DNA, 22 bp, Artificial Sequence
  chemically synthesized
tctaagctgtgtcccagagatt

SEQ ID NO: 150634 - DNA, 22 bp, Artificial Sequence
  chemically synthesized
agctgtgtcccagagattccgg

SEQ ID NO: 150635 - DNA, 22 bp, Artificial Sequence
  chemically synthesized
tgtcccagagattccggtatat

SEQ ID NO: 150636 - DNA, 22 bp, Artificial Sequence
  chemically synthesized
cggtatattgtatctttgttct

SEQ ID NO: 150637 - DNA, 22 bp, Artificial Sequence
  chemically synthesized
tatctttgttctcattagtttc

SEQ ID NO: 150638 - DNA, 22 bp, Artificial Sequence
  chemically synthesized
tgttctcattagtttcaaagaa

SEQ ID NO: 150639 - DNA, 22 bp, Artificial Sequence
  chemically synthesized
gttctcattagtttcaaagaac

SEQ ID NO: 150640 - DNA, 22 bp, Artificial Sequence
  chemically synthesized
ttctcattagtttcaaagaact

SEQ ID NO: 150641 - DNA, 22 bp, Artificial Sequence
  chemically synthesized
tcattagtttcaaagaactatt

SEQ ID NO: 150642 - DNA, 22 bp, Artificial Sequence
  chemically synthesized
attagtttcaaagaactatttt

SEQ ID NO: 150643 - DNA, 22 bp, Artificial Sequence
  chemically synthesized
gtttcaaagaactattttattt

SEQ ID NO: 150644 - DNA, 22 bp, Artificial Sequence
  chemically synthesized
caaagaactattttatttttgc

SEQ ID NO: 150645 - DNA, 22 bp, Artificial Sequence
  chemically synthesized
aaagaactattttatttttgcc

SEQ ID NO: 150646 - DNA, 22 bp, Artificial Sequence
  chemically synthesized
ttttatttttgccttagttttc

SEQ ID NO: 150647 - DNA, 22 bp, Artificial Sequence
  chemically synthesized
tatttttgccttagttttcatt

SEQ ID NO: 150648 - DNA, 22 bp, Artificial Sequence
  chemically synthesized
atttttgccttagttttcatta

SEQ ID NO: 150649 - DNA, 22 bp, Artificial Sequence
  chemically synthesized
tttttgccttagttttcattat

SEQ ID NO: 150650 - DNA, 22 bp, Artificial Sequence
  chemically synthesized
ttgccttagttttcattattta

SEQ ID NO: 150651 - DNA, 22 bp, Artificial Sequence
  chemically synthesized
tgccttagttttcattatttac

SEQ ID NO: 150652 - DNA, 22 bp, Artificial Sequence
  chemically synthesized
gccttagttttcattatttacc

SEQ ID NO: 150653 - DNA, 22 bp, Artificial Sequence
  chemically synthesized
ccttagttttcattatttaccc

SEQ ID NO: 150654 - DNA, 22 bp, Artificial Sequence
  chemically synthesized
agttttcattatttacccaaaa

SEQ ID NO: 150655 - DNA, 22 bp, Artificial Sequence
  chemically synthesized
gttttcattatttacccaaaat

SEQ ID NO: 150656 - DNA, 22 bp, Artificial Sequence
  chemically synthesized
tcattatttacccaaaattcat

SEQ ID NO: 150657 - DNA, 22 bp, Artificial Sequence
  chemically synthesized
cattatttacccaaaattcatt

SEQ ID NO: 150658 - DNA, 22 bp, Artificial Sequence
  chemically synthesized
attatttacccaaaattcattc

SEQ ID NO: 150659 - DNA, 22 bp, Artificial Sequence
  chemically synthesized
tttacccaaaattcattcagga

SEQ ID NO: 150660 - DNA, 22 bp, Artificial Sequence
  chemically synthesized
acccaaaattcattcaggagca

SEQ ID NO: 150661 - DNA, 22 bp, Artificial Sequence
  chemically synthesized
cccaaaattcattcaggagcag

SEQ ID NO: 150662 - DNA, 22 bp, Artificial Sequence
  chemically synthesized
attcaggagcaggttgtttaat

SEQ ID NO: 150663 - DNA, 22 bp, Artificial Sequence
  chemically synthesized
aggagcaggttgtttaatttcc

SEQ ID NO: 150664 - DNA, 22 bp, Artificial Sequence
  chemically synthesized
tttaatttccatgtaattgcat

SEQ ID NO: 150665 - DNA, 22 bp, Artificial Sequence
  chemically synthesized
aatttccatgtaattgcatagt

SEQ ID NO: 150666 - DNA, 22 bp, Artificial Sequence
  chemically synthesized
atttccatgtaattgcatagtt

SEQ ID NO: 150667 - DNA, 22 bp, Artificial Sequence
  chemically synthesized
ccatgtaattgcatagttttca

SEQ ID NO: 150668 - DNA, 22 bp, Artificial Sequence
  chemically synthesized
catgtaattgcatagttttcag

SEQ ID NO: 150669 - DNA, 22 bp, Artificial Sequence
  chemically synthesized
catagttttcagctattcatta

SEQ ID NO: 150670 - DNA, 22 bp, Artificial Sequence
  chemically synthesized
tcagctattcattagtcttgaa

SEQ ID NO: 150671 - DNA, 22 bp, Artificial Sequence
  chemically synthesized
cagctattcattagtcttgaaa

SEQ ID NO: 150672 - DNA, 22 bp, Artificial Sequence
  chemically synthesized
agctattcattagtcttgaaat

SEQ ID NO: 150673 - DNA, 22 bp, Artificial Sequence
  chemically synthesized
ttcattagtcttgaaatctatt

SEQ ID NO: 150674 - DNA, 22 bp, Artificial Sequence
  chemically synthesized
attagtcttgaaatctattttt

SEQ ID NO: 150675 - DNA, 22 bp, Artificial Sequence
  chemically synthesized
gtcttgaaatctatttttattc

SEQ ID NO: 150676 - DNA, 22 bp, Artificial Sequence
  chemically synthesized
gaaatctatttttattcctctg

SEQ ID NO: 150677 - DNA, 22 bp, Artificial Sequence
  chemically synthesized
aaatctatttttattcctctgt

SEQ ID NO: 150678 - DNA, 22 bp, Artificial Sequence
  chemically synthesized
tttttattcctctgtggtctga

SEQ ID NO: 150679 - DNA, 22 bp, Artificial Sequence
  chemically synthesized
ttattcctctgtggtctgagag

SEQ ID NO: 150680 - DNA, 22 bp, Artificial Sequence
  chemically synthesized
tattcctctgtggtctgagagt

SEQ ID NO: 150681 - DNA, 22 bp, Artificial Sequence
  chemically synthesized
attcctctgtggtctgagagtg

SEQ ID NO: 150682 - DNA, 22 bp, Artificial Sequence
  chemically synthesized
ttcctctgtggtctgagagtga

SEQ ID NO: 150683 - DNA, 22 bp, Artificial Sequence
  chemically synthesized
ctctgtggtctgagagtgattg

SEQ ID NO: 150684 - DNA, 22 bp, Artificial Sequence
  chemically synthesized
tgtggtctgagagtgattgata

SEQ ID NO: 150685 - DNA, 22 bp, Artificial Sequence
  chemically synthesized
tggtctgagagtgattgatatg

SEQ ID NO: 150686 - DNA, 22 bp, Artificial Sequence
  chemically synthesized
agagtgattgatatgatttttt

SEQ ID NO: 150687 - DNA, 22 bp, Artificial Sequence
  chemically synthesized
atatgattttttttttgcattt

SEQ ID NO: 150688 - DNA, 22 bp, Artificial Sequence
  chemically synthesized
tttttttgcatttgctgaggat

SEQ ID NO: 150689 - DNA, 22 bp, Artificial Sequence
  chemically synthesized
ttttttgcatttgctgaggatt

SEQ ID NO: 150690 - DNA, 22 bp, Artificial Sequence
  chemically synthesized
tttttgcatttgctgaggattg

SEQ ID NO: 150691 - DNA, 22 bp, Artificial Sequence
  chemically synthesized
ttttgcatttgctgaggattgt

SEQ ID NO: 150692 - DNA, 22 bp, Artificial Sequence
  chemically synthesized
tttgcatttgctgaggattgtt

SEQ ID NO: 150693 - DNA, 22 bp, Artificial Sequence
  chemically synthesized
ttgcatttgctgaggattgttt

SEQ ID NO: 150694 - DNA, 22 bp, Artificial Sequence
  chemically synthesized
tgcatttgctgaggattgtttt

SEQ ID NO: 150695 - DNA, 22 bp, Artificial Sequence
  chemically synthesized
gcatttgctgaggattgtttta

SEQ ID NO: 150696 - DNA, 22 bp, Artificial Sequence
  chemically synthesized
catttgctgaggattgttttag

SEQ ID NO: 150697 - DNA, 22 bp, Artificial Sequence
  chemically synthesized
gctgaggattgttttaggtcct

SEQ ID NO: 150698 - DNA, 22 bp, Artificial Sequence
  chemically synthesized
ctgaggattgttttaggtcctc

SEQ ID NO: 150699 - DNA, 22 bp, Artificial Sequence
  chemically synthesized
aggattgttttaggtcctccca

SEQ ID NO: 150700 - DNA, 22 bp, Artificial Sequence
  chemically synthesized
ttttaggtcctcccaaggctga

SEQ ID NO: 150701 - DNA, 22 bp, Artificial Sequence
  chemically synthesized
taggtcctcccaaggctgaacc

SEQ ID NO: 150702 - DNA, 22 bp, Artificial Sequence
  chemically synthesized
aggtcctcccaaggctgaacca

SEQ ID NO: 150703 - DNA, 22 bp, Artificial Sequence
  chemically synthesized
ggtcctcccaaggctgaaccag

SEQ ID NO: 150704 - DNA, 22 bp, Artificial Sequence
  chemically synthesized
ccaaggctgaaccaggaagaaa

SEQ ID NO: 150705 - DNA, 22 bp, Artificial Sequence
  chemically synthesized
aaccaggaagaaatcaatttcc

SEQ ID NO: 150706 - DNA, 22 bp, Artificial Sequence
  chemically synthesized
cctgaagagatccatgatgagc

SEQ ID NO: 150707 - DNA, 22 bp, Artificial Sequence
  chemically synthesized
ctgaagagatccatgatgagct

SEQ ID NO: 150708 - DNA, 22 bp, Artificial Sequence
  chemically synthesized
aagagatccatgatgagctctg

SEQ ID NO: 150709 - DNA, 22 bp, Artificial Sequence
  chemically synthesized
tgaaaatgattcagtaataaat

SEQ ID NO: 150710 - DNA, 22 bp, Artificial Sequence
  chemically synthesized
aaaatgattcagtaataaatag

SEQ ID NO: 150711 - DNA, 22 bp, Artificial Sequence
  chemically synthesized
agtaataaatagcctatcaaac

SEQ ID NO: 150712 - DNA, 22 bp, Artificial Sequence
  chemically synthesized
tcaaacaaaaaaagccctggac

SEQ ID NO: 150713 - DNA, 22 bp, Artificial Sequence
  chemically synthesized
gacaatatgattcacaaccaaa

SEQ ID NO: 150714 - DNA, 22 bp, Artificial Sequence
  chemically synthesized
acaaccaaattctatcagatgc

SEQ ID NO: 150715 - DNA, 22 bp, Artificial Sequence
  chemically synthesized
tatcagatgcacaaagaagagt

SEQ ID NO: 150716 - DNA, 22 bp, Artificial Sequence
  chemically synthesized
tcagatgcacaaagaagagttg

SEQ ID NO: 150717 - DNA, 22 bp, Artificial Sequence
  chemically synthesized
gaaaaattcctactgaagctac

SEQ ID NO: 150718 - DNA, 22 bp, Artificial Sequence
  chemically synthesized
ctactgaagctactccaaaaaa

SEQ ID NO: 150719 - DNA, 22 bp, Artificial Sequence
  chemically synthesized
ctgaagctactccaaaaaattg

SEQ ID NO: 150720 - DNA, 22 bp, Artificial Sequence
  chemically synthesized
aagctactccaaaaaattgagg

SEQ ID NO: 150721 - DNA, 22 bp, Artificial Sequence
  chemically synthesized
ctccaaaaaattgagggggagg

SEQ ID NO: 150722 - DNA, 22 bp, Artificial Sequence
  chemically synthesized
caaaaaattgagggggagggat

SEQ ID NO: 150723 - DNA, 22 bp, Artificial Sequence
  chemically synthesized
agggggagggattcaacctcag

SEQ ID NO: 150724 - DNA, 22 bp, Artificial Sequence
  chemically synthesized
aacctcagctcattttatgagg

SEQ ID NO: 150725 - DNA, 22 bp, Artificial Sequence
  chemically synthesized
agctcattttatgaggccagca

SEQ ID NO: 150726 - DNA, 22 bp, Artificial Sequence
  chemically synthesized
attttatgaggccagcatcatc

SEQ ID NO: 150727 - DNA, 22 bp, Artificial Sequence
  chemically synthesized
tatgaggccagcatcatcctga

SEQ ID NO: 150728 - DNA, 22 bp, Artificial Sequence
  chemically synthesized
atgaggccagcatcatcctgat

SEQ ID NO: 150729 - DNA, 22 bp, Artificial Sequence
  chemically synthesized
tgaggccagcatcatcctgata

SEQ ID NO: 150730 - DNA, 22 bp, Artificial Sequence
  chemically synthesized
ataccaaaacctgatagacaca

SEQ ID NO: 150731 - DNA, 22 bp, Artificial Sequence
  chemically synthesized
atagacacacaacaacaaaaaa

SEQ ID NO: 150732 - DNA, 22 bp, Artificial Sequence
  chemically synthesized
caggccaatatccttgaacatt

SEQ ID NO: 150733 - DNA, 22 bp, Artificial Sequence
  chemically synthesized
aggccaatatccttgaacattg

SEQ ID NO: 150734 - DNA, 22 bp, Artificial Sequence
  chemically synthesized
gaacattgatgcaaaaatacta

SEQ ID NO: 150735 - DNA, 22 bp, Artificial Sequence
  chemically synthesized
aacattgatgcaaaaatactag

SEQ ID NO: 150736 - DNA, 22 bp, Artificial Sequence
  chemically synthesized
atgcaaaaatactagcaagcca

SEQ ID NO: 150737 - DNA, 22 bp, Artificial Sequence
  chemically synthesized
gcaagccaaatccagcaacaca

SEQ ID NO: 150738 - DNA, 22 bp, Artificial Sequence
  chemically synthesized
atccacctcaatcaagtaggct

SEQ ID NO: 150739 - DNA, 22 bp, Artificial Sequence
  chemically synthesized
aatcaagtaggctttatccctg

SEQ ID NO: 150740 - DNA, 22 bp, Artificial Sequence
  chemically synthesized
tatccctgagaagcaagattgg

SEQ ID NO: 150741 - DNA, 22 bp, Artificial Sequence
  chemically synthesized
atccctgagaagcaagattggt

SEQ ID NO: 150742 - DNA, 22 bp, Artificial Sequence
  chemically synthesized
tccctgagaagcaagattggtt

SEQ ID NO: 150743 - DNA, 22 bp, Artificial Sequence
  chemically synthesized
agaagcaagattggttcagcat

SEQ ID NO: 150744 - DNA, 22 bp, Artificial Sequence
  chemically synthesized
gttcagcatatacaaattgata

SEQ ID NO: 150745 - DNA, 22 bp, Artificial Sequence
  chemically synthesized
agcatatacaaattgataaatg

SEQ ID NO: 150746 - DNA, 22 bp, Artificial Sequence
  chemically synthesized
ataaatgtgattcatcatatat

SEQ ID NO: 150747 - DNA, 22 bp, Artificial Sequence
  chemically synthesized
atcatatatacagcactaaaaa

SEQ ID NO: 150748 - DNA, 22 bp, Artificial Sequence
  chemically synthesized
aaaacagaaaccacatgatcat

SEQ ID NO: 150749 - DNA, 22 bp, Artificial Sequence
  chemically synthesized
caatatgtgcaaaaaaagattt

SEQ ID NO: 150750 - DNA, 22 bp, Artificial Sequence
  chemically synthesized
aatatgtgcaaaaaaagatttt

SEQ ID NO: 150751 - DNA, 22 bp, Artificial Sequence
  chemically synthesized
tgataaaattcaacttcacttc

SEQ ID NO: 150752 - DNA, 22 bp, Artificial Sequence
  chemically synthesized
gataaaattcaacttcacttca

SEQ ID NO: 150753 - DNA, 22 bp, Artificial Sequence
  chemically synthesized
ataaaattcaacttcacttcat

SEQ ID NO: 150754 - DNA, 22 bp, Artificial Sequence
  chemically synthesized
aacttcacttcatgttaaaacc

SEQ ID NO: 150755 - DNA, 22 bp, Artificial Sequence
  chemically synthesized
cacttcatgttaaaacctctca

SEQ ID NO: 150756 - DNA, 22 bp, Artificial Sequence
  chemically synthesized
acttcatgttaaaacctctcaa

SEQ ID NO: 150757 - DNA, 22 bp, Artificial Sequence
  chemically synthesized
catgttaaaacctctcaacaaa

SEQ ID NO: 150758 - DNA, 22 bp, Artificial Sequence
  chemically synthesized
atgttaaaacctctcaacaaac

SEQ ID NO: 150759 - DNA, 22 bp, Artificial Sequence
  chemically synthesized
aaacctctcaacaaactagcta

SEQ ID NO: 150760 - DNA, 22 bp, Artificial Sequence
  chemically synthesized
tcaacaaactagctatttaagg

SEQ ID NO: 150761 - DNA, 22 bp, Artificial Sequence
  chemically synthesized
aacaaactagctatttaaggac

SEQ ID NO: 150762 - DNA, 22 bp, Artificial Sequence
  chemically synthesized
gctatttaaggacatgacctca

SEQ ID NO: 150763 - DNA, 22 bp, Artificial Sequence
  chemically synthesized
tttaaggacatgacctcaaaat

SEQ ID NO: 150764 - DNA, 22 bp, Artificial Sequence
  chemically synthesized
aaggacatgacctcaaaataat

SEQ ID NO: 150765 - DNA, 22 bp, Artificial Sequence
  chemically synthesized
aggacatgacctcaaaataata

SEQ ID NO: 150766 - DNA, 22 bp, Artificial Sequence
  chemically synthesized
aaaataatatgagccatctatg

SEQ ID NO: 150767 - DNA, 22 bp, Artificial Sequence
  chemically synthesized
tgacaaacccacagccaacatc

SEQ ID NO: 150768 - DNA, 22 bp, Artificial Sequence
  chemically synthesized
gaagcattcttcttgaaaactg

SEQ ID NO: 150769 - DNA, 22 bp, Artificial Sequence
  chemically synthesized
ttcttgaaaactggcacaagac

SEQ ID NO: 150770 - DNA, 22 bp, Artificial Sequence
  chemically synthesized
cttgaaaactggcacaagacaa

SEQ ID NO: 150771 - DNA, 22 bp, Artificial Sequence
  chemically synthesized
ttgaaaactggcacaagacaag

SEQ ID NO: 150772 - DNA, 22 bp, Artificial Sequence
  chemically synthesized
gaaaactggcacaagacaagga

SEQ ID NO: 150773 - DNA, 22 bp, Artificial Sequence
  chemically synthesized
aaaactggcacaagacaaggat

SEQ ID NO: 150774 - DNA, 22 bp, Artificial Sequence
  chemically synthesized
gcacaagacaaggatgccctct

SEQ ID NO: 150775 - DNA, 22 bp, Artificial Sequence
  chemically synthesized
tctcaccactgctattcagtat

SEQ ID NO: 150776 - DNA, 22 bp, Artificial Sequence
  chemically synthesized
tcaccactgctattcagtatag

SEQ ID NO: 150777 - DNA, 22 bp, Artificial Sequence
  chemically synthesized
accactgctattcagtatagta

SEQ ID NO: 150778 - DNA, 22 bp, Artificial Sequence
  chemically synthesized
ctattcagtatagtactggcag

SEQ ID NO: 150779 - DNA, 22 bp, Artificial Sequence
  chemically synthesized
ttcagtatagtactggcagtcc

SEQ ID NO: 150780 - DNA, 22 bp, Artificial Sequence
  chemically synthesized
agtatagtactggcagtcctgg

SEQ ID NO: 150781 - DNA, 22 bp, Artificial Sequence
  chemically synthesized
gcagtcctggccagagcaatca

SEQ ID NO: 150782 - DNA, 22 bp, Artificial Sequence
  chemically synthesized
gccagagcaatcaggcaagaga

SEQ ID NO: 150783 - DNA, 22 bp, Artificial Sequence
  chemically synthesized
ttttctgtatctagaaaacacc

SEQ ID NO: 150784 - DNA, 22 bp, Artificial Sequence
  chemically synthesized
tctgtatctagaaaacaccata

SEQ ID NO: 150785 - DNA, 22 bp, Artificial Sequence
  chemically synthesized
ctgtatctagaaaacaccatag

SEQ ID NO: 150786 - DNA, 22 bp, Artificial Sequence
  chemically synthesized
tgtatctagaaaacaccatagt

SEQ ID NO: 150787 - DNA, 22 bp, Artificial Sequence
  chemically synthesized
tatctagaaaacaccatagtca

SEQ ID NO: 150788 - DNA, 22 bp, Artificial Sequence
  chemically synthesized
gaaaacaccatagtcaaggccc

SEQ ID NO: 150789 - DNA, 22 bp, Artificial Sequence
  chemically synthesized
cttcagctgataacttcagcaa

SEQ ID NO: 150790 - DNA, 22 bp, Artificial Sequence
  chemically synthesized
cagctgataacttcagcaaagt

SEQ ID NO: 150791 - DNA, 22 bp, Artificial Sequence
  chemically synthesized
agctgataacttcagcaaagtt

SEQ ID NO: 150792 - DNA, 22 bp, Artificial Sequence
  chemically synthesized
ataacttcagcaaagtttcagg

SEQ ID NO: 150793 - DNA, 22 bp, Artificial Sequence
  chemically synthesized
cagcaaagtttcaggatataaa

SEQ ID NO: 150794 - DNA, 22 bp, Artificial Sequence
  chemically synthesized
agcaaagtttcaggatataaaa

SEQ ID NO: 150795 - DNA, 22 bp, Artificial Sequence
  chemically synthesized
caggatataaaatcaatgtaca

SEQ ID NO: 150796 - DNA, 22 bp, Artificial Sequence
  chemically synthesized
aggatataaaatcaatgtacaa

SEQ ID NO: 150797 - DNA, 22 bp, Artificial Sequence
  chemically synthesized
gcattcccatacatcaacaata

SEQ ID NO: 150798 - DNA, 22 bp, Artificial Sequence
  chemically synthesized
ccatacatcaacaatagccaag

SEQ ID NO: 150799 - DNA, 22 bp, Artificial Sequence
  chemically synthesized
gagccaaatcaggaagtcaatc

SEQ ID NO: 150800 - DNA, 22 bp, Artificial Sequence
  chemically synthesized
accgttgccacaaaaagaataa

SEQ ID NO: 150801 - DNA, 22 bp, Artificial Sequence
  chemically synthesized
ccgttgccacaaaaagaataaa

SEQ ID NO: 150802 - DNA, 22 bp, Artificial Sequence
  chemically synthesized
ccacaaaaagaataaaatacct

SEQ ID NO: 150803 - DNA, 22 bp, Artificial Sequence
  chemically synthesized
aggatatatctaaccaagcagt

SEQ ID NO: 150804 - DNA, 22 bp, Artificial Sequence
  chemically synthesized
accaagcagttgaaagatctct

SEQ ID NO: 150805 - DNA, 22 bp, Artificial Sequence
  chemically synthesized
aaagatctctacaatgagattt

SEQ ID NO: 150806 - DNA, 22 bp, Artificial Sequence
  chemically synthesized
tacaatgagatttacaaaacac

SEQ ID NO: 150807 - DNA, 22 bp, Artificial Sequence
  chemically synthesized
caatgagatttacaaaacactg

SEQ ID NO: 150808 - DNA, 22 bp, Artificial Sequence
  chemically synthesized
acaaaacactgctcaaagaaat

SEQ ID NO: 150809 - DNA, 22 bp, Artificial Sequence
  chemically synthesized
caaaacactgctcaaagaaatc

SEQ ID NO: 150810 - DNA, 22 bp, Artificial Sequence
  chemically synthesized
ctcaaagaaatcagagctgata

SEQ ID NO: 150811 - DNA, 22 bp, Artificial Sequence
  chemically synthesized
aaagaaatcagagctgatagaa

SEQ ID NO: 150812 - DNA, 22 bp, Artificial Sequence
  chemically synthesized
atagaaacaaatggaaaaactt

SEQ ID NO: 150813 - DNA, 22 bp, Artificial Sequence
  chemically synthesized
tccatgctcatggataaaaaga

SEQ ID NO: 150814 - DNA, 22 bp, Artificial Sequence
  chemically synthesized
ccatgctcatggataaaaagaa

SEQ ID NO: 150815 - DNA, 22 bp, Artificial Sequence
  chemically synthesized
catgctcatggataaaaagaat

SEQ ID NO: 150816 - DNA, 22 bp, Artificial Sequence
  chemically synthesized
atggataaaaagaatcaatatt

SEQ ID NO: 150817 - DNA, 22 bp, Artificial Sequence
  chemically synthesized
ttaaaatgtccatactgcctag

SEQ ID NO: 150818 - DNA, 22 bp, Artificial Sequence
  chemically synthesized
aaatgtccatactgcctagagc

SEQ ID NO: 150819 - DNA, 22 bp, Artificial Sequence
  chemically synthesized
cctagagcaatttacagtttca

SEQ ID NO: 150820 - DNA, 22 bp, Artificial Sequence
  chemically synthesized
gagcaatttacagtttcaaagc

SEQ ID NO: 150821 - DNA, 22 bp, Artificial Sequence
  chemically synthesized
acagtttcaaagctattcctat

SEQ ID NO: 150822 - DNA, 22 bp, Artificial Sequence
  chemically synthesized
cagtttcaaagctattcctatc

SEQ ID NO: 150823 - DNA, 22 bp, Artificial Sequence
  chemically synthesized
caaagctattcctatcaaacta

SEQ ID NO: 150824 - DNA, 22 bp, Artificial Sequence
  chemically synthesized
aaagctattcctatcaaactac

SEQ ID NO: 150825 - DNA, 22 bp, Artificial Sequence
  chemically synthesized
ttcctatcaaactaccaatgac

SEQ ID NO: 150826 - DNA, 22 bp, Artificial Sequence
  chemically synthesized
ctatcaaactaccaatgacatt

SEQ ID NO: 150827 - DNA, 22 bp, Artificial Sequence
  chemically synthesized
tcaaactaccaatgacattctt

SEQ ID NO: 150828 - DNA, 22 bp, Artificial Sequence
  chemically synthesized
ccaatgacattcttcacagaac

SEQ ID NO: 150829 - DNA, 22 bp, Artificial Sequence
  chemically synthesized
ttcacagaactagaaaaataca

SEQ ID NO: 150830 - DNA, 22 bp, Artificial Sequence
  chemically synthesized
cacagaactagaaaaatacact

SEQ ID NO: 150831 - DNA, 22 bp, Artificial Sequence
  chemically synthesized
acagaactagaaaaatacactt

SEQ ID NO: 150832 - DNA, 22 bp, Artificial Sequence
  chemically synthesized
gaaaaatacactttaaagttca

SEQ ID NO: 150833 - DNA, 22 bp, Artificial Sequence
  chemically synthesized
taaagttcatatggaacaacaa

SEQ ID NO: 150834 - DNA, 22 bp, Artificial Sequence
  chemically synthesized
aaagttcatatggaacaacaac

SEQ ID NO: 150835 - DNA, 22 bp, Artificial Sequence
  chemically synthesized
aagttcatatggaacaacaaca

SEQ ID NO: 150836 - DNA, 22 bp, Artificial Sequence
  chemically synthesized
atatggaacaacaacaaaaaaa

SEQ ID NO: 150837 - DNA, 22 bp, Artificial Sequence
  chemically synthesized
ggaaatcctaatactcacaggt

SEQ ID NO: 150838 - DNA, 22 bp, Artificial Sequence
  chemically synthesized
atactcacaggtgggaattgaa

SEQ ID NO: 150839 - DNA, 22 bp, Artificial Sequence
  chemically synthesized
acaggtgggaattgaaaaatga

SEQ ID NO: 150840 - DNA, 22 bp, Artificial Sequence
  chemically synthesized
aaaaatgagaacacttggacac

SEQ ID NO: 150841 - DNA, 22 bp, Artificial Sequence
  chemically synthesized
ggacacagggtggggaacatca

SEQ ID NO: 150842 - DNA, 22 bp, Artificial Sequence
  chemically synthesized
gacacagggtggggaacatcac

SEQ ID NO: 150843 - DNA, 22 bp, Artificial Sequence
  chemically synthesized
tcgtggggtggtaggagagagg

SEQ ID NO: 150844 - DNA, 22 bp, Artificial Sequence
  chemically synthesized
ggagatatatctaatgtaaatg

SEQ ID NO: 150845 - DNA, 22 bp, Artificial Sequence
  chemically synthesized
atgtaaatgacgagttaacggg

SEQ ID NO: 150846 - DNA, 22 bp, Artificial Sequence
  chemically synthesized
acgggtgcagcacaccaatatg

SEQ ID NO: 150847 - DNA, 22 bp, Artificial Sequence
  chemically synthesized
cacaggtaccgtagaacttaga

SEQ ID NO: 150848 - DNA, 22 bp, Artificial Sequence
  chemically synthesized
agagtacaaaaaaaaaaaaaga

SEQ ID NO: 150849 - DNA, 22 bp, Artificial Sequence
  chemically synthesized
gagtacaaaaaaaaaaaaagag

SEQ ID NO: 150850 - DNA, 22 bp, Artificial Sequence
  chemically synthesized
gagataatacattgcctaactt

SEQ ID NO: 150851 - DNA, 22 bp, Artificial Sequence
  chemically synthesized
cctaacttcaaaccataccaca

SEQ ID NO: 150852 - DNA, 22 bp, Artificial Sequence
  chemically synthesized
acttcaaaccataccacagggc

SEQ ID NO: 150853 - DNA, 22 bp, Artificial Sequence
  chemically synthesized
caaaccataccacagggctaca

SEQ ID NO: 150854 - DNA, 22 bp, Artificial Sequence
  chemically synthesized
aaaccataccacagggctacag

SEQ ID NO: 150855 - DNA, 22 bp, Artificial Sequence
  chemically synthesized
cagtaaccaaaacagtgtggta

SEQ ID NO: 150856 - DNA, 22 bp, Artificial Sequence
  chemically synthesized
ttacagaaaagacacacagaca

SEQ ID NO: 150857 - DNA, 22 bp, Artificial Sequence
  chemically synthesized
cagaaaagacacacagacaaat

SEQ ID NO: 150858 - DNA, 22 bp, Artificial Sequence
  chemically synthesized
caaccatctgatctttgacaaa

SEQ ID NO: 150859 - DNA, 22 bp, Artificial Sequence
  chemically synthesized
atctttgacaaagctgataaaa

SEQ ID NO: 150860 - DNA, 22 bp, Artificial Sequence
  chemically synthesized
tgacaaagctgataaaaacaag

SEQ ID NO: 150861 - DNA, 22 bp, Artificial Sequence
  chemically synthesized
gacaaagctgataaaaacaagc

SEQ ID NO: 150862 - DNA, 22 bp, Artificial Sequence
  chemically synthesized
acaaagctgataaaaacaagca

SEQ ID NO: 150863 - DNA, 22 bp, Artificial Sequence
  chemically synthesized
ataaaaacaagcaatgaggaaa

SEQ ID NO: 150864 - DNA, 22 bp, Artificial Sequence
  chemically synthesized
ttcaacaagtggtgttgggata

SEQ ID NO: 150865 - DNA, 22 bp, Artificial Sequence
  chemically synthesized
aacaagtggtgttgggataact

SEQ ID NO: 150866 - DNA, 22 bp, Artificial Sequence
  chemically synthesized
ggataactgactaaccgtatgt

SEQ ID NO: 150867 - DNA, 22 bp, Artificial Sequence
  chemically synthesized
actaaccgtatgtagaagattg

SEQ ID NO: 150868 - DNA, 22 bp, Artificial Sequence
  chemically synthesized
accgtatgtagaagattgaaac

SEQ ID NO: 150869 - DNA, 22 bp, Artificial Sequence
  chemically synthesized
aaaccagaccccgttctatatc

SEQ ID NO: 150870 - DNA, 22 bp, Artificial Sequence
  chemically synthesized
tatatcatatacacaaataaac

SEQ ID NO: 150871 - DNA, 22 bp, Artificial Sequence
  chemically synthesized
tatcatatacacaaataaactc

SEQ ID NO: 150872 - DNA, 22 bp, Artificial Sequence
  chemically synthesized
aagatggattagagacttaaat

SEQ ID NO: 150873 - DNA, 22 bp, Artificial Sequence
  chemically synthesized
gagacttaaatgcaaaacccaa

SEQ ID NO: 150874 - DNA, 22 bp, Artificial Sequence
  chemically synthesized
aaatgcaaaacccaaactataa

SEQ ID NO: 150875 - DNA, 22 bp, Artificial Sequence
  chemically synthesized
aatgcaaaacccaaactataaa

SEQ ID NO: 150876 - DNA, 22 bp, Artificial Sequence
  chemically synthesized
taaaaatgcttgaaagcaacct

SEQ ID NO: 150877 - DNA, 22 bp, Artificial Sequence
  chemically synthesized
gaaagcaacctaggcaatacca

SEQ ID NO: 150878 - DNA, 22 bp, Artificial Sequence
  chemically synthesized
aaagcaacctaggcaataccat

SEQ ID NO: 150879 - DNA, 22 bp, Artificial Sequence
  chemically synthesized
ggcaataccattccggacataa

SEQ ID NO: 150880 - DNA, 22 bp, Artificial Sequence
  chemically synthesized
cggacataagcaggggcaaaga

SEQ ID NO: 150881 - DNA, 22 bp, Artificial Sequence
  chemically synthesized
catgacaaagatgccaacagtc

SEQ ID NO: 150882 - DNA, 22 bp, Artificial Sequence
  chemically synthesized
atgacaaagatgccaacagtca

SEQ ID NO: 150883 - DNA, 22 bp, Artificial Sequence
  chemically synthesized
cagcaaaagcaaaaattgacaa

SEQ ID NO: 150884 - DNA, 22 bp, Artificial Sequence
  chemically synthesized
acaaataggatctaattaaaat

SEQ ID NO: 150885 - DNA, 22 bp, Artificial Sequence
  chemically synthesized
attaaaataaagtttctgcaca

SEQ ID NO: 150886 - DNA, 22 bp, Artificial Sequence
  chemically synthesized
aaataaagtttctgcacagcaa

SEQ ID NO: 150887 - DNA, 22 bp, Artificial Sequence
  chemically synthesized
ctgcacagcaaaagaaactatc

SEQ ID NO: 150888 - DNA, 22 bp, Artificial Sequence
  chemically synthesized
tgcacagcaaaagaaactatca

SEQ ID NO: 150889 - DNA, 22 bp, Artificial Sequence
  chemically synthesized
cacagcaaaagaaactatcaac

SEQ ID NO: 150890 - DNA, 22 bp, Artificial Sequence
  chemically synthesized
tcaactgagtaaacaacctata

SEQ ID NO: 150891 - DNA, 22 bp, Artificial Sequence
  chemically synthesized
agtaaacaacctatagaatggg

SEQ ID NO: 150892 - DNA, 22 bp, Artificial Sequence
  chemically synthesized
tagaatgggagaaaatttttgc

SEQ ID NO: 150893 - DNA, 22 bp, Artificial Sequence
  chemically synthesized
ttgcaaactatgcatccaacaa

SEQ ID NO: 150894 - DNA, 22 bp, Artificial Sequence
  chemically synthesized
tgcaaactatgcatccaacaaa

SEQ ID NO: 150895 - DNA, 22 bp, Artificial Sequence
  chemically synthesized
gcaaactatgcatccaacaaag

SEQ ID NO: 150896 - DNA, 22 bp, Artificial Sequence
  chemically synthesized
caaactatgcatccaacaaagg

SEQ ID NO: 150897 - DNA, 22 bp, Artificial Sequence
  chemically synthesized
tgcatccaacaaaggcctaata

SEQ ID NO: 150898 - DNA, 22 bp, Artificial Sequence
  chemically synthesized
atattcagaatctataaggaac

SEQ ID NO: 150899 - DNA, 22 bp, Artificial Sequence
  chemically synthesized
agaatctataaggaacttaaat

SEQ ID NO: 150900 - DNA, 22 bp, Artificial Sequence
  chemically synthesized
taaggaacttaaatgaatctac

SEQ ID NO: 150901 - DNA, 22 bp, Artificial Sequence
  chemically synthesized
aaatgaatctacaagaacaaaa

SEQ ID NO: 150902 - DNA, 22 bp, Artificial Sequence
  chemically synthesized
aatgaatctacaagaacaaaac

SEQ ID NO: 150903 - DNA, 22 bp, Artificial Sequence
  chemically synthesized
caagaacaaaacaaacaatgcc

SEQ ID NO: 150904 - DNA, 22 bp, Artificial Sequence
  chemically synthesized
aaaagaagacatacatgtggcc

SEQ ID NO: 150905 - DNA, 22 bp, Artificial Sequence
  chemically synthesized
agtgtcactgatcattagagaa

SEQ ID NO: 150906 - DNA, 22 bp, Artificial Sequence
  chemically synthesized
atcattagagaaatgccaatca

SEQ ID NO: 150907 - DNA, 22 bp, Artificial Sequence
  chemically synthesized
gagaaatgccaatcaaacccaa

SEQ ID NO: 150908 - DNA, 22 bp, Artificial Sequence
  chemically synthesized
tctcacatcacttaaaatatct

SEQ ID NO: 150909 - DNA, 22 bp, Artificial Sequence
  chemically synthesized
acatcacttaaaatatctataa

SEQ ID NO: 150910 - DNA, 22 bp, Artificial Sequence
  chemically synthesized
aaaatatctataattaaatagt

SEQ ID NO: 150911 - DNA, 22 bp, Artificial Sequence
  chemically synthesized
aaatatctataattaaatagtc

SEQ ID NO: 150912 - DNA, 22 bp, Artificial Sequence
  chemically synthesized
taattaaatagtcaaaaaataa

SEQ ID NO: 150913 - DNA, 22 bp, Artificial Sequence
  chemically synthesized
aatagtcaaaaaataacagatg

SEQ ID NO: 150914 - DNA, 22 bp, Artificial Sequence
  chemically synthesized
tggagaaaagggaatgtttata

SEQ ID NO: 150915 - DNA, 22 bp, Artificial Sequence
  chemically synthesized
atacaccattggtggcaatata

SEQ ID NO: 150916 - DNA, 22 bp, Artificial Sequence
  chemically synthesized
tacaccattggtggcaatataa

SEQ ID NO: 150917 - DNA, 22 bp, Artificial Sequence
  chemically synthesized
gtggcaatataaattagttcga

SEQ ID NO: 150918 - DNA, 22 bp, Artificial Sequence
  chemically synthesized
gttcgaccattgtagacagcag

SEQ ID NO: 150919 - DNA, 22 bp, Artificial Sequence
  chemically synthesized
gaccattgtagacagcagtgtg

SEQ ID NO: 150920 - DNA, 22 bp, Artificial Sequence
  chemically synthesized
tagacagcagtgtggcaattcc

SEQ ID NO: 150921 - DNA, 22 bp, Artificial Sequence
  chemically synthesized
cctaaagacctaaaaacagaaa

SEQ ID NO: 150922 - DNA, 22 bp, Artificial Sequence
  chemically synthesized
aagacctaaaaacagaaatacc

SEQ ID NO: 150923 - DNA, 22 bp, Artificial Sequence
  chemically synthesized
aaaacagaaataccatttaacc

SEQ ID NO: 150924 - DNA, 22 bp, Artificial Sequence
  chemically synthesized
aacccaacaatcctattattga

SEQ ID NO: 150925 - DNA, 22 bp, Artificial Sequence
  chemically synthesized
acccaacaatcctattattgag

SEQ ID NO: 150926 - DNA, 22 bp, Artificial Sequence
  chemically synthesized
ttattgagtatatacctaaagg

SEQ ID NO: 150927 - DNA, 22 bp, Artificial Sequence
  chemically synthesized
ttgagtatatacctaaaggaaa

SEQ ID NO: 150928 - DNA, 22 bp, Artificial Sequence
  chemically synthesized
agtatatacctaaaggaaaata

SEQ ID NO: 150929 - DNA, 22 bp, Artificial Sequence
  chemically synthesized
aaggaaaataaaccattctatc

SEQ ID NO: 150930 - DNA, 22 bp, Artificial Sequence
  chemically synthesized
tatcacaaagacacatgcacac

SEQ ID NO: 150931 - DNA, 22 bp, Artificial Sequence
  chemically synthesized
tcacaaagacacatgcacacct

SEQ ID NO: 150932 - DNA, 22 bp, Artificial Sequence
  chemically synthesized
tgtccattgcagcataatcaca

SEQ ID NO: 150933 - DNA, 22 bp, Artificial Sequence
  chemically synthesized
cagcataatcacaatagcaaag

SEQ ID NO: 150934 - DNA, 22 bp, Artificial Sequence
  chemically synthesized
aaggcccattagtggtataccg

SEQ ID NO: 150935 - DNA, 22 bp, Artificial Sequence
  chemically synthesized
gtggtataccgataaagaacat

SEQ ID NO: 150936 - DNA, 22 bp, Artificial Sequence
  chemically synthesized
tgtggccataaaaaagaatgag

SEQ ID NO: 150937 - DNA, 22 bp, Artificial Sequence
  chemically synthesized
tgcaggaacatggatggagccg

SEQ ID NO: 150938 - DNA, 22 bp, Artificial Sequence
  chemically synthesized
gcaggaacatggatggagccgg

SEQ ID NO: 150939 - DNA, 22 bp, Artificial Sequence
  chemically synthesized
caggaacatggatggagccgga

SEQ ID NO: 150940 - DNA, 22 bp, Artificial Sequence
  chemically synthesized
tccttaacaaactaatgtaaga

SEQ ID NO: 150941 - DNA, 22 bp, Artificial Sequence
  chemically synthesized
aacaaactaatgtaagaacaga

SEQ ID NO: 150942 - DNA, 22 bp, Artificial Sequence
  chemically synthesized
acaaactaatgtaagaacagaa

SEQ ID NO: 150943 - DNA, 22 bp, Artificial Sequence
  chemically synthesized
atgtaagaacagaaaaccaaat

SEQ ID NO: 150944 - DNA, 22 bp, Artificial Sequence
  chemically synthesized
catattatcacttacaagtagg

SEQ ID NO: 150945 - DNA, 22 bp, Artificial Sequence
  chemically synthesized
tcacttacaagtaggaactaaa

SEQ ID NO: 150946 - DNA, 22 bp, Artificial Sequence
  chemically synthesized
acaagtaggaactaaatgatga

SEQ ID NO: 150947 - DNA, 22 bp, Artificial Sequence
  chemically synthesized
caagtaggaactaaatgatgag

SEQ ID NO: 150948 - DNA, 22 bp, Artificial Sequence
  chemically synthesized
aatgatgagaaaacatgcacac

SEQ ID NO: 150949 - DNA, 22 bp, Artificial Sequence
  chemically synthesized
cagcctaattgagtttggaggg

SEQ ID NO: 150950 - DNA, 22 bp, Artificial Sequence
  chemically synthesized
attgagtttggagggtgggaac

SEQ ID NO: 150951 - DNA, 22 bp, Artificial Sequence
  chemically synthesized
agtttggagggtgggaacgggg

SEQ ID NO: 150952 - DNA, 22 bp, Artificial Sequence
  chemically synthesized
ggagggtgggaacggggagaag

SEQ ID NO: 150953 - DNA, 22 bp, Artificial Sequence
  chemically synthesized
gagggtgggaacggggagaaga

SEQ ID NO: 150954 - DNA, 22 bp, Artificial Sequence
  chemically synthesized
ttgagtactgggagatgaaata

SEQ ID NO: 150955 - DNA, 22 bp, Artificial Sequence
  chemically synthesized
agtactgggagatgaaataatc

SEQ ID NO: 150956 - DNA, 22 bp, Artificial Sequence
  chemically synthesized
ggagatgaaataatctgtacga

SEQ ID NO: 150957 - DNA, 22 bp, Artificial Sequence
  chemically synthesized
tacgacaaacccatgacatgtg

SEQ ID NO: 150958 - DNA, 22 bp, Artificial Sequence
  chemically synthesized
agctatgtaacaaaccatcgtg

SEQ ID NO: 150959 - DNA, 22 bp, Artificial Sequence
  chemically synthesized
gctatgtaacaaaccatcgtga

SEQ ID NO: 150960 - DNA, 22 bp, Artificial Sequence
  chemically synthesized
tgtaacaaaccatcgtgagtct

SEQ ID NO: 150961 - DNA, 22 bp, Artificial Sequence
  chemically synthesized
tagcagttctttcctcccattt

SEQ ID NO: 150962 - DNA, 22 bp, Artificial Sequence
  chemically synthesized
agcagttctttcctcccatttt

SEQ ID NO: 150963 - DNA, 22 bp, Artificial Sequence
  chemically synthesized
gcagttctttcctcccatttta

SEQ ID NO: 150964 - DNA, 22 bp, Artificial Sequence
  chemically synthesized
tttcctcccattttattcttcc

SEQ ID NO: 150965 - DNA, 22 bp, Artificial Sequence
  chemically synthesized
tcctcccattttattcttcctt

SEQ ID NO: 150966 - DNA, 22 bp, Artificial Sequence
  chemically synthesized
cctcccattttattcttccttg

SEQ ID NO: 150967 - DNA, 22 bp, Artificial Sequence
  chemically synthesized
ctcccattttattcttccttgc

SEQ ID NO: 150968 - DNA, 22 bp, Artificial Sequence
  chemically synthesized
ccattttattcttccttgctcc

SEQ ID NO: 150969 - DNA, 22 bp, Artificial Sequence
  chemically synthesized
tattcttccttgctcctctttc

SEQ ID NO: 150970 - DNA, 22 bp, Artificial Sequence
  chemically synthesized
attcttccttgctcctctttcc

SEQ ID NO: 150971 - DNA, 22 bp, Artificial Sequence
  chemically synthesized
ttcttccttgctcctctttcca

SEQ ID NO: 150972 - DNA, 22 bp, Artificial Sequence
  chemically synthesized
ttccttgctcctctttccacct

SEQ ID NO: 150973 - DNA, 22 bp, Artificial Sequence
  chemically synthesized
ccttgctcctctttccacctat

SEQ ID NO: 150974 - DNA, 22 bp, Artificial Sequence
  chemically synthesized
cttgctcctctttccacctatt

SEQ ID NO: 150975 - DNA, 22 bp, Artificial Sequence
  chemically synthesized
gctcctctttccacctattagt

SEQ ID NO: 150976 - DNA, 22 bp, Artificial Sequence
  chemically synthesized
ctcctctttccacctattagtc

SEQ ID NO: 150977 - DNA, 22 bp, Artificial Sequence
  chemically synthesized
ctctttccacctattagtcaca

SEQ ID NO: 150978 - DNA, 22 bp, Artificial Sequence
  chemically synthesized
tttccacctattagtcacatat

SEQ ID NO: 150979 - DNA, 22 bp, Artificial Sequence
  chemically synthesized
tccacctattagtcacatatct

SEQ ID NO: 150980 - DNA, 22 bp, Artificial Sequence
  chemically synthesized
ccacctattagtcacatatctt

SEQ ID NO: 150981 - DNA, 22 bp, Artificial Sequence
  chemically synthesized
cacctattagtcacatatcttt

SEQ ID NO: 150982 - DNA, 22 bp, Artificial Sequence
  chemically synthesized
ttagtcacatatctttttatag

SEQ ID NO: 150983 - DNA, 22 bp, Artificial Sequence
  chemically synthesized
gtcacatatctttttatagtta

SEQ ID NO: 150984 - DNA, 22 bp, Artificial Sequence
  chemically synthesized
tttatagttataatcagcttgt

SEQ ID NO: 150985 - DNA, 22 bp, Artificial Sequence
  chemically synthesized
ttatagttataatcagcttgtt

SEQ ID NO: 150986 - DNA, 22 bp, Artificial Sequence
  chemically synthesized
tatagttataatcagcttgttt

SEQ ID NO: 150987 - DNA, 22 bp, Artificial Sequence
  chemically synthesized
atagttataatcagcttgtttt

SEQ ID NO: 150988 - DNA, 22 bp, Artificial Sequence
  chemically synthesized
tagttataatcagcttgttttt

SEQ ID NO: 150989 - DNA, 22 bp, Artificial Sequence
  chemically synthesized
taatcagcttgtttttaagtct

SEQ ID NO: 150990 - DNA, 22 bp, Artificial Sequence
  chemically synthesized
gtttttaagtctaacaaaatgt

SEQ ID NO: 150991 - DNA, 22 bp, Artificial Sequence
  chemically synthesized
tttttaagtctaacaaaatgtt

SEQ ID NO: 150992 - DNA, 22 bp, Artificial Sequence
  chemically synthesized
ttaagtctaacaaaatgttgtt

SEQ ID NO: 150993 - DNA, 22 bp, Artificial Sequence
  chemically synthesized
taagtctaacaaaatgttgttt

SEQ ID NO: 150994 - DNA, 22 bp, Artificial Sequence
  chemically synthesized
aagtctaacaaaatgttgtttt

SEQ ID NO: 150995 - DNA, 22 bp, Artificial Sequence
  chemically synthesized
agtctaacaaaatgttgtttta

SEQ ID NO: 150996 - DNA, 22 bp, Artificial Sequence
  chemically synthesized
acaaaatgttgttttatgcgca

SEQ ID NO: 150997 - DNA, 22 bp, Artificial Sequence
  chemically synthesized
ttttatgcgcattatgaaagta

SEQ ID NO: 150998 - DNA, 22 bp, Artificial Sequence
  chemically synthesized
tatgcgcattatgaaagtaatt

SEQ ID NO: 150999 - DNA, 22 bp, Artificial Sequence
  chemically synthesized
atgcgcattatgaaagtaattt

SEQ ID NO: 151000 - DNA, 22 bp, Artificial Sequence
  chemically synthesized
tgcgcattatgaaagtaattta

SEQ ID NO: 151001 - DNA, 22 bp, Artificial Sequence
  chemically synthesized
tgaaagtaatttaatgattctc

SEQ ID NO: 151002 - DNA, 22 bp, Artificial Sequence
  chemically synthesized
aatgattctctgtccttctttg

SEQ ID NO: 151003 - DNA, 22 bp, Artificial Sequence
  chemically synthesized
atgattctctgtccttctttgt

SEQ ID NO: 151004 - DNA, 22 bp, Artificial Sequence
  chemically synthesized
tctgtccttctttgtaatttga

SEQ ID NO: 151005 - DNA, 22 bp, Artificial Sequence
  chemically synthesized
tgtccttctttgtaatttgatt

SEQ ID NO: 151006 - DNA, 22 bp, Artificial Sequence
  chemically synthesized
tccttctttgtaatttgatttt

SEQ ID NO: 151007 - DNA, 22 bp, Artificial Sequence
  chemically synthesized
ctttgtaatttgattttatgca

SEQ ID NO: 151008 - DNA, 22 bp, Artificial Sequence
  chemically synthesized
tttgtaatttgattttatgcaa

SEQ ID NO: 151009 - DNA, 22 bp, Artificial Sequence
  chemically synthesized
tgtaatttgattttatgcaaca

SEQ ID NO: 151010 - DNA, 22 bp, Artificial Sequence
  chemically synthesized
gtaatttgattttatgcaacaa

SEQ ID NO: 151011 - DNA, 22 bp, Artificial Sequence
  chemically synthesized
taatttgattttatgcaacaag

SEQ ID NO: 151012 - DNA, 22 bp, Artificial Sequence
  chemically synthesized
gattttatgcaacaagcattta

SEQ ID NO: 151013 - DNA, 22 bp, Artificial Sequence
  chemically synthesized
attttatgcaacaagcatttat

SEQ ID NO: 151014 - DNA, 22 bp, Artificial Sequence
  chemically synthesized
tatgcaacaagcatttattgtg

SEQ ID NO: 151015 - DNA, 22 bp, Artificial Sequence
  chemically synthesized
atgcaacaagcatttattgtgt

SEQ ID NO: 151016 - DNA, 22 bp, Artificial Sequence
  chemically synthesized
tgcaacaagcatttattgtgtt

SEQ ID NO: 151017 - DNA, 22 bp, Artificial Sequence
  chemically synthesized
attgtgttcctatatagtaaat

SEQ ID NO: 151018 - DNA, 22 bp, Artificial Sequence
  chemically synthesized
ttgtgttcctatatagtaaata

SEQ ID NO: 151019 - DNA, 22 bp, Artificial Sequence
  chemically synthesized
tgttcctatatagtaaatataa

SEQ ID NO: 151020 - DNA, 22 bp, Artificial Sequence
  chemically synthesized
ctatatagtaaatataaaaact

SEQ ID NO: 151021 - DNA, 22 bp, Artificial Sequence
  chemically synthesized
tatagtaaatataaaaactgta

SEQ ID NO: 151022 - DNA, 22 bp, Artificial Sequence
  chemically synthesized
tatatatgttggaggtaaaaaa

SEQ ID NO: 151023 - DNA, 22 bp, Artificial Sequence
  chemically synthesized
gaggtaaaaaataatgacaatg

SEQ ID NO: 151024 - DNA, 22 bp, Artificial Sequence
  chemically synthesized
ttgccctcaaaataatgtgagc

SEQ ID NO: 151025 - DNA, 22 bp, Artificial Sequence
  chemically synthesized
tgccctcaaaataatgtgagca

SEQ ID NO: 151026 - DNA, 22 bp, Artificial Sequence
  chemically synthesized
gccctcaaaataatgtgagcaa

SEQ ID NO: 151027 - DNA, 22 bp, Artificial Sequence
  chemically synthesized
ccctcaaaataatgtgagcaat

SEQ ID NO: 151028 - DNA, 22 bp, Artificial Sequence
  chemically synthesized
aaaataatgtgagcaatttagt

SEQ ID NO: 151029 - DNA, 22 bp, Artificial Sequence
  chemically synthesized
agtcctatggctcctatttgtt

SEQ ID NO: 151030 - DNA, 22 bp, Artificial Sequence
  chemically synthesized
gtcctatggctcctatttgtta

SEQ ID NO: 151031 - DNA, 22 bp, Artificial Sequence
  chemically synthesized
tggctcctatttgttaaagaca

SEQ ID NO: 151032 - DNA, 22 bp, Artificial Sequence
  chemically synthesized
ctatttgttaaagacattcagt

SEQ ID NO: 151033 - DNA, 22 bp, Artificial Sequence
  chemically synthesized
tttgttaaagacattcagttac

SEQ ID NO: 151034 - DNA, 22 bp, Artificial Sequence
  chemically synthesized
gttaaagacattcagttacttc

SEQ ID NO: 151035 - DNA, 22 bp, Artificial Sequence
  chemically synthesized
ttaaagacattcagttacttct

SEQ ID NO: 151036 - DNA, 22 bp, Artificial Sequence
  chemically synthesized
aagacattcagttacttctgac

SEQ ID NO: 151037 - DNA, 22 bp, Artificial Sequence
  chemically synthesized
agttacttctgacaacctgaat

SEQ ID NO: 151038 - DNA, 22 bp, Artificial Sequence
  chemically synthesized
cttctgacaacctgaattgtta

SEQ ID NO: 151039 - DNA, 22 bp, Artificial Sequence
  chemically synthesized
ctgacaacctgaattgttaatt

SEQ ID NO: 151040 - DNA, 22 bp, Artificial Sequence
  chemically synthesized
tgacaacctgaattgttaattt

SEQ ID NO: 151041 - DNA, 22 bp, Artificial Sequence
  chemically synthesized
acaacctgaattgttaatttct

SEQ ID NO: 151042 - DNA, 22 bp, Artificial Sequence
  chemically synthesized
aattgttaatttctttctttct

SEQ ID NO: 151043 - DNA, 22 bp, Artificial Sequence
  chemically synthesized
ttaatttctttctttctagctc

SEQ ID NO: 151044 - DNA, 22 bp, Artificial Sequence
  chemically synthesized
atttctttctttctagctctct

SEQ ID NO: 151045 - DNA, 22 bp, Artificial Sequence
  chemically synthesized
ctttctttctagctctcttttt

SEQ ID NO: 151046 - DNA, 22 bp, Artificial Sequence
  chemically synthesized
tttctttctagctctctttttt

SEQ ID NO: 151047 - DNA, 22 bp, Artificial Sequence
  chemically synthesized
tctttctagctctctttttttt

SEQ ID NO: 151048 - DNA, 22 bp, Artificial Sequence
  chemically synthesized
ctttctagctctcttttttttt

SEQ ID NO: 151049 - DNA, 22 bp, Artificial Sequence
  chemically synthesized
tttctagctctctttttttttt

SEQ ID NO: 151050 - DNA, 22 bp, Artificial Sequence
  chemically synthesized
tctagctctctttttttttttt

SEQ ID NO: 151051 - DNA, 22 bp, Artificial Sequence
  chemically synthesized
ctagctctcttttttttttttt

SEQ ID NO: 151052 - DNA, 22 bp, Artificial Sequence
  chemically synthesized
tagctctctttttttttttttt

SEQ ID NO: 151053 - DNA, 22 bp, Artificial Sequence
  chemically synthesized
gctctcttttttttttttttga

SEQ ID NO: 151054 - DNA, 22 bp, Artificial Sequence
  chemically synthesized
tcttttttttttttttgacagg

SEQ ID NO: 151055 - DNA, 22 bp, Artificial Sequence
  chemically synthesized
ttttttttttttttgacagggt

SEQ ID NO: 151056 - DNA, 22 bp, Artificial Sequence
  chemically synthesized
ttttttttttttgacagggtct

SEQ ID NO: 151057 - DNA, 22 bp, Artificial Sequence
  chemically synthesized
tttttttttttgacagggtctc

SEQ ID NO: 151058 - DNA, 22 bp, Artificial Sequence
  chemically synthesized
ttttttttttgacagggtctcg

SEQ ID NO: 151059 - DNA, 22 bp, Artificial Sequence
  chemically synthesized
tttttttttgacagggtctcgc

SEQ ID NO: 151060 - DNA, 22 bp, Artificial Sequence
  chemically synthesized
ttttttttgacagggtctcgct

SEQ ID NO: 151061 - DNA, 22 bp, Artificial Sequence
  chemically synthesized
tttttttgacagggtctcgctg

SEQ ID NO: 151062 - DNA, 22 bp, Artificial Sequence
  chemically synthesized
ttttttgacagggtctcgctgt

SEQ ID NO: 151063 - DNA, 22 bp, Artificial Sequence
  chemically synthesized
tttttgacagggtctcgctgtg

SEQ ID NO: 151064 - DNA, 22 bp, Artificial Sequence
  chemically synthesized
ttttgacagggtctcgctgtgt

SEQ ID NO: 151065 - DNA, 22 bp, Artificial Sequence
  chemically synthesized
tttgacagggtctcgctgtgtt

SEQ ID NO: 151066 - DNA, 22 bp, Artificial Sequence
  chemically synthesized
ttgacagggtctcgctgtgttg

SEQ ID NO: 151067 - DNA, 22 bp, Artificial Sequence
  chemically synthesized
tgacagggtctcgctgtgttgc

SEQ ID NO: 151068 - DNA, 22 bp, Artificial Sequence
  chemically synthesized
gacagggtctcgctgtgttgcc

SEQ ID NO: 151069 - DNA, 22 bp, Artificial Sequence
  chemically synthesized
acagggtctcgctgtgttgccc

SEQ ID NO: 151070 - DNA, 22 bp, Artificial Sequence
  chemically synthesized
gctgtgttgcccaggttggagt

SEQ ID NO: 151071 - DNA, 22 bp, Artificial Sequence
  chemically synthesized
tgttgcccaggttggagtgcag

SEQ ID NO: 151072 - DNA, 22 bp, Artificial Sequence
  chemically synthesized
cccaggttggagtgcagtggta

SEQ ID NO: 151073 - DNA, 22 bp, Artificial Sequence
  chemically synthesized
gagtgcagtggtacaatctttg

SEQ ID NO: 151074 - DNA, 22 bp, Artificial Sequence
  chemically synthesized
tgctcactgcaatctccccctc

SEQ ID NO: 151075 - DNA, 22 bp, Artificial Sequence
  chemically synthesized
gctcactgcaatctccccctcc

SEQ ID NO: 151076 - DNA, 22 bp, Artificial Sequence
  chemically synthesized
ctcactgcaatctccccctcct

SEQ ID NO: 151077 - DNA, 22 bp, Artificial Sequence
  chemically synthesized
actgcaatctccccctccttgg

SEQ ID NO: 151078 - DNA, 22 bp, Artificial Sequence
  chemically synthesized
caatctccccctccttggctca

SEQ ID NO: 151079 - DNA, 22 bp, Artificial Sequence
  chemically synthesized
cccctccttggctcaagatatc

SEQ ID NO: 151080 - DNA, 22 bp, Artificial Sequence
  chemically synthesized
cttggctcaagatatccttcca

SEQ ID NO: 151081 - DNA, 22 bp, Artificial Sequence
  chemically synthesized
ggctcaagatatccttccacct

SEQ ID NO: 151082 - DNA, 22 bp, Artificial Sequence
  chemically synthesized
gctcaagatatccttccacctc

SEQ ID NO: 151083 - DNA, 22 bp, Artificial Sequence
  chemically synthesized
aagatatccttccacctcagcc

SEQ ID NO: 151084 - DNA, 22 bp, Artificial Sequence
  chemically synthesized
ccacctcagcctcccaagtagc

SEQ ID NO: 151085 - DNA, 22 bp, Artificial Sequence
  chemically synthesized
cacctcagcctcccaagtagct

SEQ ID NO: 151086 - DNA, 22 bp, Artificial Sequence
  chemically synthesized
agcctcccaagtagctgggact

SEQ ID NO: 151087 - DNA, 22 bp, Artificial Sequence
  chemically synthesized
ccaagtagctgggactacaggc

SEQ ID NO: 151088 - DNA, 22 bp, Artificial Sequence
  chemically synthesized
ggactacaggcacgtaacacca

SEQ ID NO: 151089 - DNA, 22 bp, Artificial Sequence
  chemically synthesized
caggcacgtaacaccatattcg

SEQ ID NO: 151090 - DNA, 22 bp, Artificial Sequence
  chemically synthesized
ggctactttttaaaattttttg

SEQ ID NO: 151091 - DNA, 22 bp, Artificial Sequence
  chemically synthesized
ctttttaaaattttttgtagag

SEQ ID NO: 151092 - DNA, 22 bp, Artificial Sequence
  chemically synthesized
tttaaaattttttgtagagagg

SEQ ID NO: 151093 - DNA, 22 bp, Artificial Sequence
  chemically synthesized
ttaaaattttttgtagagaggg

SEQ ID NO: 151094 - DNA, 22 bp, Artificial Sequence
  chemically synthesized
taaaattttttgtagagagggg

SEQ ID NO: 151095 - DNA, 22 bp, Artificial Sequence
  chemically synthesized
aaaattttttgtagagaggggt

SEQ ID NO: 151096 - DNA, 22 bp, Artificial Sequence
  chemically synthesized
aaattttttgtagagaggggtt

SEQ ID NO: 151097 - DNA, 22 bp, Artificial Sequence
  chemically synthesized
tttgtagagaggggtttctcca

SEQ ID NO: 151098 - DNA, 22 bp, Artificial Sequence
  chemically synthesized
ttgtagagaggggtttctccat

SEQ ID NO: 151099 - DNA, 22 bp, Artificial Sequence
  chemically synthesized
tgtagagaggggtttctccatg

SEQ ID NO: 151100 - DNA, 22 bp, Artificial Sequence
  chemically synthesized
gtagagaggggtttctccatgt

SEQ ID NO: 151101 - DNA, 22 bp, Artificial Sequence
  chemically synthesized
tagagaggggtttctccatgtt

SEQ ID NO: 151102 - DNA, 22 bp, Artificial Sequence
  chemically synthesized
ctccatgttgcccaagctggtc

SEQ ID NO: 151103 - DNA, 22 bp, Artificial Sequence
  chemically synthesized
tccatgttgcccaagctggtct

SEQ ID NO: 151104 - DNA, 22 bp, Artificial Sequence
  chemically synthesized
catgttgcccaagctggtctcc

SEQ ID NO: 151105 - DNA, 22 bp, Artificial Sequence
  chemically synthesized
cccaagctggtctccaactcct

SEQ ID NO: 151106 - DNA, 22 bp, Artificial Sequence
  chemically synthesized
gtctccaactcctgagctcaaa

SEQ ID NO: 151107 - DNA, 22 bp, Artificial Sequence
  chemically synthesized
caactcctgagctcaaatcgtt

SEQ ID NO: 151108 - DNA, 22 bp, Artificial Sequence
  chemically synthesized
ctgagctcaaatcgttctccct

SEQ ID NO: 151109 - DNA, 22 bp, Artificial Sequence
  chemically synthesized
agctcaaatcgttctccctccg

SEQ ID NO: 151110 - DNA, 22 bp, Artificial Sequence
  chemically synthesized
aaatcgttctccctccggcctc

SEQ ID NO: 151111 - DNA, 22 bp, Artificial Sequence
  chemically synthesized
tccctccggcctcggctgtgat

SEQ ID NO: 151112 - DNA, 22 bp, Artificial Sequence
  chemically synthesized
cctccggcctcggctgtgatta

SEQ ID NO: 151113 - DNA, 22 bp, Artificial Sequence
  chemically synthesized
cggcctcggctgtgattacagg

SEQ ID NO: 151114 - DNA, 22 bp, Artificial Sequence
  chemically synthesized
ggctgtgattacaggtgtgagc

SEQ ID NO: 151115 - DNA, 22 bp, Artificial Sequence
  chemically synthesized
tgattacaggtgtgagccactg

SEQ ID NO: 151116 - DNA, 22 bp, Artificial Sequence
  chemically synthesized
caggtgtgagccactgtgcttg

SEQ ID NO: 151117 - DNA, 22 bp, Artificial Sequence
  chemically synthesized
tgcttggcccagacaacatgaa

SEQ ID NO: 151118 - DNA, 22 bp, Artificial Sequence
  chemically synthesized
ggcccagacaacatgaactgtt

SEQ ID NO: 151119 - DNA, 22 bp, Artificial Sequence
  chemically synthesized
gcccagacaacatgaactgtta

SEQ ID NO: 151120 - DNA, 22 bp, Artificial Sequence
  chemically synthesized
ttactgttattttctaatcctt

SEQ ID NO: 151121 - DNA, 22 bp, Artificial Sequence
  chemically synthesized
ctgttattttctaatccttcga

SEQ ID NO: 151122 - DNA, 22 bp, Artificial Sequence
  chemically synthesized
ttattttctaatccttcgagga

SEQ ID NO: 151123 - DNA, 22 bp, Artificial Sequence
  chemically synthesized
ttttctaatccttcgaggaact

SEQ ID NO: 151124 - DNA, 22 bp, Artificial Sequence
  chemically synthesized
tctaatccttcgaggaactcaa

SEQ ID NO: 151125 - DNA, 22 bp, Artificial Sequence
  chemically synthesized
ctaatccttcgaggaactcaag

SEQ ID NO: 151126 - DNA, 22 bp, Artificial Sequence
  chemically synthesized
taatccttcgaggaactcaagt

SEQ ID NO: 151127 - DNA, 22 bp, Artificial Sequence
  chemically synthesized
atccttcgaggaactcaagtcc

SEQ ID NO: 151128 - DNA, 22 bp, Artificial Sequence
  chemically synthesized
cgaggaactcaagtcctatctt

SEQ ID NO: 151129 - DNA, 22 bp, Artificial Sequence
  chemically synthesized
gaggaactcaagtcctatcttg

SEQ ID NO: 151130 - DNA, 22 bp, Artificial Sequence
  chemically synthesized
aagtcctatcttgaaaactaat

SEQ ID NO: 151131 - DNA, 22 bp, Artificial Sequence
  chemically synthesized
tcttgaaaactaattcaaaagg

SEQ ID NO: 151132 - DNA, 22 bp, Artificial Sequence
  chemically synthesized
gaaaactaattcaaaaggtact

SEQ ID NO: 151133 - DNA, 22 bp, Artificial Sequence
  chemically synthesized
aaaactaattcaaaaggtacta

SEQ ID NO: 151134 - DNA, 22 bp, Artificial Sequence
  chemically synthesized
attcaaaaggtactaacgagat

SEQ ID NO: 151135 - DNA, 22 bp, Artificial Sequence
  chemically synthesized
aaaaggtactaacgagattagg

SEQ ID NO: 151136 - DNA, 22 bp, Artificial Sequence
  chemically synthesized
acgagattaggaagtgccccga

SEQ ID NO: 151137 - DNA, 22 bp, Artificial Sequence
  chemically synthesized
ggaagtgccccgagagagtgca

SEQ ID NO: 151138 - DNA, 22 bp, Artificial Sequence
  chemically synthesized
ggtttgctttgttagtgaagga

SEQ ID NO: 151139 - DNA, 22 bp, Artificial Sequence
  chemically synthesized
gctttgttagtgaaggaataaa

SEQ ID NO: 151140 - DNA, 22 bp, Artificial Sequence
  chemically synthesized
ctttgttagtgaaggaataaaa

SEQ ID NO: 151141 - DNA, 22 bp, Artificial Sequence
  chemically synthesized
tgttagtgaaggaataaaatgc

SEQ ID NO: 151142 - DNA, 22 bp, Artificial Sequence
  chemically synthesized
gttagtgaaggaataaaatgca

SEQ ID NO: 151143 - DNA, 22 bp, Artificial Sequence
  chemically synthesized
ttagtgaaggaataaaatgcat

SEQ ID NO: 151144 - DNA, 22 bp, Artificial Sequence
  chemically synthesized
gtgaaggaataaaatgcatcag

SEQ ID NO: 151145 - DNA, 22 bp, Artificial Sequence
  chemically synthesized
ctcagcctctgataggccctga

SEQ ID NO: 151146 - DNA, 22 bp, Artificial Sequence
  chemically synthesized
tcagcctctgataggccctgag

SEQ ID NO: 151147 - DNA, 22 bp, Artificial Sequence
  chemically synthesized
agcctctgataggccctgagct

SEQ ID NO: 151148 - DNA, 22 bp, Artificial Sequence
  chemically synthesized
tgataggccctgagctgggagc

SEQ ID NO: 151149 - DNA, 22 bp, Artificial Sequence
  chemically synthesized
ataggccctgagctgggagctg

SEQ ID NO: 151150 - DNA, 22 bp, Artificial Sequence
  chemically synthesized
agctgggagctgctaagccatc

SEQ ID NO: 151151 - DNA, 22 bp, Artificial Sequence
  chemically synthesized
ggagctgctaagccatcctgca

SEQ ID NO: 151152 - DNA, 22 bp, Artificial Sequence
  chemically synthesized
ctaagccatcctgcagagcaag

SEQ ID NO: 151153 - DNA, 22 bp, Artificial Sequence
  chemically synthesized
agccatcctgcagagcaagtgg

SEQ ID NO: 151154 - DNA, 22 bp, Artificial Sequence
  chemically synthesized
cagagcaagtgggagaaacaga

SEQ ID NO: 151155 - DNA, 22 bp, Artificial Sequence
  chemically synthesized
ggtcagacttggcagattctgc

SEQ ID NO: 151156 - DNA, 22 bp, Artificial Sequence
  chemically synthesized
ggcagattctgctcctttttcc

SEQ ID NO: 151157 - DNA, 22 bp, Artificial Sequence
  chemically synthesized
gcagattctgctcctttttccc

SEQ ID NO: 151158 - DNA, 22 bp, Artificial Sequence
  chemically synthesized
tgctcctttttcccttcccttt

SEQ ID NO: 151159 - DNA, 22 bp, Artificial Sequence
  chemically synthesized
ctcctttttcccttcccttttc

SEQ ID NO: 151160 - DNA, 22 bp, Artificial Sequence
  chemically synthesized
ctttttcccttcccttttcccc

SEQ ID NO: 151161 - DNA, 22 bp, Artificial Sequence
  chemically synthesized
tttcccttcccttttccccatc

SEQ ID NO: 151162 - DNA, 22 bp, Artificial Sequence
  chemically synthesized
ttcccttcccttttccccatcc

SEQ ID NO: 151163 - DNA, 22 bp, Artificial Sequence
  chemically synthesized
tcccttcccttttccccatcca

SEQ ID NO: 151164 - DNA, 22 bp, Artificial Sequence
  chemically synthesized
cccttcccttttccccatccac

SEQ ID NO: 151165 - DNA, 22 bp, Artificial Sequence
  chemically synthesized
ccttcccttttccccatccact

SEQ ID NO: 151166 - DNA, 22 bp, Artificial Sequence
  chemically synthesized
cccttttccccatccacttgct

SEQ ID NO: 151167 - DNA, 22 bp, Artificial Sequence
  chemically synthesized
ccttttccccatccacttgctc

SEQ ID NO: 151168 - DNA, 22 bp, Artificial Sequence
  chemically synthesized
ttccccatccacttgctcattc

SEQ ID NO: 151169 - DNA, 22 bp, Artificial Sequence
  chemically synthesized
tccccatccacttgctcattct

SEQ ID NO: 151170 - DNA, 22 bp, Artificial Sequence
  chemically synthesized
ccccatccacttgctcattctg

SEQ ID NO: 151171 - DNA, 22 bp, Artificial Sequence
  chemically synthesized
cccatccacttgctcattctgg

SEQ ID NO: 151172 - DNA, 22 bp, Artificial Sequence
  chemically synthesized
gctcattctggatggcaggatt

SEQ ID NO: 151173 - DNA, 22 bp, Artificial Sequence
  chemically synthesized
ctcattctggatggcaggatta

SEQ ID NO: 151174 - DNA, 22 bp, Artificial Sequence
  chemically synthesized
attctggatggcaggattaggc

SEQ ID NO: 151175 - DNA, 22 bp, Artificial Sequence
  chemically synthesized
tggatggcaggattaggcttta

SEQ ID NO: 151176 - DNA, 22 bp, Artificial Sequence
  chemically synthesized
gatggcaggattaggctttata

SEQ ID NO: 151177 - DNA, 22 bp, Artificial Sequence
  chemically synthesized
ggctttatatttccctaccata

SEQ ID NO: 151178 - DNA, 22 bp, Artificial Sequence
  chemically synthesized
tatatttccctaccatattagc

SEQ ID NO: 151179 - DNA, 22 bp, Artificial Sequence
  chemically synthesized
atatttccctaccatattagct

SEQ ID NO: 151180 - DNA, 22 bp, Artificial Sequence
  chemically synthesized
tatttccctaccatattagctt

SEQ ID NO: 151181 - DNA, 22 bp, Artificial Sequence
  chemically synthesized
ccctaccatattagcttgtgca

SEQ ID NO: 151182 - DNA, 22 bp, Artificial Sequence
  chemically synthesized
cctaccatattagcttgtgcac

SEQ ID NO: 151183 - DNA, 22 bp, Artificial Sequence
  chemically synthesized
ccatattagcttgtgcacttaa

SEQ ID NO: 151184 - DNA, 22 bp, Artificial Sequence
  chemically synthesized
gcttgtgcacttaaaggaagtt

SEQ ID NO: 151185 - DNA, 22 bp, Artificial Sequence
  chemically synthesized
gtgcacttaaaggaagtttaga

SEQ ID NO: 151186 - DNA, 22 bp, Artificial Sequence
  chemically synthesized
tgcacttaaaggaagtttagat

SEQ ID NO: 151187 - DNA, 22 bp, Artificial Sequence
  chemically synthesized
aaaggaagtttagatagccttg

SEQ ID NO: 151188 - DNA, 22 bp, Artificial Sequence
  chemically synthesized
aaggaagtttagatagccttga

SEQ ID NO: 151189 - DNA, 22 bp, Artificial Sequence
  chemically synthesized
agatagccttgactccatgggg

SEQ ID NO: 151190 - DNA, 22 bp, Artificial Sequence
  chemically synthesized
gatagccttgactccatgggga

SEQ ID NO: 151191 - DNA, 22 bp, Artificial Sequence
  chemically synthesized
gactccatggggaaaaggaaaa

SEQ ID NO: 151192 - DNA, 22 bp, Artificial Sequence
  chemically synthesized
actccatggggaaaaggaaaaa

SEQ ID NO: 151193 - DNA, 22 bp, Artificial Sequence
  chemically synthesized
catggggaaaaggaaaaagtac

SEQ ID NO: 151194 - DNA, 22 bp, Artificial Sequence
  chemically synthesized
agtggggtgtgggactgttgga

SEQ ID NO: 151195 - DNA, 22 bp, Artificial Sequence
  chemically synthesized
gtggggtgtgggactgttggat

SEQ ID NO: 151196 - DNA, 22 bp, Artificial Sequence
  chemically synthesized
ttggattattagatgtcttgca

SEQ ID NO: 151197 - DNA, 22 bp, Artificial Sequence
  chemically synthesized
gattattagatgtcttgcattt

SEQ ID NO: 151198 - DNA, 22 bp, Artificial Sequence
  chemically synthesized
ttagatgtcttgcatttctctc

SEQ ID NO: 151199 - DNA, 22 bp, Artificial Sequence
  chemically synthesized
gatgtcttgcatttctctcatt

SEQ ID NO: 151200 - DNA, 22 bp, Artificial Sequence
  chemically synthesized
gcatttctctcattctgttcca

SEQ ID NO: 151201 - DNA, 22 bp, Artificial Sequence
  chemically synthesized
catttctctcattctgttccag

SEQ ID NO: 151202 - DNA, 22 bp, Artificial Sequence
  chemically synthesized
ctctcattctgttccagttgag

SEQ ID NO: 151203 - DNA, 22 bp, Artificial Sequence
  chemically synthesized
tctcattctgttccagttgagg

SEQ ID NO: 151204 - DNA, 22 bp, Artificial Sequence
  chemically synthesized
tcattctgttccagttgaggcc

SEQ ID NO: 151205 - DNA, 22 bp, Artificial Sequence
  chemically synthesized
attctgttccagttgaggccag

SEQ ID NO: 151206 - DNA, 22 bp, Artificial Sequence
  chemically synthesized
tgttccagttgaggccagcttg

SEQ ID NO: 151207 - DNA, 22 bp, Artificial Sequence
  chemically synthesized
ttccagttgaggccagcttgct

SEQ ID NO: 151208 - DNA, 22 bp, Artificial Sequence
  chemically synthesized
cagttgaggccagcttgcttcc

SEQ ID NO: 151209 - DNA, 22 bp, Artificial Sequence
  chemically synthesized
aggccagcttgcttcccactag

SEQ ID NO: 151210 - DNA, 22 bp, Artificial Sequence
  chemically synthesized
gcttcccactagaagaataact

SEQ ID NO: 151211 - DNA, 22 bp, Artificial Sequence
  chemically synthesized
cttcccactagaagaataactg

SEQ ID NO: 151212 - DNA, 22 bp, Artificial Sequence
  chemically synthesized
cccactagaagaataactgttc

SEQ ID NO: 151213 - DNA, 22 bp, Artificial Sequence
  chemically synthesized
ccactagaagaataactgttct

SEQ ID NO: 151214 - DNA, 22 bp, Artificial Sequence
  chemically synthesized
gaagaataactgttctctttat

SEQ ID NO: 151215 - DNA, 22 bp, Artificial Sequence
  chemically synthesized
ttctctttatacaattcctagt

SEQ ID NO: 151216 - DNA, 22 bp, Artificial Sequence
  chemically synthesized
tctttatacaattcctagtcaa

SEQ ID NO: 151217 - DNA, 22 bp, Artificial Sequence
  chemically synthesized
tttatacaattcctagtcaagt

SEQ ID NO: 151218 - DNA, 22 bp, Artificial Sequence
  chemically synthesized
tatacaattcctagtcaagtag

SEQ ID NO: 151219 - DNA, 22 bp, Artificial Sequence
  chemically synthesized
atacaattcctagtcaagtagg

SEQ ID NO: 151220 - DNA, 22 bp, Artificial Sequence
  chemically synthesized
tacaattcctagtcaagtaggg

SEQ ID NO: 151221 - DNA, 22 bp, Artificial Sequence
  chemically synthesized
ctagtcaagtaggggcaaaaag

SEQ ID NO: 151222 - DNA, 22 bp, Artificial Sequence
  chemically synthesized
gtcaagtaggggcaaaaagtat

SEQ ID NO: 151223 - DNA, 22 bp, Artificial Sequence
  chemically synthesized
tcatttattattgtttttctgg

SEQ ID NO: 151224 - DNA, 22 bp, Artificial Sequence
  chemically synthesized
catttattattgtttttctggg

SEQ ID NO: 151225 - DNA, 22 bp, Artificial Sequence
  chemically synthesized
atttattattgtttttctggga

SEQ ID NO: 151226 - DNA, 22 bp, Artificial Sequence
  chemically synthesized
attattgtttttctgggatgta

SEQ ID NO: 151227 - DNA, 22 bp, Artificial Sequence
  chemically synthesized
ttattgtttttctgggatgtag

SEQ ID NO: 151228 - DNA, 22 bp, Artificial Sequence
  chemically synthesized
ttgtttttctgggatgtagcca

SEQ ID NO: 151229 - DNA, 22 bp, Artificial Sequence
  chemically synthesized
tttttctgggatgtagccagga

SEQ ID NO: 151230 - DNA, 22 bp, Artificial Sequence
  chemically synthesized
ttctgggatgtagccaggagca

SEQ ID NO: 151231 - DNA, 22 bp, Artificial Sequence
  chemically synthesized
tctgggatgtagccaggagcaa

SEQ ID NO: 151232 - DNA, 22 bp, Artificial Sequence
  chemically synthesized
ctgggatgtagccaggagcaat

SEQ ID NO: 151233 - DNA, 22 bp, Artificial Sequence
  chemically synthesized
tgggatgtagccaggagcaatt

SEQ ID NO: 151234 - DNA, 22 bp, Artificial Sequence
  chemically synthesized
ggatgtagccaggagcaattta

SEQ ID NO: 151235 - DNA, 22 bp, Artificial Sequence
  chemically synthesized
aaacttgctggagtgcaatttc

SEQ ID NO: 151236 - DNA, 22 bp, Artificial Sequence
  chemically synthesized
aacttgctggagtgcaatttct

SEQ ID NO: 151237 - DNA, 22 bp, Artificial Sequence
  chemically synthesized
gctggagtgcaatttcttcaac

SEQ ID NO: 151238 - DNA, 22 bp, Artificial Sequence
  chemically synthesized
ctggagtgcaatttcttcaact

SEQ ID NO: 151239 - DNA, 22 bp, Artificial Sequence
  chemically synthesized
gagtgcaatttcttcaactaca

SEQ ID NO: 151240 - DNA, 22 bp, Artificial Sequence
  chemically synthesized
cttcaactacaaatgagaataa

SEQ ID NO: 151241 - DNA, 22 bp, Artificial Sequence
  chemically synthesized
ttcaactacaaatgagaataat

SEQ ID NO: 151242 - DNA, 22 bp, Artificial Sequence
  chemically synthesized
caactacaaatgagaataataa

SEQ ID NO: 151243 - DNA, 22 bp, Artificial Sequence
  chemically synthesized
aactacaaatgagaataataat

SEQ ID NO: 151244 - DNA, 22 bp, Artificial Sequence
  chemically synthesized
caaatgagaataataataacag

SEQ ID NO: 151245 - DNA, 22 bp, Artificial Sequence
  chemically synthesized
cgaactaattgtaataatacag

SEQ ID NO: 151246 - DNA, 22 bp, Artificial Sequence
  chemically synthesized
attgtaataatacagaactaaa

SEQ ID NO: 151247 - DNA, 22 bp, Artificial Sequence
  chemically synthesized
taataatacagaactaaatgta

SEQ ID NO: 151248 - DNA, 22 bp, Artificial Sequence
  chemically synthesized
aatgtaaatatacaaaggataa

SEQ ID NO: 151249 - DNA, 22 bp, Artificial Sequence
  chemically synthesized
aaaatctgggcacatgcaggct

SEQ ID NO: 151250 - DNA, 22 bp, Artificial Sequence
  chemically synthesized
ggcacatgcaggctgctataag

SEQ ID NO: 151251 - DNA, 22 bp, Artificial Sequence
  chemically synthesized
ctataagagaaaacatctatga

SEQ ID NO: 151252 - DNA, 22 bp, Artificial Sequence
  chemically synthesized
taagagaaaacatctatgatat

SEQ ID NO: 151253 - DNA, 22 bp, Artificial Sequence
  chemically synthesized
tgatattataggttgaccaaat

SEQ ID NO: 151254 - DNA, 22 bp, Artificial Sequence
  chemically synthesized
taggttgaccaaatgacattaa

SEQ ID NO: 151255 - DNA, 22 bp, Artificial Sequence
  chemically synthesized
accaaatgacattaaattatag

SEQ ID NO: 151256 - DNA, 22 bp, Artificial Sequence
  chemically synthesized
aattatagtggggaggtaaaca

SEQ ID NO: 151257 - DNA, 22 bp, Artificial Sequence
  chemically synthesized
tagtggggaggtaaacaggttg

SEQ ID NO: 151258 - DNA, 22 bp, Artificial Sequence
  chemically synthesized
gcagtgtattttaaagttgaac

SEQ ID NO: 151259 - DNA, 22 bp, Artificial Sequence
  chemically synthesized
taaagttgaacatatgcatatt

SEQ ID NO: 151260 - DNA, 22 bp, Artificial Sequence
  chemically synthesized
aaagttgaacatatgcatattt

SEQ ID NO: 151261 - DNA, 22 bp, Artificial Sequence
  chemically synthesized
aagttgaacatatgcatatttt

SEQ ID NO: 151262 - DNA, 22 bp, Artificial Sequence
  chemically synthesized
aacatatgcatattttatgacc

SEQ ID NO: 151263 - DNA, 22 bp, Artificial Sequence
  chemically synthesized
tatgacctagcaatttacagaa

SEQ ID NO: 151264 - DNA, 22 bp, Artificial Sequence
  chemically synthesized
atgacctagcaatttacagaat

SEQ ID NO: 151265 - DNA, 22 bp, Artificial Sequence
  chemically synthesized
tgacctagcaatttacagaata

SEQ ID NO: 151266 - DNA, 22 bp, Artificial Sequence
  chemically synthesized
gcaatttacagaatatatatac

SEQ ID NO: 151267 - DNA, 22 bp, Artificial Sequence
  chemically synthesized
acagaatatatatacaaaaata

SEQ ID NO: 151268 - DNA, 22 bp, Artificial Sequence
  chemically synthesized
cagaatatatatacaaaaatat

SEQ ID NO: 151269 - DNA, 22 bp, Artificial Sequence
  chemically synthesized
catagcagcaatttatattata

SEQ ID NO: 151270 - DNA, 22 bp, Artificial Sequence
  chemically synthesized
atagcagcaatttatattatag

SEQ ID NO: 151271 - DNA, 22 bp, Artificial Sequence
  chemically synthesized
atattatagccaaaagctagaa

SEQ ID NO: 151272 - DNA, 22 bp, Artificial Sequence
  chemically synthesized
tattatagccaaaagctagaag

SEQ ID NO: 151273 - DNA, 22 bp, Artificial Sequence
  chemically synthesized
tagccaaaagctagaaggtact

SEQ ID NO: 151274 - DNA, 22 bp, Artificial Sequence
  chemically synthesized
gaaggtactcaaatatctatca

SEQ ID NO: 151275 - DNA, 22 bp, Artificial Sequence
  chemically synthesized
aaatatctatcaactgtggagt

SEQ ID NO: 151276 - DNA, 22 bp, Artificial Sequence
  chemically synthesized
tcaactgtggagtcaataaata

SEQ ID NO: 151277 - DNA, 22 bp, Artificial Sequence
  chemically synthesized
tggagtcaataaatatattgtg

SEQ ID NO: 151278 - DNA, 22 bp, Artificial Sequence
  chemically synthesized
tggtatatacataaaatagaat

SEQ ID NO: 151279 - DNA, 22 bp, Artificial Sequence
  chemically synthesized
agaaatgaaaaatcaactacag

SEQ ID NO: 151280 - DNA, 22 bp, Artificial Sequence
  chemically synthesized
cagtcatacactagtatgaatg

SEQ ID NO: 151281 - DNA, 22 bp, Artificial Sequence
  chemically synthesized
gtatgaatgcaattcacaaaca

SEQ ID NO: 151282 - DNA, 22 bp, Artificial Sequence
  chemically synthesized
acaaacataatattgaataaag

SEQ ID NO: 151283 - DNA, 22 bp, Artificial Sequence
  chemically synthesized
aataaagtcagacataagcaac

SEQ ID NO: 151284 - DNA, 22 bp, Artificial Sequence
  chemically synthesized
aatgtatacacacttttaaaaa

SEQ ID NO: 151285 - DNA, 22 bp, Artificial Sequence
  chemically synthesized
ttaaaaaaagggacatgagtca

SEQ ID NO: 151286 - DNA, 22 bp, Artificial Sequence
  chemically synthesized
taaaaaaagggacatgagtcaa

SEQ ID NO: 151287 - DNA, 22 bp, Artificial Sequence
  chemically synthesized
aaaaaaagggacatgagtcaat

SEQ ID NO: 151288 - DNA, 22 bp, Artificial Sequence
  chemically synthesized
aaaaaagggacatgagtcaatc

SEQ ID NO: 151289 - DNA, 22 bp, Artificial Sequence
  chemically synthesized
tatcaggataattattaacttt

SEQ ID NO: 151290 - DNA, 22 bp, Artificial Sequence
  chemically synthesized
ttaactttggagacaattagtg

SEQ ID NO: 151291 - DNA, 22 bp, Artificial Sequence
  chemically synthesized
actttggagacaattagtggaa

SEQ ID NO: 151292 - DNA, 22 bp, Artificial Sequence
  chemically synthesized
tggagacaattagtggaatgat

SEQ ID NO: 151293 - DNA, 22 bp, Artificial Sequence
  chemically synthesized
ggagacaattagtggaatgata

SEQ ID NO: 151294 - DNA, 22 bp, Artificial Sequence
  chemically synthesized
gagacaattagtggaatgataa

SEQ ID NO: 151295 - DNA, 22 bp, Artificial Sequence
  chemically synthesized
gtggaatgataaagagtgagca

SEQ ID NO: 151296 - DNA, 22 bp, Artificial Sequence
  chemically synthesized
actctttaatttcctatcttat

SEQ ID NO: 151297 - DNA, 22 bp, Artificial Sequence
  chemically synthesized
ctctttaatttcctatcttatt

SEQ ID NO: 151298 - DNA, 22 bp, Artificial Sequence
  chemically synthesized
tttaatttcctatcttattagt

SEQ ID NO: 151299 - DNA, 22 bp, Artificial Sequence
  chemically synthesized
taatttcctatcttattagttg

SEQ ID NO: 151300 - DNA, 22 bp, Artificial Sequence
  chemically synthesized
aatttcctatcttattagttgt

SEQ ID NO: 151301 - DNA, 22 bp, Artificial Sequence
  chemically synthesized
atttcctatcttattagttgtt

SEQ ID NO: 151302 - DNA, 22 bp, Artificial Sequence
  chemically synthesized
cctatcttattagttgttacat

SEQ ID NO: 151303 - DNA, 22 bp, Artificial Sequence
  chemically synthesized
ctatcttattagttgttacatg

SEQ ID NO: 151304 - DNA, 22 bp, Artificial Sequence
  chemically synthesized
tcttattagttgttacatgggt

SEQ ID NO: 151305 - DNA, 22 bp, Artificial Sequence
  chemically synthesized
attagttgttacatgggtgtgt

SEQ ID NO: 151306 - DNA, 22 bp, Artificial Sequence
  chemically synthesized
ttagttgttacatgggtgtgtt

SEQ ID NO: 151307 - DNA, 22 bp, Artificial Sequence
  chemically synthesized
gttgttacatgggtgtgttcac

SEQ ID NO: 151308 - DNA, 22 bp, Artificial Sequence
  chemically synthesized
ttacatgggtgtgttcaccttc

SEQ ID NO: 151309 - DNA, 22 bp, Artificial Sequence
  chemically synthesized
catgggtgtgttcaccttccaa

SEQ ID NO: 151310 - DNA, 22 bp, Artificial Sequence
  chemically synthesized
accttccaaaagttaattcagc

SEQ ID NO: 151311 - DNA, 22 bp, Artificial Sequence
  chemically synthesized
ccaaaagttaattcagctgtgc

SEQ ID NO: 151312 - DNA, 22 bp, Artificial Sequence
  chemically synthesized
caaaagttaattcagctgtgca

SEQ ID NO: 151313 - DNA, 22 bp, Artificial Sequence
  chemically synthesized
attcagctgtgcatgtataatt

SEQ ID NO: 151314 - DNA, 22 bp, Artificial Sequence
  chemically synthesized
agctgtgcatgtataatttgtg

SEQ ID NO: 151315 - DNA, 22 bp, Artificial Sequence
  chemically synthesized
tgcatgtataatttgtgtactt

SEQ ID NO: 151316 - DNA, 22 bp, Artificial Sequence
  chemically synthesized
gtgtacttttatatatgcatgc

SEQ ID NO: 151317 - DNA, 22 bp, Artificial Sequence
  chemically synthesized
tgtacttttatatatgcatgct

SEQ ID NO: 151318 - DNA, 22 bp, Artificial Sequence
  chemically synthesized
ttatatatgcatgctgtactta

SEQ ID NO: 151319 - DNA, 22 bp, Artificial Sequence
  chemically synthesized
tatatatgcatgctgtacttaa

SEQ ID NO: 151320 - DNA, 22 bp, Artificial Sequence
  chemically synthesized
atatatgcatgctgtacttaaa

SEQ ID NO: 151321 - DNA, 22 bp, Artificial Sequence
  chemically synthesized
tatatgcatgctgtacttaaaa

SEQ ID NO: 151322 - DNA, 22 bp, Artificial Sequence
  chemically synthesized
tacttaaaatattaaaataaaa

SEQ ID NO: 151323 - DNA, 22 bp, Artificial Sequence
  chemically synthesized
aaaatattaaaataaaaactaa

SEQ ID NO: 151324 - DNA, 22 bp, Artificial Sequence
  chemically synthesized
aaatattaaaataaaaactaaa

SEQ ID NO: 151325 - DNA, 22 bp, Artificial Sequence
  chemically synthesized
aaataaaaactaaatttagaaa

SEQ ID NO: 151326 - DNA, 22 bp, Artificial Sequence
  chemically synthesized
aatttagaaactaaacaatgga

SEQ ID NO: 151327 - DNA, 22 bp, Artificial Sequence
  chemically synthesized
agaaactaaacaatggaaaaaa

SEQ ID NO: 151328 - DNA, 22 bp, Artificial Sequence
  chemically synthesized
gaaactaaacaatggaaaaaag

SEQ ID NO: 151329 - DNA, 22 bp, Artificial Sequence
  chemically synthesized
aacaatggaaaaaagtcagacc

SEQ ID NO: 151330 - DNA, 22 bp, Artificial Sequence
  chemically synthesized
ctttgcatttcaagaagtgcat

SEQ ID NO: 151331 - DNA, 22 bp, Artificial Sequence
  chemically synthesized
tttgcatttcaagaagtgcata

SEQ ID NO: 151332 - DNA, 22 bp, Artificial Sequence
  chemically synthesized
tgcatttcaagaagtgcatact

SEQ ID NO: 151333 - DNA, 22 bp, Artificial Sequence
  chemically synthesized
gcatttcaagaagtgcatacta

SEQ ID NO: 151334 - DNA, 22 bp, Artificial Sequence
  chemically synthesized
catttcaagaagtgcatactaa

SEQ ID NO: 151335 - DNA, 22 bp, Artificial Sequence
  chemically synthesized
caagaagtgcatactaactgag

SEQ ID NO: 151336 - DNA, 22 bp, Artificial Sequence
  chemically synthesized
aagaagtgcatactaactgaga

SEQ ID NO: 151337 - DNA, 22 bp, Artificial Sequence
  chemically synthesized
actgagatattacattcttaaa

SEQ ID NO: 151338 - DNA, 22 bp, Artificial Sequence
  chemically synthesized
agatattacattcttaaatggc

SEQ ID NO: 151339 - DNA, 22 bp, Artificial Sequence
  chemically synthesized
cattcttaaatggctttagtca

SEQ ID NO: 151340 - DNA, 22 bp, Artificial Sequence
  chemically synthesized
ttaaatggctttagtcaattag

SEQ ID NO: 151341 - DNA, 22 bp, Artificial Sequence
  chemically synthesized
aaatggctttagtcaattaggc

SEQ ID NO: 151342 - DNA, 22 bp, Artificial Sequence
  chemically synthesized
aatggctttagtcaattaggct

SEQ ID NO: 151343 - DNA, 22 bp, Artificial Sequence
  chemically synthesized
tagtcaattaggctttaaattt

SEQ ID NO: 151344 - DNA, 22 bp, Artificial Sequence
  chemically synthesized
agtcaattaggctttaaatttc

SEQ ID NO: 151345 - DNA, 22 bp, Artificial Sequence
  chemically synthesized
gtcaattaggctttaaatttca

SEQ ID NO: 151346 - DNA, 22 bp, Artificial Sequence
  chemically synthesized
ggctttaaatttcaccactata

SEQ ID NO: 151347 - DNA, 22 bp, Artificial Sequence
  chemically synthesized
taaatttcaccactatataaac

SEQ ID NO: 151348 - DNA, 22 bp, Artificial Sequence
  chemically synthesized
aaatttcaccactatataaaca

SEQ ID NO: 151349 - DNA, 22 bp, Artificial Sequence
  chemically synthesized
aatttcaccactatataaacat

SEQ ID NO: 151350 - DNA, 22 bp, Artificial Sequence
  chemically synthesized
caccactatataaacatttgct

SEQ ID NO: 151351 - DNA, 22 bp, Artificial Sequence
  chemically synthesized
accactatataaacatttgctt

SEQ ID NO: 151352 - DNA, 22 bp, Artificial Sequence
  chemically synthesized
tataaacatttgcttctaaatc

SEQ ID NO: 151353 - DNA, 22 bp, Artificial Sequence
  chemically synthesized
gcttctaaatctaggtagactg

SEQ ID NO: 151354 - DNA, 22 bp, Artificial Sequence
  chemically synthesized
cttctaaatctaggtagactgt

SEQ ID NO: 151355 - DNA, 22 bp, Artificial Sequence
  chemically synthesized
ctaaatctaggtagactgtctt

SEQ ID NO: 151356 - DNA, 22 bp, Artificial Sequence
  chemically synthesized
taaatctaggtagactgtctta

SEQ ID NO: 151357 - DNA, 22 bp, Artificial Sequence
  chemically synthesized
aatctaggtagactgtcttaac

SEQ ID NO: 151358 - DNA, 22 bp, Artificial Sequence
  chemically synthesized
ggtagactgtcttaacttcctg

SEQ ID NO: 151359 - DNA, 22 bp, Artificial Sequence
  chemically synthesized
tcttaacttcctgaagaagagg

SEQ ID NO: 151360 - DNA, 22 bp, Artificial Sequence
  chemically synthesized
aacttcctgaagaagagggaag

SEQ ID NO: 151361 - DNA, 22 bp, Artificial Sequence
  chemically synthesized
acttcctgaagaagagggaaga

SEQ ID NO: 151362 - DNA, 22 bp, Artificial Sequence
  chemically synthesized
cctgaagaagagggaagaaata

SEQ ID NO: 151363 - DNA, 22 bp, Artificial Sequence
  chemically synthesized
ctgaagaagagggaagaaataa

SEQ ID NO: 151364 - DNA, 22 bp, Artificial Sequence
  chemically synthesized
aagaagagggaagaaataatga

SEQ ID NO: 151365 - DNA, 22 bp, Artificial Sequence
  chemically synthesized
gaggagggaaataaaaagccta

SEQ ID NO: 151366 - DNA, 22 bp, Artificial Sequence
  chemically synthesized
ggaaagcaacatgaaaagatgg

SEQ ID NO: 151367 - DNA, 22 bp, Artificial Sequence
  chemically synthesized
tctggtacatcctgtgcttcct

SEQ ID NO: 151368 - DNA, 22 bp, Artificial Sequence
  chemically synthesized
tggtacatcctgtgcttcctga

SEQ ID NO: 151369 - DNA, 22 bp, Artificial Sequence
  chemically synthesized
gtacatcctgtgcttcctgaga

SEQ ID NO: 151370 - DNA, 22 bp, Artificial Sequence
  chemically synthesized
tgcttcctgagatgttgttatt

SEQ ID NO: 151371 - DNA, 22 bp, Artificial Sequence
  chemically synthesized
cctgagatgttgttattcgtct

SEQ ID NO: 151372 - DNA, 22 bp, Artificial Sequence
  chemically synthesized
ctgagatgttgttattcgtctt

SEQ ID NO: 151373 - DNA, 22 bp, Artificial Sequence
  chemically synthesized
agatgttgttattcgtctttta

SEQ ID NO: 151374 - DNA, 22 bp, Artificial Sequence
  chemically synthesized
ttattcgtcttttacacacact

SEQ ID NO: 151375 - DNA, 22 bp, Artificial Sequence
  chemically synthesized
ttcgtcttttacacacactgtc

SEQ ID NO: 151376 - DNA, 22 bp, Artificial Sequence
  chemically synthesized
gtcttttacacacactgtcttg

SEQ ID NO: 151377 - DNA, 22 bp, Artificial Sequence
  chemically synthesized
ttacacacactgtcttgggatg

SEQ ID NO: 151378 - DNA, 22 bp, Artificial Sequence
  chemically synthesized
tacacacactgtcttgggatgg

SEQ ID NO: 151379 - DNA, 22 bp, Artificial Sequence
  chemically synthesized
acacacactgtcttgggatggg

SEQ ID NO: 151380 - DNA, 22 bp, Artificial Sequence
  chemically synthesized
cacacactgtcttgggatgggc

SEQ ID NO: 151381 - DNA, 22 bp, Artificial Sequence
  chemically synthesized
tcttgggatgggcattaaggtg

SEQ ID NO: 151382 - DNA, 22 bp, Artificial Sequence
  chemically synthesized
gggatgggcattaaggtgttgt

SEQ ID NO: 151383 - DNA, 22 bp, Artificial Sequence
  chemically synthesized
ggatgggcattaaggtgttgta

SEQ ID NO: 151384 - DNA, 22 bp, Artificial Sequence
  chemically synthesized
aggtgttgtagctactcagcta

SEQ ID NO: 151385 - DNA, 22 bp, Artificial Sequence
  chemically synthesized
tagctactcagctagtaagtag

SEQ ID NO: 151386 - DNA, 22 bp, Artificial Sequence
  chemically synthesized
ctcagctagtaagtagctgagc

SEQ ID NO: 151387 - DNA, 22 bp, Artificial Sequence
  chemically synthesized
agctagtaagtagctgagctaa

SEQ ID NO: 151388 - DNA, 22 bp, Artificial Sequence
  chemically synthesized
gtaagtagctgagctaagattc

SEQ ID NO: 151389 - DNA, 22 bp, Artificial Sequence
  chemically synthesized
agctaagattctttcaattcca

SEQ ID NO: 151390 - DNA, 22 bp, Artificial Sequence
  chemically synthesized
agattctttcaattccaaagtc

SEQ ID NO: 151391 - DNA, 22 bp, Artificial Sequence
  chemically synthesized
tttcaattccaaagtcagcagt

SEQ ID NO: 151392 - DNA, 22 bp, Artificial Sequence
  chemically synthesized
tcaattccaaagtcagcagtgt

SEQ ID NO: 151393 - DNA, 22 bp, Artificial Sequence
  chemically synthesized
caattccaaagtcagcagtgtc

SEQ ID NO: 151394 - DNA, 22 bp, Artificial Sequence
  chemically synthesized
aattccaaagtcagcagtgtct

SEQ ID NO: 151395 - DNA, 22 bp, Artificial Sequence
  chemically synthesized
caaagtcagcagtgtcttcact

SEQ ID NO: 151396 - DNA, 22 bp, Artificial Sequence
  chemically synthesized
cactacatggtactatgtcaag

SEQ ID NO: 151397 - DNA, 22 bp, Artificial Sequence
  chemically synthesized
actacatggtactatgtcaaga

SEQ ID NO: 151398 - DNA, 22 bp, Artificial Sequence
  chemically synthesized
catggtactatgtcaagaaaga

SEQ ID NO: 151399 - DNA, 22 bp, Artificial Sequence
  chemically synthesized
tgtcaagaaagagaaactccac

SEQ ID NO: 151400 - DNA, 22 bp, Artificial Sequence
  chemically synthesized
cactaaaaagaacttcattgct

SEQ ID NO: 151401 - DNA, 22 bp, Artificial Sequence
  chemically synthesized
aaaagaacttcattgctctctg

SEQ ID NO: 151402 - DNA, 22 bp, Artificial Sequence
  chemically synthesized
cattgctctctgttagggatac

SEQ ID NO: 151403 - DNA, 22 bp, Artificial Sequence
  chemically synthesized
attgctctctgttagggataca

SEQ ID NO: 151404 - DNA, 22 bp, Artificial Sequence
  chemically synthesized
ctctctgttagggatacattaa

SEQ ID NO: 151405 - DNA, 22 bp, Artificial Sequence
  chemically synthesized
tctgttagggatacattaacat

SEQ ID NO: 151406 - DNA, 22 bp, Artificial Sequence
  chemically synthesized
tgttagggatacattaacattt

SEQ ID NO: 151407 - DNA, 22 bp, Artificial Sequence
  chemically synthesized
ttagggatacattaacattttg

SEQ ID NO: 151408 - DNA, 22 bp, Artificial Sequence
  chemically synthesized
gggatacattaacattttggga

SEQ ID NO: 151409 - DNA, 22 bp, Artificial Sequence
  chemically synthesized
acattttgggacatgaaaaaaa

SEQ ID NO: 151410 - DNA, 22 bp, Artificial Sequence
  chemically synthesized
tgggacatgaaaaaaaaatgtt

SEQ ID NO: 151411 - DNA, 22 bp, Artificial Sequence
  chemically synthesized
gggacatgaaaaaaaaatgtta

SEQ ID NO: 151412 - DNA, 22 bp, Artificial Sequence
  chemically synthesized
ggacatgaaaaaaaaatgttac

SEQ ID NO: 151413 - DNA, 22 bp, Artificial Sequence
  chemically synthesized
caatagcttacaggtcacctcc

SEQ ID NO: 151414 - DNA, 22 bp, Artificial Sequence
  chemically synthesized
acaggtcacctccacttatatg

SEQ ID NO: 151415 - DNA, 22 bp, Artificial Sequence
  chemically synthesized
caggtcacctccacttatatga

SEQ ID NO: 151416 - DNA, 22 bp, Artificial Sequence
  chemically synthesized
cacttatatgacctatggacct

SEQ ID NO: 151417 - DNA, 22 bp, Artificial Sequence
  chemically synthesized
atatgacctatggacctcttaa

SEQ ID NO: 151418 - DNA, 22 bp, Artificial Sequence
  chemically synthesized
tatgacctatggacctcttaaa

SEQ ID NO: 151419 - DNA, 22 bp, Artificial Sequence
  chemically synthesized
tggacctcttaaactcagcgag

SEQ ID NO: 151420 - DNA, 22 bp, Artificial Sequence
  chemically synthesized
ttaaactcagcgagttgaaaag

SEQ ID NO: 151421 - DNA, 22 bp, Artificial Sequence
  chemically synthesized
aaactcagcgagttgaaaagat

SEQ ID NO: 151422 - DNA, 22 bp, Artificial Sequence
  chemically synthesized
aactcagcgagttgaaaagata

SEQ ID NO: 151423 - DNA, 22 bp, Artificial Sequence
  chemically synthesized
agcgagttgaaaagatagtaaa

SEQ ID NO: 151424 - DNA, 22 bp, Artificial Sequence
  chemically synthesized
aaaagatagtaaattatcctcc

SEQ ID NO: 151425 - DNA, 22 bp, Artificial Sequence
  chemically synthesized
tcctccacttctttcagtttcc

SEQ ID NO: 151426 - DNA, 22 bp, Artificial Sequence
  chemically synthesized
cacttctttcagtttcctctaa

SEQ ID NO: 151427 - DNA, 22 bp, Artificial Sequence
  chemically synthesized
ctttcagtttcctctaatgctt

SEQ ID NO: 151428 - DNA, 22 bp, Artificial Sequence
  chemically synthesized
tttcagtttcctctaatgcttc

SEQ ID NO: 151429 - DNA, 22 bp, Artificial Sequence
  chemically synthesized
tcagtttcctctaatgcttcca

SEQ ID NO: 151430 - DNA, 22 bp, Artificial Sequence
  chemically synthesized
cagtttcctctaatgcttccaa

SEQ ID NO: 151431 - DNA, 22 bp, Artificial Sequence
  chemically synthesized
agtttcctctaatgcttccaaa

SEQ ID NO: 151432 - DNA, 22 bp, Artificial Sequence
  chemically synthesized
cctctaatgcttccaaacttga

SEQ ID NO: 151433 - DNA, 22 bp, Artificial Sequence
  chemically synthesized
ctctaatgcttccaaacttgat

SEQ ID NO: 151434 - DNA, 22 bp, Artificial Sequence
  chemically synthesized
taatgcttccaaacttgatgaa

SEQ ID NO: 151435 - DNA, 22 bp, Artificial Sequence
  chemically synthesized
atgcttccaaacttgatgaatg

SEQ ID NO: 151436 - DNA, 22 bp, Artificial Sequence
  chemically synthesized
ccaaacttgatgaatggttcac

SEQ ID NO: 151437 - DNA, 22 bp, Artificial Sequence
  chemically synthesized
caaacttgatgaatggttcact

SEQ ID NO: 151438 - DNA, 22 bp, Artificial Sequence
  chemically synthesized
gatgaatggttcactcagattt

SEQ ID NO: 151439 - DNA, 22 bp, Artificial Sequence
  chemically synthesized
atgaatggttcactcagatttc

SEQ ID NO: 151440 - DNA, 22 bp, Artificial Sequence
  chemically synthesized
actcagatttccaagacaaaat

SEQ ID NO: 151441 - DNA, 22 bp, Artificial Sequence
  chemically synthesized
agatttccaagacaaaattttg

SEQ ID NO: 151442 - DNA, 22 bp, Artificial Sequence
  chemically synthesized
ccaagacaaaattttgtcaatc

SEQ ID NO: 151443 - DNA, 22 bp, Artificial Sequence
  chemically synthesized
caagacaaaattttgtcaatca

SEQ ID NO: 151444 - DNA, 22 bp, Artificial Sequence
  chemically synthesized
tgtcaatcatttttgcctttac

SEQ ID NO: 151445 - DNA, 22 bp, Artificial Sequence
  chemically synthesized
gtcaatcatttttgcctttact

SEQ ID NO: 151446 - DNA, 22 bp, Artificial Sequence
  chemically synthesized
tcaatcatttttgcctttactc

SEQ ID NO: 151447 - DNA, 22 bp, Artificial Sequence
  chemically synthesized
ttgcctttactctccactctct

SEQ ID NO: 151448 - DNA, 22 bp, Artificial Sequence
  chemically synthesized
tgcctttactctccactctctt

SEQ ID NO: 151449 - DNA, 22 bp, Artificial Sequence
  chemically synthesized
gcctttactctccactctcttc

SEQ ID NO: 151450 - DNA, 22 bp, Artificial Sequence
  chemically synthesized
cctttactctccactctcttct

SEQ ID NO: 151451 - DNA, 22 bp, Artificial Sequence
  chemically synthesized
tactctccactctcttctatcc

SEQ ID NO: 151452 - DNA, 22 bp, Artificial Sequence
  chemically synthesized
actctccactctcttctatccc

SEQ ID NO: 151453 - DNA, 22 bp, Artificial Sequence
  chemically synthesized
ctctccactctcttctatccct

SEQ ID NO: 151454 - DNA, 22 bp, Artificial Sequence
  chemically synthesized
tccactctcttctatcccttat

SEQ ID NO: 151455 - DNA, 22 bp, Artificial Sequence
  chemically synthesized
cactctcttctatcccttatat

SEQ ID NO: 151456 - DNA, 22 bp, Artificial Sequence
  chemically synthesized
tcttctatcccttatatatatt

SEQ ID NO: 151457 - DNA, 22 bp, Artificial Sequence
  chemically synthesized
ttctatcccttatatatattta

SEQ ID NO: 151458 - DNA, 22 bp, Artificial Sequence
  chemically synthesized
ctatcccttatatatatttaat

SEQ ID NO: 151459 - DNA, 22 bp, Artificial Sequence
  chemically synthesized
tatcccttatatatatttaata

SEQ ID NO: 151460 - DNA, 22 bp, Artificial Sequence
  chemically synthesized
tcccttatatatatttaataat

SEQ ID NO: 151461 - DNA, 22 bp, Artificial Sequence
  chemically synthesized
atatatatttaataatcaattt

SEQ ID NO: 151462 - DNA, 22 bp, Artificial Sequence
  chemically synthesized
tatatatttaataatcaatttc

SEQ ID NO: 151463 - DNA, 22 bp, Artificial Sequence
  chemically synthesized
aataatcaatttctcacaacta

SEQ ID NO: 151464 - DNA, 22 bp, Artificial Sequence
  chemically synthesized
ataatcaatttctcacaactag

SEQ ID NO: 151465 - DNA, 22 bp, Artificial Sequence
  chemically synthesized
ctcacaactagaattattatca

SEQ ID NO: 151466 - DNA, 22 bp, Artificial Sequence
  chemically synthesized
tcacaactagaattattatcat

SEQ ID NO: 151467 - DNA, 22 bp, Artificial Sequence
  chemically synthesized
acaactagaattattatcataa

SEQ ID NO: 151468 - DNA, 22 bp, Artificial Sequence
  chemically synthesized
gaattattatcataaatactga

SEQ ID NO: 151469 - DNA, 22 bp, Artificial Sequence
  chemically synthesized
ttatcataaatactgatagctt

SEQ ID NO: 151470 - DNA, 22 bp, Artificial Sequence
  chemically synthesized
tcataaatactgatagcttttg

SEQ ID NO: 151471 - DNA, 22 bp, Artificial Sequence
  chemically synthesized
atagcttttgagtggcagataa

SEQ ID NO: 151472 - DNA, 22 bp, Artificial Sequence
  chemically synthesized
ttgagtggcagataatgagccg

SEQ ID NO: 151473 - DNA, 22 bp, Artificial Sequence
  chemically synthesized
tgagtggcagataatgagccgt

SEQ ID NO: 151474 - DNA, 22 bp, Artificial Sequence
  chemically synthesized
gagtggcagataatgagccgtt

SEQ ID NO: 151475 - DNA, 22 bp, Artificial Sequence
  chemically synthesized
agtggcagataatgagccgttt

SEQ ID NO: 151476 - DNA, 22 bp, Artificial Sequence
  chemically synthesized
ttatatattatcatcataccaa

SEQ ID NO: 151477 - DNA, 22 bp, Artificial Sequence
  chemically synthesized
tatatattatcatcataccaac

SEQ ID NO: 151478 - DNA, 22 bp, Artificial Sequence
  chemically synthesized
atatattatcatcataccaaca

SEQ ID NO: 151479 - DNA, 22 bp, Artificial Sequence
  chemically synthesized
tatattatcatcataccaacaa

SEQ ID NO: 151480 - DNA, 22 bp, Artificial Sequence
  chemically synthesized
tcatcataccaacaatattttt

SEQ ID NO: 151481 - DNA, 22 bp, Artificial Sequence
  chemically synthesized
ttaaaaattgtgcagctaagtg

SEQ ID NO: 151482 - DNA, 22 bp, Artificial Sequence
  chemically synthesized
taaaaattgtgcagctaagtgt

SEQ ID NO: 151483 - DNA, 22 bp, Artificial Sequence
  chemically synthesized
aaaaattgtgcagctaagtgtt

SEQ ID NO: 151484 - DNA, 22 bp, Artificial Sequence
  chemically synthesized
aaaattgtgcagctaagtgttg

SEQ ID NO: 151485 - DNA, 22 bp, Artificial Sequence
  chemically synthesized
tgcagctaagtgttgagctaaa

SEQ ID NO: 151486 - DNA, 22 bp, Artificial Sequence
  chemically synthesized
agtgttgagctaaaaattatat

SEQ ID NO: 151487 - DNA, 22 bp, Artificial Sequence
  chemically synthesized
agctaaaaattatatacctaag

SEQ ID NO: 151488 - DNA, 22 bp, Artificial Sequence
  chemically synthesized
aaaattatatacctaagaaatg

SEQ ID NO: 151489 - DNA, 22 bp, Artificial Sequence
  chemically synthesized
tatacctaagaaatgacaaaac

SEQ ID NO: 151490 - DNA, 22 bp, Artificial Sequence
  chemically synthesized
agaaatgacaaaaccaagattt

SEQ ID NO: 151491 - DNA, 22 bp, Artificial Sequence
  chemically synthesized
gaaaccagttctcactgaccag

SEQ ID NO: 151492 - DNA, 22 bp, Artificial Sequence
  chemically synthesized
aaaccagttctcactgaccaga

SEQ ID NO: 151493 - DNA, 22 bp, Artificial Sequence
  chemically synthesized
tcactgaccagaagatcattct

SEQ ID NO: 151494 - DNA, 22 bp, Artificial Sequence
  chemically synthesized
actgaccagaagatcattcttt

SEQ ID NO: 151495 - DNA, 22 bp, Artificial Sequence
  chemically synthesized
accagaagatcattctttcagc

SEQ ID NO: 151496 - DNA, 22 bp, Artificial Sequence
  chemically synthesized
tttcagctaaggagctaattac

SEQ ID NO: 151497 - DNA, 22 bp, Artificial Sequence
  chemically synthesized
tcagctaaggagctaattactg

SEQ ID NO: 151498 - DNA, 22 bp, Artificial Sequence
  chemically synthesized
cagctaaggagctaattactgc

SEQ ID NO: 151499 - DNA, 22 bp, Artificial Sequence
  chemically synthesized
agctaaggagctaattactgcg

SEQ ID NO: 151500 - DNA, 22 bp, Artificial Sequence
  chemically synthesized
aggagctaattactgcgttcct

SEQ ID NO: 151501 - DNA, 22 bp, Artificial Sequence
  chemically synthesized
attactgcgttccttcatagtt

SEQ ID NO: 151502 - DNA, 22 bp, Artificial Sequence
  chemically synthesized
ctgcgttccttcatagtttttt

SEQ ID NO: 151503 - DNA, 22 bp, Artificial Sequence
  chemically synthesized
cgttccttcatagttttttttt

SEQ ID NO: 151504 - DNA, 22 bp, Artificial Sequence
  chemically synthesized
cttcatagtttttttttttcct

SEQ ID NO: 151505 - DNA, 22 bp, Artificial Sequence
  chemically synthesized
catagtttttttttttcctctc

SEQ ID NO: 151506 - DNA, 22 bp, Artificial Sequence
  chemically synthesized
atagtttttttttttcctctca

SEQ ID NO: 151507 - DNA, 22 bp, Artificial Sequence
  chemically synthesized
ttttttttcctctcaggtattc

SEQ ID NO: 151508 - DNA, 22 bp, Artificial Sequence
  chemically synthesized
tttttttcctctcaggtattcc

SEQ ID NO: 151509 - DNA, 22 bp, Artificial Sequence
  chemically synthesized
ttttttcctctcaggtattccc

SEQ ID NO: 151510 - DNA, 22 bp, Artificial Sequence
  chemically synthesized
tttttcctctcaggtattccct

SEQ ID NO: 151511 - DNA, 22 bp, Artificial Sequence
  chemically synthesized
ttttcctctcaggtattccctg

SEQ ID NO: 151512 - DNA, 22 bp, Artificial Sequence
  chemically synthesized
tttcctctcaggtattccctga

SEQ ID NO: 151513 - DNA, 22 bp, Artificial Sequence
  chemically synthesized
ttcctctcaggtattccctgaa

SEQ ID NO: 151514 - DNA, 22 bp, Artificial Sequence
  chemically synthesized
tcctctcaggtattccctgaaa

SEQ ID NO: 151515 - DNA, 22 bp, Artificial Sequence
  chemically synthesized
cctctcaggtattccctgaaat

SEQ ID NO: 151516 - DNA, 22 bp, Artificial Sequence
  chemically synthesized
ctctcaggtattccctgaaata

SEQ ID NO: 151517 - DNA, 22 bp, Artificial Sequence
  chemically synthesized
tcaggtattccctgaaatatgc

SEQ ID NO: 151518 - DNA, 22 bp, Artificial Sequence
  chemically synthesized
aggtattccctgaaatatgcat

SEQ ID NO: 151519 - DNA, 22 bp, Artificial Sequence
  chemically synthesized
cctgaaatatgcattttcttgg

SEQ ID NO: 151520 - DNA, 22 bp, Artificial Sequence
  chemically synthesized
aaatatgcattttcttggtcct

SEQ ID NO: 151521 - DNA, 22 bp, Artificial Sequence
  chemically synthesized
tcttggtcctactctactcaaa

SEQ ID NO: 151522 - DNA, 22 bp, Artificial Sequence
  chemically synthesized
cttggtcctactctactcaaat

SEQ ID NO: 151523 - DNA, 22 bp, Artificial Sequence
  chemically synthesized
ttggtcctactctactcaaatt

SEQ ID NO: 151524 - DNA, 22 bp, Artificial Sequence
  chemically synthesized
ggtcctactctactcaaatttc

SEQ ID NO: 151525 - DNA, 22 bp, Artificial Sequence
  chemically synthesized
gtcctactctactcaaatttca

SEQ ID NO: 151526 - DNA, 22 bp, Artificial Sequence
  chemically synthesized
ctctactcaaatttcaaaccac

SEQ ID NO: 151527 - DNA, 22 bp, Artificial Sequence
  chemically synthesized
tactcaaatttcaaaccactat

SEQ ID NO: 151528 - DNA, 22 bp, Artificial Sequence
  chemically synthesized
ctcaaatttcaaaccactatta

SEQ ID NO: 151529 - DNA, 22 bp, Artificial Sequence
  chemically synthesized
aaatttcaaaccactattattt

SEQ ID NO: 151530 - DNA, 22 bp, Artificial Sequence
  chemically synthesized
caaaccactattatttcatgcc

SEQ ID NO: 151531 - DNA, 22 bp, Artificial Sequence
  chemically synthesized
aaaccactattatttcatgccc

SEQ ID NO: 151532 - DNA, 22 bp, Artificial Sequence
  chemically synthesized
ttatttcatgcccttcaataac

SEQ ID NO: 151533 - DNA, 22 bp, Artificial Sequence
  chemically synthesized
tttcatgcccttcaataacttc

SEQ ID NO: 151534 - DNA, 22 bp, Artificial Sequence
  chemically synthesized
catgcccttcaataacttctaa

SEQ ID NO: 151535 - DNA, 22 bp, Artificial Sequence
  chemically synthesized
atgcccttcaataacttctaac

SEQ ID NO: 151536 - DNA, 22 bp, Artificial Sequence
  chemically synthesized
caataacttctaaccggttcta

SEQ ID NO: 151537 - DNA, 22 bp, Artificial Sequence
  chemically synthesized
aataacttctaaccggttctat

SEQ ID NO: 151538 - DNA, 22 bp, Artificial Sequence
  chemically synthesized
ctaaccggttctattttcctat

SEQ ID NO: 151539 - DNA, 22 bp, Artificial Sequence
  chemically synthesized
taaccggttctattttcctatt

SEQ ID NO: 151540 - DNA, 22 bp, Artificial Sequence
  chemically synthesized
accggttctattttcctatttg

SEQ ID NO: 151541 - DNA, 22 bp, Artificial Sequence
  chemically synthesized
tattttcctatttgtgtcttgc

SEQ ID NO: 151542 - DNA, 22 bp, Artificial Sequence
  chemically synthesized
ttttcctatttgtgtcttgcaa

SEQ ID NO: 151543 - DNA, 22 bp, Artificial Sequence
  chemically synthesized
tcctatttgtgtcttgcaacat

SEQ ID NO: 151544 - DNA, 22 bp, Artificial Sequence
  chemically synthesized
cctatttgtgtcttgcaacatg

SEQ ID NO: 151545 - DNA, 22 bp, Artificial Sequence
  chemically synthesized
ctatttgtgtcttgcaacatgg

SEQ ID NO: 151546 - DNA, 22 bp, Artificial Sequence
  chemically synthesized
tttgtgtcttgcaacatgggat

SEQ ID NO: 151547 - DNA, 22 bp, Artificial Sequence
  chemically synthesized
gtgtcttgcaacatgggataat

SEQ ID NO: 151548 - DNA, 22 bp, Artificial Sequence
  chemically synthesized
tgtcttgcaacatgggataata

SEQ ID NO: 151549 - DNA, 22 bp, Artificial Sequence
  chemically synthesized
gcaacatgggataataggttct

SEQ ID NO: 151550 - DNA, 22 bp, Artificial Sequence
  chemically synthesized
caacatgggataataggttctg

SEQ ID NO: 151551 - DNA, 22 bp, Artificial Sequence
  chemically synthesized
tggcatgagacagcccgggctc

SEQ ID NO: 151552 - DNA, 22 bp, Artificial Sequence
  chemically synthesized
gcatgagacagcccgggctcta

SEQ ID NO: 151553 - DNA, 22 bp, Artificial Sequence
  chemically synthesized
tactctcaggtccataagttaa

SEQ ID NO: 151554 - DNA, 22 bp, Artificial Sequence
  chemically synthesized
ctctcaggtccataagttaata

SEQ ID NO: 151555 - DNA, 22 bp, Artificial Sequence
  chemically synthesized
tcaggtccataagttaatagct

SEQ ID NO: 151556 - DNA, 22 bp, Artificial Sequence
  chemically synthesized
aggtccataagttaatagcttt

SEQ ID NO: 151557 - DNA, 22 bp, Artificial Sequence
  chemically synthesized
atagctttgttttgaggataag

SEQ ID NO: 151558 - DNA, 22 bp, Artificial Sequence
  chemically synthesized
tgttttgaggataagttacttc

SEQ ID NO: 151559 - DNA, 22 bp, Artificial Sequence
  chemically synthesized
gttttgaggataagttacttct

SEQ ID NO: 151560 - DNA, 22 bp, Artificial Sequence
  chemically synthesized
ttttgaggataagttacttctc

SEQ ID NO: 151561 - DNA, 22 bp, Artificial Sequence
  chemically synthesized
tgaggataagttacttctctat

SEQ ID NO: 151562 - DNA, 22 bp, Artificial Sequence
  chemically synthesized
gaggataagttacttctctatg

SEQ ID NO: 151563 - DNA, 22 bp, Artificial Sequence
  chemically synthesized
aggataagttacttctctatgc

SEQ ID NO: 151564 - DNA, 22 bp, Artificial Sequence
  chemically synthesized
cttctctatgccttacattcct

SEQ ID NO: 151565 - DNA, 22 bp, Artificial Sequence
  chemically synthesized
ctctatgccttacattcctcaa

SEQ ID NO: 151566 - DNA, 22 bp, Artificial Sequence
  chemically synthesized
tctatgccttacattcctcaat

SEQ ID NO: 151567 - DNA, 22 bp, Artificial Sequence
  chemically synthesized
tatgccttacattcctcaataa

SEQ ID NO: 151568 - DNA, 22 bp, Artificial Sequence
  chemically synthesized
tgccttacattcctcaataata

SEQ ID NO: 151569 - DNA, 22 bp, Artificial Sequence
  chemically synthesized
acattcctcaataataaattaa

SEQ ID NO: 151570 - DNA, 22 bp, Artificial Sequence
  chemically synthesized
cattcctcaataataaattaag

SEQ ID NO: 151571 - DNA, 22 bp, Artificial Sequence
  chemically synthesized
ctcaataataaattaagagcta

SEQ ID NO: 151572 - DNA, 22 bp, Artificial Sequence
  chemically synthesized
aataataaattaagagctataa

SEQ ID NO: 151573 - DNA, 22 bp, Artificial Sequence
  chemically synthesized
agagctataatggaatctactt

SEQ ID NO: 151574 - DNA, 22 bp, Artificial Sequence
  chemically synthesized
taatggaatctactttataaat

SEQ ID NO: 151575 - DNA, 22 bp, Artificial Sequence
  chemically synthesized
ctttataaatttcttatagtga

SEQ ID NO: 151576 - DNA, 22 bp, Artificial Sequence
  chemically synthesized
tataaatttcttatagtgagta

SEQ ID NO: 151577 - DNA, 22 bp, Artificial Sequence
  chemically synthesized
ataaatttcttatagtgagtaa

SEQ ID NO: 151578 - DNA, 22 bp, Artificial Sequence
  chemically synthesized
taaatttcttatagtgagtaaa

SEQ ID NO: 151579 - DNA, 22 bp, Artificial Sequence
  chemically synthesized
cttatagtgagtaaattaacat

SEQ ID NO: 151580 - DNA, 22 bp, Artificial Sequence
  chemically synthesized
ttatagtgagtaaattaacata

SEQ ID NO: 151581 - DNA, 22 bp, Artificial Sequence
  chemically synthesized
atagtgagtaaattaacataaa

SEQ ID NO: 151582 - DNA, 22 bp, Artificial Sequence
  chemically synthesized
tagtgagtaaattaacataaat

SEQ ID NO: 151583 - DNA, 22 bp, Artificial Sequence
  chemically synthesized
acataaattccttcgaaaaatg

SEQ ID NO: 151584 - DNA, 22 bp, Artificial Sequence
  chemically synthesized
cttcgaaaaatgacaaaccaaa

SEQ ID NO: 151585 - DNA, 22 bp, Artificial Sequence
  chemically synthesized
cgaaaaatgacaaaccaaataa

SEQ ID NO: 151586 - DNA, 22 bp, Artificial Sequence
  chemically synthesized
gaaaaatgacaaaccaaataag

SEQ ID NO: 151587 - DNA, 22 bp, Artificial Sequence
  chemically synthesized
ccagtaaatattaactttttat

SEQ ID NO: 151588 - DNA, 22 bp, Artificial Sequence
  chemically synthesized
actttttatcatgatgatcatg

SEQ ID NO: 151589 - DNA, 22 bp, Artificial Sequence
  chemically synthesized
tttatcatgatgatcatggtga

SEQ ID NO: 151590 - DNA, 22 bp, Artificial Sequence
  chemically synthesized
ttatcatgatgatcatggtgat

SEQ ID NO: 151591 - DNA, 22 bp, Artificial Sequence
  chemically synthesized
tatcatgatgatcatggtgata

SEQ ID NO: 151592 - DNA, 22 bp, Artificial Sequence
  chemically synthesized
atcatgatgatcatggtgatat

SEQ ID NO: 151593 - DNA, 22 bp, Artificial Sequence
  chemically synthesized
tcatgatgatcatggtgatatt

SEQ ID NO: 151594 - DNA, 22 bp, Artificial Sequence
  chemically synthesized
ataataaaactaaaattataat

SEQ ID NO: 151595 - DNA, 22 bp, Artificial Sequence
  chemically synthesized
aaattataatttttttcttcac

SEQ ID NO: 151596 - DNA, 22 bp, Artificial Sequence
  chemically synthesized
taatttttttcttcacctatag

SEQ ID NO: 151597 - DNA, 22 bp, Artificial Sequence
  chemically synthesized
ttttcttcacctatagccacag

SEQ ID NO: 151598 - DNA, 22 bp, Artificial Sequence
  chemically synthesized
tttcttcacctatagccacagt

SEQ ID NO: 151599 - DNA, 22 bp, Artificial Sequence
  chemically synthesized
ttcttcacctatagccacagtc

SEQ ID NO: 151600 - DNA, 22 bp, Artificial Sequence
  chemically synthesized
tcttcacctatagccacagtca

SEQ ID NO: 151601 - DNA, 22 bp, Artificial Sequence
  chemically synthesized
cttcacctatagccacagtcag

SEQ ID NO: 151602 - DNA, 22 bp, Artificial Sequence
  chemically synthesized
ttcacctatagccacagtcagc

SEQ ID NO: 151603 - DNA, 22 bp, Artificial Sequence
  chemically synthesized
cacctatagccacagtcagctt

SEQ ID NO: 151604 - DNA, 22 bp, Artificial Sequence
  chemically synthesized
acctatagccacagtcagcttc

SEQ ID NO: 151605 - DNA, 22 bp, Artificial Sequence
  chemically synthesized
tagccacagtcagcttctcaaa

SEQ ID NO: 151606 - DNA, 22 bp, Artificial Sequence
  chemically synthesized
ctcaaagacaaatatgattatg

SEQ ID NO: 151607 - DNA, 22 bp, Artificial Sequence
  chemically synthesized
tcaaagacaaatatgattatgc

SEQ ID NO: 151608 - DNA, 22 bp, Artificial Sequence
  chemically synthesized
aaagacaaatatgattatgcct

SEQ ID NO: 151609 - DNA, 22 bp, Artificial Sequence
  chemically synthesized
tgcctcacctttttatgatcta

SEQ ID NO: 151610 - DNA, 22 bp, Artificial Sequence
  chemically synthesized
acctttttatgatctaatagct

SEQ ID NO: 151611 - DNA, 22 bp, Artificial Sequence
  chemically synthesized
tttatgatctaatagctactaa

SEQ ID NO: 151612 - DNA, 22 bp, Artificial Sequence
  chemically synthesized
ttatgatctaatagctactaat

SEQ ID NO: 151613 - DNA, 22 bp, Artificial Sequence
  chemically synthesized
tatgatctaatagctactaatt

SEQ ID NO: 151614 - DNA, 22 bp, Artificial Sequence
  chemically synthesized
atgatctaatagctactaattt

SEQ ID NO: 151615 - DNA, 22 bp, Artificial Sequence
  chemically synthesized
tgatctaatagctactaatttc

SEQ ID NO: 151616 - DNA, 22 bp, Artificial Sequence
  chemically synthesized
atagctactaatttctccacgc

SEQ ID NO: 151617 - DNA, 22 bp, Artificial Sequence
  chemically synthesized
ctaatttctccacgctgacgtt

SEQ ID NO: 151618 - DNA, 22 bp, Artificial Sequence
  chemically synthesized
atttctccacgctgacgtttac

SEQ ID NO: 151619 - DNA, 22 bp, Artificial Sequence
  chemically synthesized
ctccacgctgacgtttaccaca

SEQ ID NO: 151620 - DNA, 22 bp, Artificial Sequence
  chemically synthesized
tccacgctgacgtttaccacag

SEQ ID NO: 151621 - DNA, 22 bp, Artificial Sequence
  chemically synthesized
cacgctgacgtttaccacagaa

SEQ ID NO: 151622 - DNA, 22 bp, Artificial Sequence
  chemically synthesized
acgtttaccacagaacctggac

SEQ ID NO: 151623 - DNA, 22 bp, Artificial Sequence
  chemically synthesized
accacagaacctggacataggt

SEQ ID NO: 151624 - DNA, 22 bp, Artificial Sequence
  chemically synthesized
ccacagaacctggacataggtg

SEQ ID NO: 151625 - DNA, 22 bp, Artificial Sequence
  chemically synthesized
gacataggtgttgcacacacta

SEQ ID NO: 151626 - DNA, 22 bp, Artificial Sequence
  chemically synthesized
cacacactatgatctctaataa

SEQ ID NO: 151627 - DNA, 22 bp, Artificial Sequence
  chemically synthesized
tgatctctaataaataaataaa

SEQ ID NO: 151628 - DNA, 22 bp, Artificial Sequence
  chemically synthesized
taataaataaataaaataaata

SEQ ID NO: 151629 - DNA, 22 bp, Artificial Sequence
  chemically synthesized
ataaataaataaaataaataaa

SEQ ID NO: 151630 - DNA, 22 bp, Artificial Sequence
  chemically synthesized
agtgaatatgttatatgctacg

SEQ ID NO: 151631 - DNA, 22 bp, Artificial Sequence
  chemically synthesized
tatgctacggcaccagtggtct

SEQ ID NO: 151632 - DNA, 22 bp, Artificial Sequence
  chemically synthesized
cggcaccagtggtctttctggg

SEQ ID NO: 151633 - DNA, 22 bp, Artificial Sequence
  chemically synthesized
tctgggtattgtacacttgccc

SEQ ID NO: 151634 - DNA, 22 bp, Artificial Sequence
  chemically synthesized
ctgggtattgtacacttgcccc

SEQ ID NO: 151635 - DNA, 22 bp, Artificial Sequence
  chemically synthesized
tgggtattgtacacttgcccca

SEQ ID NO: 151636 - DNA, 22 bp, Artificial Sequence
  chemically synthesized
ggtattgtacacttgccccatt

SEQ ID NO: 151637 - DNA, 22 bp, Artificial Sequence
  chemically synthesized
tacacttgccccattctaggac

SEQ ID NO: 151638 - DNA, 22 bp, Artificial Sequence
  chemically synthesized
gccccattctaggacaatggtt

SEQ ID NO: 151639 - DNA, 22 bp, Artificial Sequence
  chemically synthesized
ccccattctaggacaatggttc

SEQ ID NO: 151640 - DNA, 22 bp, Artificial Sequence
  chemically synthesized
taggacaatggttccttctgat

SEQ ID NO: 151641 - DNA, 22 bp, Artificial Sequence
  chemically synthesized
ggacaatggttccttctgatta

SEQ ID NO: 151642 - DNA, 22 bp, Artificial Sequence
  chemically synthesized
cttctgattagttaccttttcc

SEQ ID NO: 151643 - DNA, 22 bp, Artificial Sequence
  chemically synthesized
ctgattagttaccttttccagt

SEQ ID NO: 151644 - DNA, 22 bp, Artificial Sequence
  chemically synthesized
tgattagttaccttttccagtc

SEQ ID NO: 151645 - DNA, 22 bp, Artificial Sequence
  chemically synthesized
attagttaccttttccagtctg

SEQ ID NO: 151646 - DNA, 22 bp, Artificial Sequence
  chemically synthesized
gttaccttttccagtctgagag

SEQ ID NO: 151647 - DNA, 22 bp, Artificial Sequence
  chemically synthesized
ccttttccagtctgagagacat

SEQ ID NO: 151648 - DNA, 22 bp, Artificial Sequence
  chemically synthesized
ttccagtctgagagacatgcct

SEQ ID NO: 151649 - DNA, 22 bp, Artificial Sequence
  chemically synthesized
tccagtctgagagacatgcctg

SEQ ID NO: 151650 - DNA, 22 bp, Artificial Sequence
  chemically synthesized
ccagtctgagagacatgcctgg

SEQ ID NO: 151651 - DNA, 22 bp, Artificial Sequence
  chemically synthesized
cagtctgagagacatgcctggc

SEQ ID NO: 151652 - DNA, 22 bp, Artificial Sequence
  chemically synthesized
agagacatgcctggctcacacc

SEQ ID NO: 151653 - DNA, 22 bp, Artificial Sequence
  chemically synthesized
gctcacacctgatttgtaaggc

SEQ ID NO: 151654 - DNA, 22 bp, Artificial Sequence
  chemically synthesized
acacctgatttgtaaggcaatg

SEQ ID NO: 151655 - DNA, 22 bp, Artificial Sequence
  chemically synthesized
atttgtaaggcaatggagatgg

SEQ ID NO: 151656 - DNA, 22 bp, Artificial Sequence
  chemically synthesized
gtaaggcaatggagatggagac

SEQ ID NO: 151657 - DNA, 22 bp, Artificial Sequence
  chemically synthesized
taaggcaatggagatggagaca

SEQ ID NO: 151658 - DNA, 22 bp, Artificial Sequence
  chemically synthesized
ttatatccaaaagtacatagct

SEQ ID NO: 151659 - DNA, 22 bp, Artificial Sequence
  chemically synthesized
atatccaaaagtacatagctcc

SEQ ID NO: 151660 - DNA, 22 bp, Artificial Sequence
  chemically synthesized
tatccaaaagtacatagctccg

SEQ ID NO: 151661 - DNA, 22 bp, Artificial Sequence
  chemically synthesized
cggtagcttagataataaacct

SEQ ID NO: 151662 - DNA, 22 bp, Artificial Sequence
  chemically synthesized
agataataaacctttgtcacct

SEQ ID NO: 151663 - DNA, 22 bp, Artificial Sequence
  chemically synthesized
gataataaacctttgtcacctc

SEQ ID NO: 151664 - DNA, 22 bp, Artificial Sequence
  chemically synthesized
tgtcacctctagagaattctaa

SEQ ID NO: 151665 - DNA, 22 bp, Artificial Sequence
  chemically synthesized
gtcacctctagagaattctaaa

SEQ ID NO: 151666 - DNA, 22 bp, Artificial Sequence
  chemically synthesized
tcacctctagagaattctaaaa

SEQ ID NO: 151667 - DNA, 22 bp, Artificial Sequence
  chemically synthesized
tagagaattctaaaaatccaca

SEQ ID NO: 151668 - DNA, 22 bp, Artificial Sequence
  chemically synthesized
gagaattctaaaaatccacaga

SEQ ID NO: 151669 - DNA, 22 bp, Artificial Sequence
  chemically synthesized
taaaaatccacagatttagaaa

SEQ ID NO: 151670 - DNA, 22 bp, Artificial Sequence
  chemically synthesized
aaaatccacagatttagaaatt

SEQ ID NO: 151671 - DNA, 22 bp, Artificial Sequence
  chemically synthesized
agaaattctaggaatccaagaa

SEQ ID NO: 151672 - DNA, 22 bp, Artificial Sequence
  chemically synthesized
gaaattctaggaatccaagaaa

SEQ ID NO: 151673 - DNA, 22 bp, Artificial Sequence
  chemically synthesized
taggaatccaagaaattacaat

SEQ ID NO: 151674 - DNA, 22 bp, Artificial Sequence
  chemically synthesized
ggaatccaagaaattacaattt

SEQ ID NO: 151675 - DNA, 22 bp, Artificial Sequence
  chemically synthesized
caattttagatctactacaatt

SEQ ID NO: 151676 - DNA, 22 bp, Artificial Sequence
  chemically synthesized
tagatctactacaatttcacaa

SEQ ID NO: 151677 - DNA, 22 bp, Artificial Sequence
  chemically synthesized
agatctactacaatttcacaat

SEQ ID NO: 151678 - DNA, 22 bp, Artificial Sequence
  chemically synthesized
gatctactacaatttcacaata

SEQ ID NO: 151679 - DNA, 22 bp, Artificial Sequence
  chemically synthesized
ctacaatttcacaatataacaa

SEQ ID NO: 151680 - DNA, 22 bp, Artificial Sequence
  chemically synthesized
caatttcacaatataacaataa

SEQ ID NO: 151681 - DNA, 22 bp, Artificial Sequence
  chemically synthesized
cacaatataacaataaccaata

SEQ ID NO: 151682 - DNA, 22 bp, Artificial Sequence
  chemically synthesized
acaatataacaataaccaataa

SEQ ID NO: 151683 - DNA, 22 bp, Artificial Sequence
  chemically synthesized
tatttacataaataaaagatgg

SEQ ID NO: 151684 - DNA, 22 bp, Artificial Sequence
  chemically synthesized
atttacataaataaaagatggg

SEQ ID NO: 151685 - DNA, 22 bp, Artificial Sequence
  chemically synthesized
tttacataaataaaagatgggt

SEQ ID NO: 151686 - DNA, 22 bp, Artificial Sequence
  chemically synthesized
acataaataaaagatgggtttg

SEQ ID NO: 151687 - DNA, 22 bp, Artificial Sequence
  chemically synthesized
cataaataaaagatgggtttgt

SEQ ID NO: 151688 - DNA, 22 bp, Artificial Sequence
  chemically synthesized
gtcacacaatttaaaaatctag

SEQ ID NO: 151689 - DNA, 22 bp, Artificial Sequence
  chemically synthesized
tcacacaatttaaaaatctagg

SEQ ID NO: 151690 - DNA, 22 bp, Artificial Sequence
  chemically synthesized
aaaaatctagggtcgaaagcca

SEQ ID NO: 151691 - DNA, 22 bp, Artificial Sequence
  chemically synthesized
aaaatctagggtcgaaagccac

SEQ ID NO: 151692 - DNA, 22 bp, Artificial Sequence
  chemically synthesized
gggtcgaaagccacagcaaagg

SEQ ID NO: 151693 - DNA, 22 bp, Artificial Sequence
  chemically synthesized
ctggcactatatcacaatagat

SEQ ID NO: 151694 - DNA, 22 bp, Artificial Sequence
  chemically synthesized
gcactatatcacaatagatgac

SEQ ID NO: 151695 - DNA, 22 bp, Artificial Sequence
  chemically synthesized
tatcacaatagatgacacctgc

SEQ ID NO: 151696 - DNA, 22 bp, Artificial Sequence
  chemically synthesized
catagagaaagcaaagtggtca

SEQ ID NO: 151697 - DNA, 22 bp, Artificial Sequence
  chemically synthesized
gtcactgattgcctcaaataat

SEQ ID NO: 151698 - DNA, 22 bp, Artificial Sequence
  chemically synthesized
attgcctcaaataatccctgtg

SEQ ID NO: 151699 - DNA, 22 bp, Artificial Sequence
  chemically synthesized
cctcaaataatccctgtgggga

SEQ ID NO: 151700 - DNA, 22 bp, Artificial Sequence
  chemically synthesized
aaataatccctgtggggatgtc

SEQ ID NO: 151701 - DNA, 22 bp, Artificial Sequence
  chemically synthesized
tggggatgtctactcttttgta

SEQ ID NO: 151702 - DNA, 22 bp, Artificial Sequence
  chemically synthesized
ctcttttgtattccatcagctt

SEQ ID NO: 151703 - DNA, 22 bp, Artificial Sequence
  chemically synthesized
ttttgtattccatcagcttttt

SEQ ID NO: 151704 - DNA, 22 bp, Artificial Sequence
  chemically synthesized
ttgtattccatcagcttttttc

SEQ ID NO: 151705 - DNA, 22 bp, Artificial Sequence
  chemically synthesized
tgtattccatcagcttttttcc

SEQ ID NO: 151706 - DNA, 22 bp, Artificial Sequence
  chemically synthesized
gtattccatcagcttttttccc

SEQ ID NO: 151707 - DNA, 22 bp, Artificial Sequence
  chemically synthesized
tattccatcagcttttttccca

SEQ ID NO: 151708 - DNA, 22 bp, Artificial Sequence
  chemically synthesized
catcagcttttttcccagtaac

SEQ ID NO: 151709 - DNA, 22 bp, Artificial Sequence
  chemically synthesized
ttttcccagtaacaacacatcc

SEQ ID NO: 151710 - DNA, 22 bp, Artificial Sequence
  chemically synthesized
tttcccagtaacaacacatcct

SEQ ID NO: 151711 - DNA, 22 bp, Artificial Sequence
  chemically synthesized
ttcccagtaacaacacatccta

SEQ ID NO: 151712 - DNA, 22 bp, Artificial Sequence
  chemically synthesized
tcccagtaacaacacatcctag

SEQ ID NO: 151713 - DNA, 22 bp, Artificial Sequence
  chemically synthesized
cccagtaacaacacatcctagc

SEQ ID NO: 151714 - DNA, 22 bp, Artificial Sequence
  chemically synthesized
ccagtaacaacacatcctagca

SEQ ID NO: 151715 - DNA, 22 bp, Artificial Sequence
  chemically synthesized
gcaataatatcctgacgagttt

SEQ ID NO: 151716 - DNA, 22 bp, Artificial Sequence
  chemically synthesized
acgagtttctataaaaaaaaaa

SEQ ID NO: 151717 - DNA, 22 bp, Artificial Sequence
  chemically synthesized
ctataaaaaaaaaaaactcccc

SEQ ID NO: 151718 - DNA, 22 bp, Artificial Sequence
  chemically synthesized
tataaaaaaaaaaaactcccct

SEQ ID NO: 151719 - DNA, 22 bp, Artificial Sequence
  chemically synthesized
taaaaaaaaaaaactcccctcc

SEQ ID NO: 151720 - DNA, 22 bp, Artificial Sequence
  chemically synthesized
ccctcctaagatacagtatctt

SEQ ID NO: 151721 - DNA, 22 bp, Artificial Sequence
  chemically synthesized
ctaagatacagtatctttgtgg

SEQ ID NO: 151722 - DNA, 22 bp, Artificial Sequence
  chemically synthesized
agatacagtatctttgtggttg

SEQ ID NO: 151723 - DNA, 22 bp, Artificial Sequence
  chemically synthesized
tgtggttgcatccccagccatc

SEQ ID NO: 151724 - DNA, 22 bp, Artificial Sequence
  chemically synthesized
gtggttgcatccccagccatcc

SEQ ID NO: 151725 - DNA, 22 bp, Artificial Sequence
  chemically synthesized
tggttgcatccccagccatccc

SEQ ID NO: 151726 - DNA, 22 bp, Artificial Sequence
  chemically synthesized
catccccagccatccctcattt

SEQ ID NO: 151727 - DNA, 22 bp, Artificial Sequence
  chemically synthesized
atttggttgaggttggaatttc

SEQ ID NO: 151728 - DNA, 22 bp, Artificial Sequence
  chemically synthesized
ggttgaggttggaatttcaatg

SEQ ID NO: 151729 - DNA, 22 bp, Artificial Sequence
  chemically synthesized
gttgaggttggaatttcaatgg

SEQ ID NO: 151730 - DNA, 22 bp, Artificial Sequence
  chemically synthesized
aggttggaatttcaatgggtgg

SEQ ID NO: 151731 - DNA, 22 bp, Artificial Sequence
  chemically synthesized
gaatttcaatgggtgggttgaa

SEQ ID NO: 151732 - DNA, 22 bp, Artificial Sequence
  chemically synthesized
caatgggtgggttgaatttttc

SEQ ID NO: 151733 - DNA, 22 bp, Artificial Sequence
  chemically synthesized
aatgggtgggttgaatttttcc

SEQ ID NO: 151734 - DNA, 22 bp, Artificial Sequence
  chemically synthesized
aatttttccctaaacaaacttg

SEQ ID NO: 151735 - DNA, 22 bp, Artificial Sequence
  chemically synthesized
ttccctaaacaaacttgccatg

SEQ ID NO: 151736 - DNA, 22 bp, Artificial Sequence
  chemically synthesized
tccctaaacaaacttgccatgg

SEQ ID NO: 151737 - DNA, 22 bp, Artificial Sequence
  chemically synthesized
ccctaaacaaacttgccatggt

SEQ ID NO: 151738 - DNA, 22 bp, Artificial Sequence
  chemically synthesized
cctaaacaaacttgccatggta

SEQ ID NO: 151739 - DNA, 22 bp, Artificial Sequence
  chemically synthesized
aacaaacttgccatggtaaaat

SEQ ID NO: 151740 - DNA, 22 bp, Artificial Sequence
  chemically synthesized
gccatggtaaaatcaaggctag

SEQ ID NO: 151741 - DNA, 22 bp, Artificial Sequence
  chemically synthesized
ccatggtaaaatcaaggctagc

SEQ ID NO: 151742 - DNA, 22 bp, Artificial Sequence
  chemically synthesized
gcattactgttcacacaaggca

SEQ ID NO: 151743 - DNA, 22 bp, Artificial Sequence
  chemically synthesized
ctgttcacacaaggcactgtgc

SEQ ID NO: 151744 - DNA, 22 bp, Artificial Sequence
  chemically synthesized
ttcacacaaggcactgtgctaa

SEQ ID NO: 151745 - DNA, 22 bp, Artificial Sequence
  chemically synthesized
acacaaggcactgtgctaagat

SEQ ID NO: 151746 - DNA, 22 bp, Artificial Sequence
  chemically synthesized
tgctaagatccccatccttata

SEQ ID NO: 151747 - DNA, 22 bp, Artificial Sequence
  chemically synthesized
agatccccatccttatagcaat

SEQ ID NO: 151748 - DNA, 22 bp, Artificial Sequence
  chemically synthesized
atagcaatgggagggctcatag

SEQ ID NO: 151749 - DNA, 22 bp, Artificial Sequence
  chemically synthesized
tagcaatgggagggctcatagg

SEQ ID NO: 151750 - DNA, 22 bp, Artificial Sequence
  chemically synthesized
ataggcaagtcatgtcatgcag

SEQ ID NO: 151751 - DNA, 22 bp, Artificial Sequence
  chemically synthesized
catcatcccttcttgtctttgg

SEQ ID NO: 151752 - DNA, 22 bp, Artificial Sequence
  chemically synthesized
atcatcccttcttgtctttggg

SEQ ID NO: 151753 - DNA, 22 bp, Artificial Sequence
  chemically synthesized
cttgtctttggggacttgggtc

SEQ ID NO: 151754 - DNA, 22 bp, Artificial Sequence
  chemically synthesized
ttgtctttggggacttgggtct

SEQ ID NO: 151755 - DNA, 22 bp, Artificial Sequence
  chemically synthesized
gtctttggggacttgggtctct

SEQ ID NO: 151756 - DNA, 22 bp, Artificial Sequence
  chemically synthesized
tctttggggacttgggtctctc

SEQ ID NO: 151757 - DNA, 22 bp, Artificial Sequence
  chemically synthesized
tggggacttgggtctctccggt

SEQ ID NO: 151758 - DNA, 22 bp, Artificial Sequence
  chemically synthesized
ggggacttgggtctctccggtt

SEQ ID NO: 151759 - DNA, 22 bp, Artificial Sequence
  chemically synthesized
gggacttgggtctctccggttg

SEQ ID NO: 151760 - DNA, 22 bp, Artificial Sequence
  chemically synthesized
gggtctctccggttgtatagga

SEQ ID NO: 151761 - DNA, 22 bp, Artificial Sequence
  chemically synthesized
ggtctctccggttgtataggag

SEQ ID NO: 151762 - DNA, 22 bp, Artificial Sequence
  chemically synthesized
tccggttgtataggagatttcg

SEQ ID NO: 151763 - DNA, 22 bp, Artificial Sequence
  chemically synthesized
cggttgtataggagatttcgcc

SEQ ID NO: 151764 - DNA, 22 bp, Artificial Sequence
  chemically synthesized
tataggagatttcgccaggcat

SEQ ID NO: 151765 - DNA, 22 bp, Artificial Sequence
  chemically synthesized
cgccaggcatttgaatccttca

SEQ ID NO: 151766 - DNA, 22 bp, Artificial Sequence
  chemically synthesized
gccaggcatttgaatccttcac

SEQ ID NO: 151767 - DNA, 22 bp, Artificial Sequence
  chemically synthesized
gaatccttcactgctagtcatc

SEQ ID NO: 151768 - DNA, 22 bp, Artificial Sequence
  chemically synthesized
aatccttcactgctagtcatcc

SEQ ID NO: 151769 - DNA, 22 bp, Artificial Sequence
  chemically synthesized
cactgctagtcatcctggactc

SEQ ID NO: 151770 - DNA, 22 bp, Artificial Sequence
  chemically synthesized
actgctagtcatcctggactct

SEQ ID NO: 151771 - DNA, 22 bp, Artificial Sequence
  chemically synthesized
ctagtcatcctggactctgtgg

SEQ ID NO: 151772 - DNA, 22 bp, Artificial Sequence
  chemically synthesized
gtcatcctggactctgtggtgt

SEQ ID NO: 151773 - DNA, 22 bp, Artificial Sequence
  chemically synthesized
gactctgtggtgtacaatatcc

SEQ ID NO: 151774 - DNA, 22 bp, Artificial Sequence
  chemically synthesized
tgtggtgtacaatatccatctc

SEQ ID NO: 151775 - DNA, 22 bp, Artificial Sequence
  chemically synthesized
tggtgtacaatatccatctctc

SEQ ID NO: 151776 - DNA, 22 bp, Artificial Sequence
  chemically synthesized
tcctatgttctgaggtcagaat

SEQ ID NO: 151777 - DNA, 22 bp, Artificial Sequence
  chemically synthesized
ctatgttctgaggtcagaatga

SEQ ID NO: 151778 - DNA, 22 bp, Artificial Sequence
  chemically synthesized
tgttctgaggtcagaatgacct

SEQ ID NO: 151779 - DNA, 22 bp, Artificial Sequence
  chemically synthesized
tgaggtcagaatgacctctctc

SEQ ID NO: 151780 - DNA, 22 bp, Artificial Sequence
  chemically synthesized
aggtcagaatgacctctctctt

SEQ ID NO: 151781 - DNA, 22 bp, Artificial Sequence
  chemically synthesized
tctcttaaccagttgtctgggc

SEQ ID NO: 151782 - DNA, 22 bp, Artificial Sequence
  chemically synthesized
tcttaaccagttgtctgggccc

SEQ ID NO: 151783 - DNA, 22 bp, Artificial Sequence
  chemically synthesized
ttaaccagttgtctgggcccag

SEQ ID NO: 151784 - DNA, 22 bp, Artificial Sequence
  chemically synthesized
aaccagttgtctgggcccaggc

SEQ ID NO: 151785 - DNA, 22 bp, Artificial Sequence
  chemically synthesized
accagttgtctgggcccaggct

SEQ ID NO: 151786 - DNA, 22 bp, Artificial Sequence
  chemically synthesized
tctgggcccaggctccattatt

SEQ ID NO: 151787 - DNA, 22 bp, Artificial Sequence
  chemically synthesized
ggcccaggctccattattgata

SEQ ID NO: 151788 - DNA, 22 bp, Artificial Sequence
  chemically synthesized
cattattgatatagtcatgatc

SEQ ID NO: 151789 - DNA, 22 bp, Artificial Sequence
  chemically synthesized
ttgatatagtcatgatctcctc

SEQ ID NO: 151790 - DNA, 22 bp, Artificial Sequence
  chemically synthesized
atatagtcatgatctcctctgt

SEQ ID NO: 151791 - DNA, 22 bp, Artificial Sequence
  chemically synthesized
ctctgttggggatgaagtaggc

SEQ ID NO: 151792 - DNA, 22 bp, Artificial Sequence
  chemically synthesized
tgttggggatgaagtaggcaaa

SEQ ID NO: 151793 - DNA, 22 bp, Artificial Sequence
  chemically synthesized
ttggggatgaagtaggcaaatt

SEQ ID NO: 151794 - DNA, 22 bp, Artificial Sequence
  chemically synthesized
gggatgaagtaggcaaatttga

SEQ ID NO: 151795 - DNA, 22 bp, Artificial Sequence
  chemically synthesized
gaggcactaatttacttctcac

SEQ ID NO: 151796 - DNA, 22 bp, Artificial Sequence
  chemically synthesized
aggcactaatttacttctcaca

SEQ ID NO: 151797 - DNA, 22 bp, Artificial Sequence
  chemically synthesized
atttacttctcacattcttttc

SEQ ID NO: 151798 - DNA, 22 bp, Artificial Sequence
  chemically synthesized
acttctcacattcttttcttga

SEQ ID NO: 151799 - DNA, 22 bp, Artificial Sequence
  chemically synthesized
cttctcacattcttttcttgaa

SEQ ID NO: 151800 - DNA, 22 bp, Artificial Sequence
  chemically synthesized
ctcacattcttttcttgaacag

SEQ ID NO: 151801 - DNA, 22 bp, Artificial Sequence
  chemically synthesized
tcacattcttttcttgaacaga

SEQ ID NO: 151802 - DNA, 22 bp, Artificial Sequence
  chemically synthesized
acattcttttcttgaacagaaa

SEQ ID NO: 151803 - DNA, 22 bp, Artificial Sequence
  chemically synthesized
ttttcttgaacagaaagataga

SEQ ID NO: 151804 - DNA, 22 bp, Artificial Sequence
  chemically synthesized
ttcttgaacagaaagatagaac

SEQ ID NO: 151805 - DNA, 22 bp, Artificial Sequence
  chemically synthesized
tcttgaacagaaagatagaact

SEQ ID NO: 151806 - DNA, 22 bp, Artificial Sequence
  chemically synthesized
cttgaacagaaagatagaactg

SEQ ID NO: 151807 - DNA, 22 bp, Artificial Sequence
  chemically synthesized
ttgaacagaaagatagaactgg

SEQ ID NO: 151808 - DNA, 22 bp, Artificial Sequence
  chemically synthesized
gaacagaaagatagaactggaa

SEQ ID NO: 151809 - DNA, 22 bp, Artificial Sequence
  chemically synthesized
aacagaaagatagaactggaaa

SEQ ID NO: 151810 - DNA, 22 bp, Artificial Sequence
  chemically synthesized
gaaattaatagtagtatataaa

SEQ ID NO: 151811 - DNA, 22 bp, Artificial Sequence
  chemically synthesized
atagtagtatataaattcaaaa

SEQ ID NO: 151812 - DNA, 22 bp, Artificial Sequence
  chemically synthesized
aaaattttagctttaataacat

SEQ ID NO: 151813 - DNA, 22 bp, Artificial Sequence
  chemically synthesized
tagctttaataacatttaatca

SEQ ID NO: 151814 - DNA, 22 bp, Artificial Sequence
  chemically synthesized
agctttaataacatttaatcag

SEQ ID NO: 151815 - DNA, 22 bp, Artificial Sequence
  chemically synthesized
gctttaataacatttaatcaga

SEQ ID NO: 151816 - DNA, 22 bp, Artificial Sequence
  chemically synthesized
taataacatttaatcagacata

SEQ ID NO: 151817 - DNA, 22 bp, Artificial Sequence
  chemically synthesized
aataacatttaatcagacataa

SEQ ID NO: 151818 - DNA, 22 bp, Artificial Sequence
  chemically synthesized
ataacatttaatcagacataaa

SEQ ID NO: 151819 - DNA, 22 bp, Artificial Sequence
  chemically synthesized
aatcagacataaataattatgg

SEQ ID NO: 151820 - DNA, 22 bp, Artificial Sequence
  chemically synthesized
atcagacataaataattatggt

SEQ ID NO: 151821 - DNA, 22 bp, Artificial Sequence
  chemically synthesized
tggtaatgtgaatttcaataaa

SEQ ID NO: 151822 - DNA, 22 bp, Artificial Sequence
  chemically synthesized
caataaataaattttagttcta

SEQ ID NO: 151823 - DNA, 22 bp, Artificial Sequence
  chemically synthesized
aataaataaattttagttctaa

SEQ ID NO: 151824 - DNA, 22 bp, Artificial Sequence
  chemically synthesized
tagttctaatataagtgtaact

SEQ ID NO: 151825 - DNA, 22 bp, Artificial Sequence
  chemically synthesized
agttctaatataagtgtaactg

SEQ ID NO: 151826 - DNA, 22 bp, Artificial Sequence
  chemically synthesized
gttctaatataagtgtaactgt

SEQ ID NO: 151827 - DNA, 22 bp, Artificial Sequence
  chemically synthesized
taatataagtgtaactgtgtaa

SEQ ID NO: 151828 - DNA, 22 bp, Artificial Sequence
  chemically synthesized
atataagtgtaactgtgtaata

SEQ ID NO: 151829 - DNA, 22 bp, Artificial Sequence
  chemically synthesized
tgtaatattcatactttttctg

SEQ ID NO: 151830 - DNA, 22 bp, Artificial Sequence
  chemically synthesized
atactttttctgaaggctttac

SEQ ID NO: 151831 - DNA, 22 bp, Artificial Sequence
  chemically synthesized
tttctgaaggctttactaattt

SEQ ID NO: 151832 - DNA, 22 bp, Artificial Sequence
  chemically synthesized
ttctgaaggctttactaatttg

SEQ ID NO: 151833 - DNA, 22 bp, Artificial Sequence
  chemically synthesized
tctgaaggctttactaatttga

SEQ ID NO: 151834 - DNA, 22 bp, Artificial Sequence
  chemically synthesized
ctgaaggctttactaatttgat

SEQ ID NO: 151835 - DNA, 22 bp, Artificial Sequence
  chemically synthesized
tgaaggctttactaatttgata

SEQ ID NO: 151836 - DNA, 22 bp, Artificial Sequence
  chemically synthesized
aaggctttactaatttgatatg

SEQ ID NO: 151837 - DNA, 22 bp, Artificial Sequence
  chemically synthesized
tactaatttgatatggcattac

SEQ ID NO: 151838 - DNA, 22 bp, Artificial Sequence
  chemically synthesized
actaatttgatatggcattact

SEQ ID NO: 151839 - DNA, 22 bp, Artificial Sequence
  chemically synthesized
ctaatttgatatggcattactt

SEQ ID NO: 151840 - DNA, 22 bp, Artificial Sequence
  chemically synthesized
atttgatatggcattacttttt

SEQ ID NO: 151841 - DNA, 22 bp, Artificial Sequence
  chemically synthesized
gatatggcattacttttttatt

SEQ ID NO: 151842 - DNA, 22 bp, Artificial Sequence
  chemically synthesized
atatggcattacttttttattg

SEQ ID NO: 151843 - DNA, 22 bp, Artificial Sequence
  chemically synthesized
cttttttattgctgccaaaact

SEQ ID NO: 151844 - DNA, 22 bp, Artificial Sequence
  chemically synthesized
ttttattgctgccaaaactatt

SEQ ID NO: 151845 - DNA, 22 bp, Artificial Sequence
  chemically synthesized
tttattgctgccaaaactattc

SEQ ID NO: 151846 - DNA, 22 bp, Artificial Sequence
  chemically synthesized
ttattgctgccaaaactattct

SEQ ID NO: 151847 - DNA, 22 bp, Artificial Sequence
  chemically synthesized
tattgctgccaaaactattctt

SEQ ID NO: 151848 - DNA, 22 bp, Artificial Sequence
  chemically synthesized
attgctgccaaaactattctta

SEQ ID NO: 151849 - DNA, 22 bp, Artificial Sequence
  chemically synthesized
ttgctgccaaaactattcttat

SEQ ID NO: 151850 - DNA, 22 bp, Artificial Sequence
  chemically synthesized
ctgccaaaactattcttattcc

SEQ ID NO: 151851 - DNA, 22 bp, Artificial Sequence
  chemically synthesized
ccaaaactattcttattccact

SEQ ID NO: 151852 - DNA, 22 bp, Artificial Sequence
  chemically synthesized
ttcttattccactgtgtggtga

SEQ ID NO: 151853 - DNA, 22 bp, Artificial Sequence
  chemically synthesized
ttattccactgtgtggtgatga

SEQ ID NO: 151854 - DNA, 22 bp, Artificial Sequence
  chemically synthesized
attccactgtgtggtgatgaga

SEQ ID NO: 151855 - DNA, 22 bp, Artificial Sequence
  chemically synthesized
ttccactgtgtggtgatgagaa

SEQ ID NO: 151856 - DNA, 22 bp, Artificial Sequence
  chemically synthesized
cactgtgtggtgatgagaaagt

SEQ ID NO: 151857 - DNA, 22 bp, Artificial Sequence
  chemically synthesized
tgtggtgatgagaaagtgagag

SEQ ID NO: 151858 - DNA, 22 bp, Artificial Sequence
  chemically synthesized
tggagatggtgattatagatag

SEQ ID NO: 151859 - DNA, 22 bp, Artificial Sequence
  chemically synthesized
gagatggtgattatagatagct

SEQ ID NO: 151860 - DNA, 22 bp, Artificial Sequence
  chemically synthesized
tagatagcttccctgaagccat

SEQ ID NO: 151861 - DNA, 22 bp, Artificial Sequence
  chemically synthesized
ccctgaagccatagtaaccccc

SEQ ID NO: 151862 - DNA, 22 bp, Artificial Sequence
  chemically synthesized
cctgaagccatagtaaccccct

SEQ ID NO: 151863 - DNA, 22 bp, Artificial Sequence
  chemically synthesized
aagccatagtaaccccctggag

SEQ ID NO: 151864 - DNA, 22 bp, Artificial Sequence
  chemically synthesized
gagaaaaattggacctggagtc

SEQ ID NO: 151865 - DNA, 22 bp, Artificial Sequence
  chemically synthesized
gacctggagtctagcagcctag

SEQ ID NO: 151866 - DNA, 22 bp, Artificial Sequence
  chemically synthesized
gagtctagcagcctaggtatgg

SEQ ID NO: 151867 - DNA, 22 bp, Artificial Sequence
  chemically synthesized
gcagcctaggtatgggtactcg

SEQ ID NO: 151868 - DNA, 22 bp, Artificial Sequence
  chemically synthesized
ggtatgggtactcgatttctta

SEQ ID NO: 151869 - DNA, 22 bp, Artificial Sequence
  chemically synthesized
gatttcttagaaagcctttaca

SEQ ID NO: 151870 - DNA, 22 bp, Artificial Sequence
  chemically synthesized
cttagaaagcctttacaatttc

SEQ ID NO: 151871 - DNA, 22 bp, Artificial Sequence
  chemically synthesized
ttagaaagcctttacaatttcc

SEQ ID NO: 151872 - DNA, 22 bp, Artificial Sequence
  chemically synthesized
agaaagcctttacaatttcctt

SEQ ID NO: 151873 - DNA, 22 bp, Artificial Sequence
  chemically synthesized
gaaagcctttacaatttccttt

SEQ ID NO: 151874 - DNA, 22 bp, Artificial Sequence
  chemically synthesized
tacaatttcctttatcttaaaa

SEQ ID NO: 151875 - DNA, 22 bp, Artificial Sequence
  chemically synthesized
acaatttcctttatcttaaaaa

SEQ ID NO: 151876 - DNA, 22 bp, Artificial Sequence
  chemically synthesized
caatttcctttatcttaaaaat

SEQ ID NO: 151877 - DNA, 22 bp, Artificial Sequence
  chemically synthesized
cctttatcttaaaaataagggt

SEQ ID NO: 151878 - DNA, 22 bp, Artificial Sequence
  chemically synthesized
ctttatcttaaaaataagggta

SEQ ID NO: 151879 - DNA, 22 bp, Artificial Sequence
  chemically synthesized
tatcttaaaaataagggtattg

SEQ ID NO: 151880 - DNA, 22 bp, Artificial Sequence
  chemically synthesized
atcttaaaaataagggtattga

SEQ ID NO: 151881 - DNA, 22 bp, Artificial Sequence
  chemically synthesized
tcttaaaaataagggtattgaa

SEQ ID NO: 151882 - DNA, 22 bp, Artificial Sequence
  chemically synthesized
aaaaataagggtattgaagtag

SEQ ID NO: 151883 - DNA, 22 bp, Artificial Sequence
  chemically synthesized
aaaataagggtattgaagtaga

SEQ ID NO: 151884 - DNA, 22 bp, Artificial Sequence
  chemically synthesized
aagtagaattctagaattttca

SEQ ID NO: 151885 - DNA, 22 bp, Artificial Sequence
  chemically synthesized
tagaattttcagaggacaactt

SEQ ID NO: 151886 - DNA, 22 bp, Artificial Sequence
  chemically synthesized
gaattttcagaggacaacttaa

SEQ ID NO: 151887 - DNA, 22 bp, Artificial Sequence
  chemically synthesized
tcagaggacaacttaaaatatg

SEQ ID NO: 151888 - DNA, 22 bp, Artificial Sequence
  chemically synthesized
cagaggacaacttaaaatatgt

SEQ ID NO: 151889 - DNA, 22 bp, Artificial Sequence
  chemically synthesized
agaggacaacttaaaatatgtg

SEQ ID NO: 151890 - DNA, 22 bp, Artificial Sequence
  chemically synthesized
aaaatatgtgtaatagttttaa

SEQ ID NO: 151891 - DNA, 22 bp, Artificial Sequence
  chemically synthesized
aaatatgtgtaatagttttaat

SEQ ID NO: 151892 - DNA, 22 bp, Artificial Sequence
  chemically synthesized
taattatttatcctcataaatt

SEQ ID NO: 151893 - DNA, 22 bp, Artificial Sequence
  chemically synthesized
aattatttatcctcataaattt

SEQ ID NO: 151894 - DNA, 22 bp, Artificial Sequence
  chemically synthesized
attatttatcctcataaattta

SEQ ID NO: 151895 - DNA, 22 bp, Artificial Sequence
  chemically synthesized
tttatcctcataaatttaactg

SEQ ID NO: 151896 - DNA, 22 bp, Artificial Sequence
  chemically synthesized
atcctcataaatttaactgttc

SEQ ID NO: 151897 - DNA, 22 bp, Artificial Sequence
  chemically synthesized
tcctcataaatttaactgttca

SEQ ID NO: 151898 - DNA, 22 bp, Artificial Sequence
  chemically synthesized
ataaatttaactgttcatttta

SEQ ID NO: 151899 - DNA, 22 bp, Artificial Sequence
  chemically synthesized
aactgttcattttaatatattt

SEQ ID NO: 151900 - DNA, 22 bp, Artificial Sequence
  chemically synthesized
actgttcattttaatatattta

SEQ ID NO: 151901 - DNA, 22 bp, Artificial Sequence
  chemically synthesized
ttcattttaatatatttaagga

SEQ ID NO: 151902 - DNA, 22 bp, Artificial Sequence
  chemically synthesized
attttaatatatttaaggatga

SEQ ID NO: 151903 - DNA, 22 bp, Artificial Sequence
  chemically synthesized
taatatatttaaggatgaattt

SEQ ID NO: 151904 - DNA, 22 bp, Artificial Sequence
  chemically synthesized
aatatatttaaggatgaatttt

SEQ ID NO: 151905 - DNA, 22 bp, Artificial Sequence
  chemically synthesized
atatatttaaggatgaattttt

SEQ ID NO: 151906 - DNA, 22 bp, Artificial Sequence
  chemically synthesized
aaggatgaattttttaaaaagt

SEQ ID NO: 151907 - DNA, 22 bp, Artificial Sequence
  chemically synthesized
aggatgaattttttaaaaagtt

SEQ ID NO: 151908 - DNA, 22 bp, Artificial Sequence
  chemically synthesized
tttaaaaagttgatttcataaa

SEQ ID NO: 151909 - DNA, 22 bp, Artificial Sequence
  chemically synthesized
ttaaaaagttgatttcataaaa

SEQ ID NO: 151910 - DNA, 22 bp, Artificial Sequence
  chemically synthesized
taaaaagttgatttcataaaaa

SEQ ID NO: 151911 - DNA, 22 bp, Artificial Sequence
  chemically synthesized
aaaaagttgatttcataaaaac

SEQ ID NO: 151912 - DNA, 22 bp, Artificial Sequence
  chemically synthesized
aaaagttgatttcataaaaacg

SEQ ID NO: 151913 - DNA, 22 bp, Artificial Sequence
  chemically synthesized
atttcataaaaacgggaataga

SEQ ID NO: 151914 - DNA, 22 bp, Artificial Sequence
  chemically synthesized
cataaaaacgggaatagaaaga

SEQ ID NO: 151915 - DNA, 22 bp, Artificial Sequence
  chemically synthesized
ataaaaacgggaatagaaagat

SEQ ID NO: 151916 - DNA, 22 bp, Artificial Sequence
  chemically synthesized
cataggctgactgagagtgtag

SEQ ID NO: 151917 - DNA, 22 bp, Artificial Sequence
  chemically synthesized
actgagagtgtagaggagggat

SEQ ID NO: 151918 - DNA, 22 bp, Artificial Sequence
  chemically synthesized
agagtgtagaggagggatggga

SEQ ID NO: 151919 - DNA, 22 bp, Artificial Sequence
  chemically synthesized
atcttcagttagactagaggaa

SEQ ID NO: 151920 - DNA, 22 bp, Artificial Sequence
  chemically synthesized
cagttagactagaggaataagt

SEQ ID NO: 151921 - DNA, 22 bp, Artificial Sequence
  chemically synthesized
agttagactagaggaataagtt

SEQ ID NO: 151922 - DNA, 22 bp, Artificial Sequence
  chemically synthesized
gactagaggaataagttttagt

SEQ ID NO: 151923 - DNA, 22 bp, Artificial Sequence
  chemically synthesized
gaggaataagttttagtgatct

SEQ ID NO: 151924 - DNA, 22 bp, Artificial Sequence
  chemically synthesized
tagtgatctctcacactgcata

SEQ ID NO: 151925 - DNA, 22 bp, Artificial Sequence
  chemically synthesized
agtgatctctcacactgcatag

SEQ ID NO: 151926 - DNA, 22 bp, Artificial Sequence
  chemically synthesized
gtgatctctcacactgcatagt

SEQ ID NO: 151927 - DNA, 22 bp, Artificial Sequence
  chemically synthesized
tcacactgcatagtgaacacag

SEQ ID NO: 151928 - DNA, 22 bp, Artificial Sequence
  chemically synthesized
acactgcatagtgaacacagtt

SEQ ID NO: 151929 - DNA, 22 bp, Artificial Sequence
  chemically synthesized
catagtgaacacagttaataat

SEQ ID NO: 151930 - DNA, 22 bp, Artificial Sequence
  chemically synthesized
ataatatattatgtatttaaat

SEQ ID NO: 151931 - DNA, 22 bp, Artificial Sequence
  chemically synthesized
tgtatttaaattaaaaattgct

SEQ ID NO: 151932 - DNA, 22 bp, Artificial Sequence
  chemically synthesized
aaattaaaaattgctaaaaaat

SEQ ID NO: 151933 - DNA, 22 bp, Artificial Sequence
  chemically synthesized
aattaaaaattgctaaaaaata

SEQ ID NO: 151934 - DNA, 22 bp, Artificial Sequence
  chemically synthesized
aaaattgctaaaaaataaatat

SEQ ID NO: 151935 - DNA, 22 bp, Artificial Sequence
  chemically synthesized
ctaaaaaataaatattttatgt

SEQ ID NO: 151936 - DNA, 22 bp, Artificial Sequence
  chemically synthesized
aaaaataaatattttatgttct

SEQ ID NO: 151937 - DNA, 22 bp, Artificial Sequence
  chemically synthesized
tatgttctcaccacaaaaaaag

SEQ ID NO: 151938 - DNA, 22 bp, Artificial Sequence
  chemically synthesized
atgttctcaccacaaaaaaagt

SEQ ID NO: 151939 - DNA, 22 bp, Artificial Sequence
  chemically synthesized
tgttctcaccacaaaaaaagtt

SEQ ID NO: 151940 - DNA, 22 bp, Artificial Sequence
  chemically synthesized
tcaccacaaaaaaagttggaag

SEQ ID NO: 151941 - DNA, 22 bp, Artificial Sequence
  chemically synthesized
accacaaaaaaagttggaaggt

SEQ ID NO: 151942 - DNA, 22 bp, Artificial Sequence
  chemically synthesized
gaaggtgattcatatgctaatt

SEQ ID NO: 151943 - DNA, 22 bp, Artificial Sequence
  chemically synthesized
atatgctaattagcttgataga

SEQ ID NO: 151944 - DNA, 22 bp, Artificial Sequence
  chemically synthesized
attagcttgatagactctctct

SEQ ID NO: 151945 - DNA, 22 bp, Artificial Sequence
  chemically synthesized
gcttgatagactctctctacaa

SEQ ID NO: 151946 - DNA, 22 bp, Artificial Sequence
  chemically synthesized
gatagactctctctacaatgta

SEQ ID NO: 151947 - DNA, 22 bp, Artificial Sequence
  chemically synthesized
atagactctctctacaatgtat

SEQ ID NO: 151948 - DNA, 22 bp, Artificial Sequence
  chemically synthesized
tctctacaatgtatatatagat

SEQ ID NO: 151949 - DNA, 22 bp, Artificial Sequence
  chemically synthesized
tctacaatgtatatatagatca

SEQ ID NO: 151950 - DNA, 22 bp, Artificial Sequence
  chemically synthesized
tacaatgtatatatagatcaaa

SEQ ID NO: 151951 - DNA, 22 bp, Artificial Sequence
  chemically synthesized
caatgtatatatagatcaaaca

SEQ ID NO: 151952 - DNA, 22 bp, Artificial Sequence
  chemically synthesized
tatcccataacatattatatat

SEQ ID NO: 151953 - DNA, 22 bp, Artificial Sequence
  chemically synthesized
tatatattatatatttatatta

SEQ ID NO: 151954 - DNA, 22 bp, Artificial Sequence
  chemically synthesized
tatatttatattatatattatt

SEQ ID NO: 151955 - DNA, 22 bp, Artificial Sequence
  chemically synthesized
atattatatattattattgtat

SEQ ID NO: 151956 - DNA, 22 bp, Artificial Sequence
  chemically synthesized
tattatatattattattgtatc

SEQ ID NO: 151957 - DNA, 22 bp, Artificial Sequence
  chemically synthesized
tatattattattgtatccatta

SEQ ID NO: 151958 - DNA, 22 bp, Artificial Sequence
  chemically synthesized
ttattgtatccattaatatatg

SEQ ID NO: 151959 - DNA, 22 bp, Artificial Sequence
  chemically synthesized
ttgtatccattaatatatgcac

SEQ ID NO: 151960 - DNA, 22 bp, Artificial Sequence
  chemically synthesized
tatccattaatatatgcactta

SEQ ID NO: 151961 - DNA, 22 bp, Artificial Sequence
  chemically synthesized
atatatgcacttattatttgcc

SEQ ID NO: 151962 - DNA, 22 bp, Artificial Sequence
  chemically synthesized
attatttgccaggcaaataaaa

SEQ ID NO: 151963 - DNA, 22 bp, Artificial Sequence
  chemically synthesized
ttatttgccaggcaaataaaaa

SEQ ID NO: 151964 - DNA, 22 bp, Artificial Sequence
  chemically synthesized
tttgccaggcaaataaaaaatg

SEQ ID NO: 151965 - DNA, 22 bp, Artificial Sequence
  chemically synthesized
gccaggcaaataaaaaatgttt

SEQ ID NO: 151966 - DNA, 22 bp, Artificial Sequence
  chemically synthesized
ccaggcaaataaaaaatgtttt

SEQ ID NO: 151967 - DNA, 22 bp, Artificial Sequence
  chemically synthesized
ttaaaatataaatttatttgta

SEQ ID NO: 151968 - DNA, 22 bp, Artificial Sequence
  chemically synthesized
taaaatataaatttatttgtaa

SEQ ID NO: 151969 - DNA, 22 bp, Artificial Sequence
  chemically synthesized
aaaatataaatttatttgtaac

SEQ ID NO: 151970 - DNA, 22 bp, Artificial Sequence
  chemically synthesized
aaatataaatttatttgtaacc

SEQ ID NO: 151971 - DNA, 22 bp, Artificial Sequence
  chemically synthesized
atttgtaacctccttttacttt

SEQ ID NO: 151972 - DNA, 22 bp, Artificial Sequence
  chemically synthesized
tttgtaacctccttttactttt

SEQ ID NO: 151973 - DNA, 22 bp, Artificial Sequence
  chemically synthesized
gtaacctccttttacttttctg

SEQ ID NO: 151974 - DNA, 22 bp, Artificial Sequence
  chemically synthesized
taacctccttttacttttctgc

SEQ ID NO: 151975 - DNA, 22 bp, Artificial Sequence
  chemically synthesized
cttttacttttctgcttggttt

SEQ ID NO: 151976 - DNA, 22 bp, Artificial Sequence
  chemically synthesized
ttacttttctgcttggttttct

SEQ ID NO: 151977 - DNA, 22 bp, Artificial Sequence
  chemically synthesized
tacttttctgcttggttttctt

SEQ ID NO: 151978 - DNA, 22 bp, Artificial Sequence
  chemically synthesized
acttttctgcttggttttcttc

SEQ ID NO: 151979 - DNA, 22 bp, Artificial Sequence
  chemically synthesized
cttttctgcttggttttcttct

SEQ ID NO: 151980 - DNA, 22 bp, Artificial Sequence
  chemically synthesized
ttctgcttggttttcttctttc

SEQ ID NO: 151981 - DNA, 22 bp, Artificial Sequence
  chemically synthesized
tctgcttggttttcttctttca

SEQ ID NO: 151982 - DNA, 22 bp, Artificial Sequence
  chemically synthesized
ctgcttggttttcttctttcat

SEQ ID NO: 151983 - DNA, 22 bp, Artificial Sequence
  chemically synthesized
tgcttggttttcttctttcatt

SEQ ID NO: 151984 - DNA, 22 bp, Artificial Sequence
  chemically synthesized
cttggttttcttctttcattca

SEQ ID NO: 151985 - DNA, 22 bp, Artificial Sequence
  chemically synthesized
ggttttcttctttcattcagtg

SEQ ID NO: 151986 - DNA, 22 bp, Artificial Sequence
  chemically synthesized
gttttcttctttcattcagtgt

SEQ ID NO: 151987 - DNA, 22 bp, Artificial Sequence
  chemically synthesized
tcttctttcattcagtgtttac

SEQ ID NO: 151988 - DNA, 22 bp, Artificial Sequence
  chemically synthesized
cttctttcattcagtgtttacc

SEQ ID NO: 151989 - DNA, 22 bp, Artificial Sequence
  chemically synthesized
ttctttcattcagtgtttacca

SEQ ID NO: 151990 - DNA, 22 bp, Artificial Sequence
  chemically synthesized
ctttcattcagtgtttaccagt

SEQ ID NO: 151991 - DNA, 22 bp, Artificial Sequence
  chemically synthesized
tttcattcagtgtttaccagtt

SEQ ID NO: 151992 - DNA, 22 bp, Artificial Sequence
  chemically synthesized
tcattcagtgtttaccagtttc

SEQ ID NO: 151993 - DNA, 22 bp, Artificial Sequence
  chemically synthesized
cattcagtgtttaccagtttct

SEQ ID NO: 151994 - DNA, 22 bp, Artificial Sequence
  chemically synthesized
attcagtgtttaccagtttctt

SEQ ID NO: 151995 - DNA, 22 bp, Artificial Sequence
  chemically synthesized
agtgtttaccagtttcttatag

SEQ ID NO: 151996 - DNA, 22 bp, Artificial Sequence
  chemically synthesized
accagtttcttatagttaattt

SEQ ID NO: 151997 - DNA, 22 bp, Artificial Sequence
  chemically synthesized
ccagtttcttatagttaatttt

SEQ ID NO: 151998 - DNA, 22 bp, Artificial Sequence
  chemically synthesized
cttatagttaattttattttaa

SEQ ID NO: 151999 - DNA, 22 bp, Artificial Sequence
  chemically synthesized
ttatagttaattttattttaag

SEQ ID NO: 152000 - DNA, 22 bp, Artificial Sequence
  chemically synthesized
atagttaattttattttaagct

SEQ ID NO: 152001 - DNA, 22 bp, Artificial Sequence
  chemically synthesized
tagttaattttattttaagctg

SEQ ID NO: 152002 - DNA, 22 bp, Artificial Sequence
  chemically synthesized
attttattttaagctgtctcac

SEQ ID NO: 152003 - DNA, 22 bp, Artificial Sequence
  chemically synthesized
tattttaagctgtctcacattt

SEQ ID NO: 152004 - DNA, 22 bp, Artificial Sequence
  chemically synthesized
attttaagctgtctcacatttt

SEQ ID NO: 152005 - DNA, 22 bp, Artificial Sequence
  chemically synthesized
ttttaagctgtctcacattttc

SEQ ID NO: 152006 - DNA, 22 bp, Artificial Sequence
  chemically synthesized
taagctgtctcacattttctga

SEQ ID NO: 152007 - DNA, 22 bp, Artificial Sequence
  chemically synthesized
aagctgtctcacattttctgaa

SEQ ID NO: 152008 - DNA, 22 bp, Artificial Sequence
  chemically synthesized
agctgtctcacattttctgaag

SEQ ID NO: 152009 - DNA, 22 bp, Artificial Sequence
  chemically synthesized
tctcacattttctgaagaaaag

SEQ ID NO: 152010 - DNA, 22 bp, Artificial Sequence
  chemically synthesized
acattttctgaagaaaagggaa

SEQ ID NO: 152011 - DNA, 22 bp, Artificial Sequence
  chemically synthesized
tctgaagaaaagggaacatatt

SEQ ID NO: 152012 - DNA, 22 bp, Artificial Sequence
  chemically synthesized
ctgaagaaaagggaacatatta

SEQ ID NO: 152013 - DNA, 22 bp, Artificial Sequence
  chemically synthesized
tgaagaaaagggaacatattaa

SEQ ID NO: 152014 - DNA, 22 bp, Artificial Sequence
  chemically synthesized
aagaaaagggaacatattaaag

SEQ ID NO: 152015 - DNA, 22 bp, Artificial Sequence
  chemically synthesized
aagccaacaaaacaaatacact

SEQ ID NO: 152016 - DNA, 22 bp, Artificial Sequence
  chemically synthesized
tcttgcatgagatgatttatgt

SEQ ID NO: 152017 - DNA, 22 bp, Artificial Sequence
  chemically synthesized
gcatgagatgatttatgtcatg

SEQ ID NO: 152018 - DNA, 22 bp, Artificial Sequence
  chemically synthesized
catgagatgatttatgtcatgg

SEQ ID NO: 152019 - DNA, 22 bp, Artificial Sequence
  chemically synthesized
atgtcatggtacaatcaaatgc

SEQ ID NO: 152020 - DNA, 22 bp, Artificial Sequence
  chemically synthesized
tgtcatggtacaatcaaatgct

SEQ ID NO: 152021 - DNA, 22 bp, Artificial Sequence
  chemically synthesized
taaatcttataaaaacttctca

SEQ ID NO: 152022 - DNA, 22 bp, Artificial Sequence
  chemically synthesized
ataaaaacttctcaaatggtta

SEQ ID NO: 152023 - DNA, 22 bp, Artificial Sequence
  chemically synthesized
taaaaacttctcaaatggttag

SEQ ID NO: 152024 - DNA, 22 bp, Artificial Sequence
  chemically synthesized
ctcaaatggttagatggctaca

SEQ ID NO: 152025 - DNA, 22 bp, Artificial Sequence
  chemically synthesized
tcaaatggttagatggctacag

SEQ ID NO: 152026 - DNA, 22 bp, Artificial Sequence
  chemically synthesized
aaatggttagatggctacagtt

SEQ ID NO: 152027 - DNA, 22 bp, Artificial Sequence
  chemically synthesized
gatggctacagttgaacagatg

SEQ ID NO: 152028 - DNA, 22 bp, Artificial Sequence
  chemically synthesized
cagttgaacagatggaccatgt

SEQ ID NO: 152029 - DNA, 22 bp, Artificial Sequence
  chemically synthesized
aacagatggaccatgtcatata

SEQ ID NO: 152030 - DNA, 22 bp, Artificial Sequence
  chemically synthesized
tttataatgcttctaaggtatg

SEQ ID NO: 152031 - DNA, 22 bp, Artificial Sequence
  chemically synthesized
ttataatgcttctaaggtatgg

SEQ ID NO: 152032 - DNA, 22 bp, Artificial Sequence
  chemically synthesized
tataatgcttctaaggtatggc

SEQ ID NO: 152033 - DNA, 22 bp, Artificial Sequence
  chemically synthesized
ataatgcttctaaggtatggct

SEQ ID NO: 152034 - DNA, 22 bp, Artificial Sequence
  chemically synthesized
taatgcttctaaggtatggcta

SEQ ID NO: 152035 - DNA, 22 bp, Artificial Sequence
  chemically synthesized
ctaaggtatggctaatttttaa

SEQ ID NO: 152036 - DNA, 22 bp, Artificial Sequence
  chemically synthesized
taaggtatggctaatttttaaa

SEQ ID NO: 152037 - DNA, 22 bp, Artificial Sequence
  chemically synthesized
aggtatggctaatttttaaaaa

SEQ ID NO: 152038 - DNA, 22 bp, Artificial Sequence
  chemically synthesized
atttttaaaaaatattttagta

SEQ ID NO: 152039 - DNA, 22 bp, Artificial Sequence
  chemically synthesized
ttaaaaaatattttagtaatga

SEQ ID NO: 152040 - DNA, 22 bp, Artificial Sequence
  chemically synthesized
taaaaaatattttagtaatgat

SEQ ID NO: 152041 - DNA, 22 bp, Artificial Sequence
  chemically synthesized
aaaaaatattttagtaatgatg

SEQ ID NO: 152042 - DNA, 22 bp, Artificial Sequence
  chemically synthesized
aaaaatattttagtaatgatgg

SEQ ID NO: 152043 - DNA, 22 bp, Artificial Sequence
  chemically synthesized
tagtaatgatgggaatattatt

SEQ ID NO: 152044 - DNA, 22 bp, Artificial Sequence
  chemically synthesized
agtaatgatgggaatattattt

SEQ ID NO: 152045 - DNA, 22 bp, Artificial Sequence
  chemically synthesized
gtaatgatgggaatattattta

SEQ ID NO: 152046 - DNA, 22 bp, Artificial Sequence
  chemically synthesized
tttatagaaatcttataaaata

SEQ ID NO: 152047 - DNA, 22 bp, Artificial Sequence
  chemically synthesized
atagaaatcttataaaatatat

SEQ ID NO: 152048 - DNA, 22 bp, Artificial Sequence
  chemically synthesized
tagaaatcttataaaatatata

SEQ ID NO: 152049 - DNA, 22 bp, Artificial Sequence
  chemically synthesized
ataaaatatataatgaaatatg

SEQ ID NO: 152050 - DNA, 22 bp, Artificial Sequence
  chemically synthesized
taaaatatataatgaaatatgt

SEQ ID NO: 152051 - DNA, 22 bp, Artificial Sequence
  chemically synthesized
gataaatgtgtatatacataat

SEQ ID NO: 152052 - DNA, 22 bp, Artificial Sequence
  chemically synthesized
attacataatatataatatata

SEQ ID NO: 152053 - DNA, 22 bp, Artificial Sequence
  chemically synthesized
ttacataatatataatatataa

SEQ ID NO: 152054 - DNA, 22 bp, Artificial Sequence
  chemically synthesized
cataatatataatatataatgt

SEQ ID NO: 152055 - DNA, 22 bp, Artificial Sequence
  chemically synthesized
atatattacatgcattatatat

SEQ ID NO: 152056 - DNA, 22 bp, Artificial Sequence
  chemically synthesized
tatattacatgcattatatatt

SEQ ID NO: 152057 - DNA, 22 bp, Artificial Sequence
  chemically synthesized
catgcattatatattaaatata

SEQ ID NO: 152058 - DNA, 22 bp, Artificial Sequence
  chemically synthesized
tatattaaatataatacatttt

SEQ ID NO: 152059 - DNA, 22 bp, Artificial Sequence
  chemically synthesized
aatataatacattttatatatt

SEQ ID NO: 152060 - DNA, 22 bp, Artificial Sequence
  chemically synthesized
tatatattatatattaaaatat

SEQ ID NO: 152061 - DNA, 22 bp, Artificial Sequence
  chemically synthesized
atatattatatattaaaatatg

SEQ ID NO: 152062 - DNA, 22 bp, Artificial Sequence
  chemically synthesized
tatattatatattaaaatatgt

SEQ ID NO: 152063 - DNA, 22 bp, Artificial Sequence
  chemically synthesized
tatattaaaatatgtaataata

SEQ ID NO: 152064 - DNA, 22 bp, Artificial Sequence
  chemically synthesized
aaatatgtaataatatgttatt

SEQ ID NO: 152065 - DNA, 22 bp, Artificial Sequence
  chemically synthesized
ttaaatatatacaataatctat

SEQ ID NO: 152066 - DNA, 22 bp, Artificial Sequence
  chemically synthesized
aatatatacaataatctattac

SEQ ID NO: 152067 - DNA, 22 bp, Artificial Sequence
  chemically synthesized
ttacattttatgcttatataat

SEQ ID NO: 152068 - DNA, 22 bp, Artificial Sequence
  chemically synthesized
cattttatgcttatataatata

SEQ ID NO: 152069 - DNA, 22 bp, Artificial Sequence
  chemically synthesized
tatgcttatataatatataata

SEQ ID NO: 152070 - DNA, 22 bp, Artificial Sequence
  chemically synthesized
atgcttatataatatataataa

SEQ ID NO: 152071 - DNA, 22 bp, Artificial Sequence
  chemically synthesized
tgcttatataatatataataaa

SEQ ID NO: 152072 - DNA, 22 bp, Artificial Sequence
  chemically synthesized
atataatatataataaatatat

SEQ ID NO: 152073 - DNA, 22 bp, Artificial Sequence
  chemically synthesized
tataatatataataaatatata

SEQ ID NO: 152074 - DNA, 22 bp, Artificial Sequence
  chemically synthesized
tatatttgtatctatatatgtt

SEQ ID NO: 152075 - DNA, 22 bp, Artificial Sequence
  chemically synthesized
gtatctatatatgtttataaag

SEQ ID NO: 152076 - DNA, 22 bp, Artificial Sequence
  chemically synthesized
tatctatatatgtttataaagt

SEQ ID NO: 152077 - DNA, 22 bp, Artificial Sequence
  chemically synthesized
tatatgtttataaagtcattcc

SEQ ID NO: 152078 - DNA, 22 bp, Artificial Sequence
  chemically synthesized
ataaagtcattcctctaattag

SEQ ID NO: 152079 - DNA, 22 bp, Artificial Sequence
  chemically synthesized
taaagtcattcctctaattagg

SEQ ID NO: 152080 - DNA, 22 bp, Artificial Sequence
  chemically synthesized
ctctaattaggtcataaccatt

SEQ ID NO: 152081 - DNA, 22 bp, Artificial Sequence
  chemically synthesized
taattaggtcataaccattcag

SEQ ID NO: 152082 - DNA, 22 bp, Artificial Sequence
  chemically synthesized
attaggtcataaccattcaggt

SEQ ID NO: 152083 - DNA, 22 bp, Artificial Sequence
  chemically synthesized
ggtcataaccattcaggtaaac

SEQ ID NO: 152084 - DNA, 22 bp, Artificial Sequence
  chemically synthesized
aggtaaactggaaatttaagcc

SEQ ID NO: 152085 - DNA, 22 bp, Artificial Sequence
  chemically synthesized
gaaatttaagcctacttcaggt

SEQ ID NO: 152086 - DNA, 22 bp, Artificial Sequence
  chemically synthesized
aagcctacttcaggtttgtggt

SEQ ID NO: 152087 - DNA, 22 bp, Artificial Sequence
  chemically synthesized
agcctacttcaggtttgtggta

SEQ ID NO: 152088 - DNA, 22 bp, Artificial Sequence
  chemically synthesized
cttcaggtttgtggtaaataga

SEQ ID NO: 152089 - DNA, 22 bp, Artificial Sequence
  chemically synthesized
caggtttgtggtaaatagattc

SEQ ID NO: 152090 - DNA, 22 bp, Artificial Sequence
  chemically synthesized
aggtttgtggtaaatagattct

SEQ ID NO: 152091 - DNA, 22 bp, Artificial Sequence
  chemically synthesized
gtggtaaatagattctctctga

SEQ ID NO: 152092 - DNA, 22 bp, Artificial Sequence
  chemically synthesized
tggtaaatagattctctctgaa

SEQ ID NO: 152093 - DNA, 22 bp, Artificial Sequence
  chemically synthesized
tctctgaactagcatattcaga

SEQ ID NO: 152094 - DNA, 22 bp, Artificial Sequence
  chemically synthesized
tctgaactagcatattcagaat

SEQ ID NO: 152095 - DNA, 22 bp, Artificial Sequence
  chemically synthesized
tgaactagcatattcagaatca

SEQ ID NO: 152096 - DNA, 22 bp, Artificial Sequence
  chemically synthesized
aactagcatattcagaatcatt

SEQ ID NO: 152097 - DNA, 22 bp, Artificial Sequence
  chemically synthesized
gcatattcagaatcattaaaca

SEQ ID NO: 152098 - DNA, 22 bp, Artificial Sequence
  chemically synthesized
agaatcattaaacagtcagttc

SEQ ID NO: 152099 - DNA, 22 bp, Artificial Sequence
  chemically synthesized
aacagtcagttctttggacaag

SEQ ID NO: 152100 - DNA, 22 bp, Artificial Sequence
  chemically synthesized
tttggacaagtcttatagaatg

SEQ ID NO: 152101 - DNA, 22 bp, Artificial Sequence
  chemically synthesized
tggacaagtcttatagaatgtt

SEQ ID NO: 152102 - DNA, 22 bp, Artificial Sequence
  chemically synthesized
ggacaagtcttatagaatgttc

SEQ ID NO: 152103 - DNA, 22 bp, Artificial Sequence
  chemically synthesized
gacaagtcttatagaatgttct

SEQ ID NO: 152104 - DNA, 22 bp, Artificial Sequence
  chemically synthesized
atagaatgttcttacctcttca

SEQ ID NO: 152105 - DNA, 22 bp, Artificial Sequence
  chemically synthesized
tagaatgttcttacctcttcag

SEQ ID NO: 152106 - DNA, 22 bp, Artificial Sequence
  chemically synthesized
ttacctcttcagccatcccaag

SEQ ID NO: 152107 - DNA, 22 bp, Artificial Sequence
  chemically synthesized
acctcttcagccatcccaagac

SEQ ID NO: 152108 - DNA, 22 bp, Artificial Sequence
  chemically synthesized
cctcttcagccatcccaagact

SEQ ID NO: 152109 - DNA, 22 bp, Artificial Sequence
  chemically synthesized
ttcagccatcccaagactcttg

SEQ ID NO: 152110 - DNA, 22 bp, Artificial Sequence
  chemically synthesized
cagccatcccaagactcttgag

SEQ ID NO: 152111 - DNA, 22 bp, Artificial Sequence
  chemically synthesized
agccatcccaagactcttgagg

SEQ ID NO: 152112 - DNA, 22 bp, Artificial Sequence
  chemically synthesized
ttgagggcctgacctcgcttac

SEQ ID NO: 152113 - DNA, 22 bp, Artificial Sequence
  chemically synthesized
gagggcctgacctcgcttacac

SEQ ID NO: 152114 - DNA, 22 bp, Artificial Sequence
  chemically synthesized
agggcctgacctcgcttacact

SEQ ID NO: 152115 - DNA, 22 bp, Artificial Sequence
  chemically synthesized
acctcgcttacactaaagcaga

SEQ ID NO: 152116 - DNA, 22 bp, Artificial Sequence
  chemically synthesized
gcttacactaaagcagatctgc

SEQ ID NO: 152117 - DNA, 22 bp, Artificial Sequence
  chemically synthesized
acactaaagcagatctgcctta

SEQ ID NO: 152118 - DNA, 22 bp, Artificial Sequence
  chemically synthesized
cactaaagcagatctgccttat

SEQ ID NO: 152119 - DNA, 22 bp, Artificial Sequence
  chemically synthesized
aagcagatctgccttatgcatc

SEQ ID NO: 152120 - DNA, 22 bp, Artificial Sequence
  chemically synthesized
ccttatgcatcactgaagtagg

SEQ ID NO: 152121 - DNA, 22 bp, Artificial Sequence
  chemically synthesized
atgcatcactgaagtagggagg

SEQ ID NO: 152122 - DNA, 22 bp, Artificial Sequence
  chemically synthesized
tgcatcactgaagtagggaggg

SEQ ID NO: 152123 - DNA, 22 bp, Artificial Sequence
  chemically synthesized
aagtagggagggaagaaagttt

SEQ ID NO: 152124 - DNA, 22 bp, Artificial Sequence
  chemically synthesized
gatgaactacttctgaccccta

SEQ ID NO: 152125 - DNA, 22 bp, Artificial Sequence
  chemically synthesized
atgaactacttctgacccctag

SEQ ID NO: 152126 - DNA, 22 bp, Artificial Sequence
  chemically synthesized
cttctgacccctagtggtgtcc

SEQ ID NO: 152127 - DNA, 22 bp, Artificial Sequence
  chemically synthesized
ctgacccctagtggtgtccaga

SEQ ID NO: 152128 - DNA, 22 bp, Artificial Sequence
  chemically synthesized
tgacccctagtggtgtccagaa

SEQ ID NO: 152129 - DNA, 22 bp, Artificial Sequence
  chemically synthesized
acccctagtggtgtccagaaaa

SEQ ID NO: 152130 - DNA, 22 bp, Artificial Sequence
  chemically synthesized
gtggtgtccagaaaagaccatt

SEQ ID NO: 152131 - DNA, 22 bp, Artificial Sequence
  chemically synthesized
aaggaatgacctttaaaggatg

SEQ ID NO: 152132 - DNA, 22 bp, Artificial Sequence
  chemically synthesized
taaaggatggacatacaatttt

SEQ ID NO: 152133 - DNA, 22 bp, Artificial Sequence
  chemically synthesized
aaaggatggacatacaattttt

SEQ ID NO: 152134 - DNA, 22 bp, Artificial Sequence
  chemically synthesized
aaggatggacatacaatttttt

SEQ ID NO: 152135 - DNA, 22 bp, Artificial Sequence
  chemically synthesized
tttgtccaaggcaggacatgtg

SEQ ID NO: 152136 - DNA, 22 bp, Artificial Sequence
  chemically synthesized
ttgtccaaggcaggacatgtgt

SEQ ID NO: 152137 - DNA, 22 bp, Artificial Sequence
  chemically synthesized
tgtccaaggcaggacatgtgtg

SEQ ID NO: 152138 - DNA, 22 bp, Artificial Sequence
  chemically synthesized
gtccaaggcaggacatgtgtgg

SEQ ID NO: 152139 - DNA, 22 bp, Artificial Sequence
  chemically synthesized
tccaaggcaggacatgtgtggg

SEQ ID NO: 152140 - DNA, 22 bp, Artificial Sequence
  chemically synthesized
tcagtaattatgttctaagaac

SEQ ID NO: 152141 - DNA, 22 bp, Artificial Sequence
  chemically synthesized
cagtaattatgttctaagaaca

SEQ ID NO: 152142 - DNA, 22 bp, Artificial Sequence
  chemically synthesized
agtaattatgttctaagaacag

SEQ ID NO: 152143 - DNA, 22 bp, Artificial Sequence
  chemically synthesized
tgttctaagaacagcaaaaact

SEQ ID NO: 152144 - DNA, 22 bp, Artificial Sequence
  chemically synthesized
taagaacagcaaaaactccact

SEQ ID NO: 152145 - DNA, 22 bp, Artificial Sequence
  chemically synthesized
agaacagcaaaaactccactgc

SEQ ID NO: 152146 - DNA, 22 bp, Artificial Sequence
  chemically synthesized
cactgccttggcaaataggaat

SEQ ID NO: 152147 - DNA, 22 bp, Artificial Sequence
  chemically synthesized
ccttggcaaataggaatgtttt

SEQ ID NO: 152148 - DNA, 22 bp, Artificial Sequence
  chemically synthesized
ggcaaataggaatgttttagtt

SEQ ID NO: 152149 - DNA, 22 bp, Artificial Sequence
  chemically synthesized
gcaaataggaatgttttagttc

SEQ ID NO: 152150 - DNA, 22 bp, Artificial Sequence
  chemically synthesized
tagttctatagaattataaaga

SEQ ID NO: 152151 - DNA, 22 bp, Artificial Sequence
  chemically synthesized
agttctatagaattataaagaa

SEQ ID NO: 152152 - DNA, 22 bp, Artificial Sequence
  chemically synthesized
gttctatagaattataaagaag

SEQ ID NO: 152153 - DNA, 22 bp, Artificial Sequence
  chemically synthesized
tatagaattataaagaagctgt

SEQ ID NO: 152154 - DNA, 22 bp, Artificial Sequence
  chemically synthesized
tagaattataaagaagctgtct

SEQ ID NO: 152155 - DNA, 22 bp, Artificial Sequence
  chemically synthesized
taaagaagctgtcttttaaaca

SEQ ID NO: 152156 - DNA, 22 bp, Artificial Sequence
  chemically synthesized
tcttttaaacacaatatacttt

SEQ ID NO: 152157 - DNA, 22 bp, Artificial Sequence
  chemically synthesized
ttaaacacaatatactttctct

SEQ ID NO: 152158 - DNA, 22 bp, Artificial Sequence
  chemically synthesized
taaacacaatatactttctcta

SEQ ID NO: 152159 - DNA, 22 bp, Artificial Sequence
  chemically synthesized
aaacacaatatactttctctat

SEQ ID NO: 152160 - DNA, 22 bp, Artificial Sequence
  chemically synthesized
aacacaatatactttctctatg

SEQ ID NO: 152161 - DNA, 22 bp, Artificial Sequence
  chemically synthesized
tctctatgtctttggaacaatg

SEQ ID NO: 152162 - DNA, 22 bp, Artificial Sequence
  chemically synthesized
ctctatgtctttggaacaatga

SEQ ID NO: 152163 - DNA, 22 bp, Artificial Sequence
  chemically synthesized
tctatgtctttggaacaatgac

SEQ ID NO: 152164 - DNA, 22 bp, Artificial Sequence
  chemically synthesized
tatgtctttggaacaatgacta

SEQ ID NO: 152165 - DNA, 22 bp, Artificial Sequence
  chemically synthesized
tgtctttggaacaatgactatt

SEQ ID NO: 152166 - DNA, 22 bp, Artificial Sequence
  chemically synthesized
tggaacaatgactattggtcat

SEQ ID NO: 152167 - DNA, 22 bp, Artificial Sequence
  chemically synthesized
ggaacaatgactattggtcatt

SEQ ID NO: 152168 - DNA, 22 bp, Artificial Sequence
  chemically synthesized
gaacaatgactattggtcatta

SEQ ID NO: 152169 - DNA, 22 bp, Artificial Sequence
  chemically synthesized
ttggtcattaccctattttaaa

SEQ ID NO: 152170 - DNA, 22 bp, Artificial Sequence
  chemically synthesized
gtcattaccctattttaaagta

SEQ ID NO: 152171 - DNA, 22 bp, Artificial Sequence
  chemically synthesized
ccctattttaaagtaagcaagt

SEQ ID NO: 152172 - DNA, 22 bp, Artificial Sequence
  chemically synthesized
ttttaaagtaagcaagtaatca

SEQ ID NO: 152173 - DNA, 22 bp, Artificial Sequence
  chemically synthesized
taaagtaagcaagtaatcacac

SEQ ID NO: 152174 - DNA, 22 bp, Artificial Sequence
  chemically synthesized
aaagtaagcaagtaatcacaca

SEQ ID NO: 152175 - DNA, 22 bp, Artificial Sequence
  chemically synthesized
aagtaagcaagtaatcacacag

SEQ ID NO: 152176 - DNA, 22 bp, Artificial Sequence
  chemically synthesized
ttctgaaaagacagaaaaaaaa

SEQ ID NO: 152177 - DNA, 22 bp, Artificial Sequence
  chemically synthesized
tgaaaagacagaaaaaaaaaaa

SEQ ID NO: 152178 - DNA, 22 bp, Artificial Sequence
  chemically synthesized
aaaagacagaaaaaaaaaaaaa

SEQ ID NO: 152179 - DNA, 22 bp, Artificial Sequence
  chemically synthesized
ctgcatatgtaggtcagtttta

SEQ ID NO: 152180 - DNA, 22 bp, Artificial Sequence
  chemically synthesized
tgcatatgtaggtcagttttaa

SEQ ID NO: 152181 - DNA, 22 bp, Artificial Sequence
  chemically synthesized
catatgtaggtcagttttaatc

SEQ ID NO: 152182 - DNA, 22 bp, Artificial Sequence
  chemically synthesized
taatcagagggcatcagaaaag

SEQ ID NO: 152183 - DNA, 22 bp, Artificial Sequence
  chemically synthesized
aatcagagggcatcagaaaaga

SEQ ID NO: 152184 - DNA, 22 bp, Artificial Sequence
  chemically synthesized
atcagagggcatcagaaaagac

SEQ ID NO: 152185 - DNA, 22 bp, Artificial Sequence
  chemically synthesized
ctgaaagaatgacctggttatt

SEQ ID NO: 152186 - DNA, 22 bp, Artificial Sequence
  chemically synthesized
aaagaatgacctggttattata

SEQ ID NO: 152187 - DNA, 22 bp, Artificial Sequence
  chemically synthesized
gttattataatcacagatttgc

SEQ ID NO: 152188 - DNA, 22 bp, Artificial Sequence
  chemically synthesized
ttataatcacagatttgctttc

SEQ ID NO: 152189 - DNA, 22 bp, Artificial Sequence
  chemically synthesized
taatcacagatttgctttccaa

SEQ ID NO: 152190 - DNA, 22 bp, Artificial Sequence
  chemically synthesized
gctttccaagtcaacattccag

SEQ ID NO: 152191 - DNA, 22 bp, Artificial Sequence
  chemically synthesized
ctttccaagtcaacattccaga

SEQ ID NO: 152192 - DNA, 22 bp, Artificial Sequence
  chemically synthesized
tccaagtcaacattccagacag

SEQ ID NO: 152193 - DNA, 22 bp, Artificial Sequence
  chemically synthesized
ccaagtcaacattccagacagt

SEQ ID NO: 152194 - DNA, 22 bp, Artificial Sequence
  chemically synthesized
caagtcaacattccagacagtg

SEQ ID NO: 152195 - DNA, 22 bp, Artificial Sequence
  chemically synthesized
cagacagtgctcagaggggata

SEQ ID NO: 152196 - DNA, 22 bp, Artificial Sequence
  chemically synthesized
agaggggatacgaaaacccttt

SEQ ID NO: 152197 - DNA, 22 bp, Artificial Sequence
  chemically synthesized
ttatttctccagactcaaattc

SEQ ID NO: 152198 - DNA, 22 bp, Artificial Sequence
  chemically synthesized
tatttctccagactcaaattca

SEQ ID NO: 152199 - DNA, 22 bp, Artificial Sequence
  chemically synthesized
atttctccagactcaaattcac

SEQ ID NO: 152200 - DNA, 22 bp, Artificial Sequence
  chemically synthesized
tttctccagactcaaattcact

SEQ ID NO: 152201 - DNA, 22 bp, Artificial Sequence
  chemically synthesized
ctccagactcaaattcactgct

SEQ ID NO: 152202 - DNA, 22 bp, Artificial Sequence
  chemically synthesized
tccagactcaaattcactgcta

SEQ ID NO: 152203 - DNA, 22 bp, Artificial Sequence
  chemically synthesized
cagactcaaattcactgctatt

SEQ ID NO: 152204 - DNA, 22 bp, Artificial Sequence
  chemically synthesized
aaattcactgctatttgtcttc

SEQ ID NO: 152205 - DNA, 22 bp, Artificial Sequence
  chemically synthesized
actgctatttgtcttctctatt

SEQ ID NO: 152206 - DNA, 22 bp, Artificial Sequence
  chemically synthesized
ctatttgtcttctctatttatt

SEQ ID NO: 152207 - DNA, 22 bp, Artificial Sequence
  chemically synthesized
tttgtcttctctatttatttta

SEQ ID NO: 152208 - DNA, 22 bp, Artificial Sequence
  chemically synthesized
gtcttctctatttattttatta

SEQ ID NO: 152209 - DNA, 22 bp, Artificial Sequence
  chemically synthesized
tcttctctatttattttattat

SEQ ID NO: 152210 - DNA, 22 bp, Artificial Sequence
  chemically synthesized
ctctatttattttattataggc

SEQ ID NO: 152211 - DNA, 22 bp, Artificial Sequence
  chemically synthesized
tctatttattttattataggca

SEQ ID NO: 152212 - DNA, 22 bp, Artificial Sequence
  chemically synthesized
tatttattttattataggcatt

SEQ ID NO: 152213 - DNA, 22 bp, Artificial Sequence
  chemically synthesized
tttattttattataggcattgt

SEQ ID NO: 152214 - DNA, 22 bp, Artificial Sequence
  chemically synthesized
attttattataggcattgttct

SEQ ID NO: 152215 - DNA, 22 bp, Artificial Sequence
  chemically synthesized
ttttattataggcattgttctg

SEQ ID NO: 152216 - DNA, 22 bp, Artificial Sequence
  chemically synthesized
tattataggcattgttctggtt

SEQ ID NO: 152217 - DNA, 22 bp, Artificial Sequence
  chemically synthesized
attataggcattgttctggttg

SEQ ID NO: 152218 - DNA, 22 bp, Artificial Sequence
  chemically synthesized
ttataggcattgttctggttgc

SEQ ID NO: 152219 - DNA, 22 bp, Artificial Sequence
  chemically synthesized
taggcattgttctggttgctgg

SEQ ID NO: 152220 - DNA, 22 bp, Artificial Sequence
  chemically synthesized
ttctggttgctgggaactcaga

SEQ ID NO: 152221 - DNA, 22 bp, Artificial Sequence
  chemically synthesized
tggttgctgggaactcagactg

SEQ ID NO: 152222 - DNA, 22 bp, Artificial Sequence
  chemically synthesized
gttgctgggaactcagactgag

SEQ ID NO: 152223 - DNA, 22 bp, Artificial Sequence
  chemically synthesized
ctgggaactcagactgagatac

SEQ ID NO: 152224 - DNA, 22 bp, Artificial Sequence
  chemically synthesized
ggaactcagactgagataccat

SEQ ID NO: 152225 - DNA, 22 bp, Artificial Sequence
  chemically synthesized
agactgagataccatacactga

SEQ ID NO: 152226 - DNA, 22 bp, Artificial Sequence
  chemically synthesized
agataccatacactgactctca

SEQ ID NO: 152227 - DNA, 22 bp, Artificial Sequence
  chemically synthesized
actctcagatagcataacacaa

SEQ ID NO: 152228 - DNA, 22 bp, Artificial Sequence
  chemically synthesized
tcagatagcataacacaacatg

SEQ ID NO: 152229 - DNA, 22 bp, Artificial Sequence
  chemically synthesized
agatagcataacacaacatgat

SEQ ID NO: 152230 - DNA, 22 bp, Artificial Sequence
  chemically synthesized
ggaaaactgtaaatctttttgt

SEQ ID NO: 152231 - DNA, 22 bp, Artificial Sequence
  chemically synthesized
gaaaactgtaaatctttttgtt

SEQ ID NO: 152232 - DNA, 22 bp, Artificial Sequence
  chemically synthesized
taaatctttttgttttttaaat

SEQ ID NO: 152233 - DNA, 22 bp, Artificial Sequence
  chemically synthesized
tttgttttttaaatacaggtgg

SEQ ID NO: 152234 - DNA, 22 bp, Artificial Sequence
  chemically synthesized
ttgttttttaaatacaggtgga

SEQ ID NO: 152235 - DNA, 22 bp, Artificial Sequence
  chemically synthesized
tgttttttaaatacaggtggag

SEQ ID NO: 152236 - DNA, 22 bp, Artificial Sequence
  chemically synthesized
gttttttaaatacaggtggagc

SEQ ID NO: 152237 - DNA, 22 bp, Artificial Sequence
  chemically synthesized
ttttttaaatacaggtggagca

SEQ ID NO: 152238 - DNA, 22 bp, Artificial Sequence
  chemically synthesized
tttaaatacaggtggagcatct

SEQ ID NO: 152239 - DNA, 22 bp, Artificial Sequence
  chemically synthesized
ttaaatacaggtggagcatctg

SEQ ID NO: 152240 - DNA, 22 bp, Artificial Sequence
  chemically synthesized
taaatacaggtggagcatctgg

SEQ ID NO: 152241 - DNA, 22 bp, Artificial Sequence
  chemically synthesized
aaatacaggtggagcatctggc

SEQ ID NO: 152242 - DNA, 22 bp, Artificial Sequence
  chemically synthesized
aatacaggtggagcatctggca

SEQ ID NO: 152243 - DNA, 22 bp, Artificial Sequence
  chemically synthesized
gcacacctgacatattgatctt

SEQ ID NO: 152244 - DNA, 22 bp, Artificial Sequence
  chemically synthesized
acatattgatcttgtttttctt

SEQ ID NO: 152245 - DNA, 22 bp, Artificial Sequence
  chemically synthesized
atcttgtttttctttaaatctt

SEQ ID NO: 152246 - DNA, 22 bp, Artificial Sequence
  chemically synthesized
gtttttctttaaatcttcattt

SEQ ID NO: 152247 - DNA, 22 bp, Artificial Sequence
  chemically synthesized
tttttctttaaatcttcattta

SEQ ID NO: 152248 - DNA, 22 bp, Artificial Sequence
  chemically synthesized
ttctttaaatcttcatttattt

SEQ ID NO: 152249 - DNA, 22 bp, Artificial Sequence
  chemically synthesized
tctttaaatcttcatttattta

SEQ ID NO: 152250 - DNA, 22 bp, Artificial Sequence
  chemically synthesized
ctttaaatcttcatttatttac

SEQ ID NO: 152251 - DNA, 22 bp, Artificial Sequence
  chemically synthesized
tttaaatcttcatttatttacc

SEQ ID NO: 152252 - DNA, 22 bp, Artificial Sequence
  chemically synthesized
taaatcttcatttatttacctt

SEQ ID NO: 152253 - DNA, 22 bp, Artificial Sequence
  chemically synthesized
aaatcttcatttatttacctta

SEQ ID NO: 152254 - DNA, 22 bp, Artificial Sequence
  chemically synthesized
aatcttcatttatttaccttat

SEQ ID NO: 152255 - DNA, 22 bp, Artificial Sequence
  chemically synthesized
catttatttaccttatcaaaac

SEQ ID NO: 152256 - DNA, 22 bp, Artificial Sequence
  chemically synthesized
atttatttaccttatcaaaact

SEQ ID NO: 152257 - DNA, 22 bp, Artificial Sequence
  chemically synthesized
atttaccttatcaaaactatgc

SEQ ID NO: 152258 - DNA, 22 bp, Artificial Sequence
  chemically synthesized
tttaccttatcaaaactatgct

SEQ ID NO: 152259 - DNA, 22 bp, Artificial Sequence
  chemically synthesized
accttatcaaaactatgctctt

SEQ ID NO: 152260 - DNA, 22 bp, Artificial Sequence
  chemically synthesized
ccttatcaaaactatgctcttt

SEQ ID NO: 152261 - DNA, 22 bp, Artificial Sequence
  chemically synthesized
atcaaaactatgctctttcatc

SEQ ID NO: 152262 - DNA, 22 bp, Artificial Sequence
  chemically synthesized
tcaaaactatgctctttcatcc

SEQ ID NO: 152263 - DNA, 22 bp, Artificial Sequence
  chemically synthesized
tgctctttcatcctacctttca

SEQ ID NO: 152264 - DNA, 22 bp, Artificial Sequence
  chemically synthesized
tttcatcctacctttcaaaaca

SEQ ID NO: 152265 - DNA, 22 bp, Artificial Sequence
  chemically synthesized
tcatcctacctttcaaaacata

SEQ ID NO: 152266 - DNA, 22 bp, Artificial Sequence
  chemically synthesized
catcctacctttcaaaacatat

SEQ ID NO: 152267 - DNA, 22 bp, Artificial Sequence
  chemically synthesized
atcctacctttcaaaacatatt

SEQ ID NO: 152268 - DNA, 22 bp, Artificial Sequence
  chemically synthesized
cctttcaaaacatattttaaaa

SEQ ID NO: 152269 - DNA, 22 bp, Artificial Sequence
  chemically synthesized
tcaaaacatattttaaaaaatc

SEQ ID NO: 152270 - DNA, 22 bp, Artificial Sequence
  chemically synthesized
caaaacatattttaaaaaatcc

SEQ ID NO: 152271 - DNA, 22 bp, Artificial Sequence
  chemically synthesized
aaaacatattttaaaaaatcct

SEQ ID NO: 152272 - DNA, 22 bp, Artificial Sequence
  chemically synthesized
taaaaaatcctccaacatgtat

SEQ ID NO: 152273 - DNA, 22 bp, Artificial Sequence
  chemically synthesized
aaaaaatcctccaacatgtatt

SEQ ID NO: 152274 - DNA, 22 bp, Artificial Sequence
  chemically synthesized
aaaaatcctccaacatgtattt

SEQ ID NO: 152275 - DNA, 22 bp, Artificial Sequence
  chemically synthesized
caacatgtattttgctctggta

SEQ ID NO: 152276 - DNA, 22 bp, Artificial Sequence
  chemically synthesized
tgctctggtaatcccaaaaggc

SEQ ID NO: 152277 - DNA, 22 bp, Artificial Sequence
  chemically synthesized
gctctggtaatcccaaaaggct

SEQ ID NO: 152278 - DNA, 22 bp, Artificial Sequence
  chemically synthesized
ctctggtaatcccaaaaggctg

SEQ ID NO: 152279 - DNA, 22 bp, Artificial Sequence
  chemically synthesized
tggtaatcccaaaaggctgata

SEQ ID NO: 152280 - DNA, 22 bp, Artificial Sequence
  chemically synthesized
gtaatcccaaaaggctgatagt

SEQ ID NO: 152281 - DNA, 22 bp, Artificial Sequence
  chemically synthesized
atagtctctatggtggcaacat

SEQ ID NO: 152282 - DNA, 22 bp, Artificial Sequence
  chemically synthesized
tatggtggcaacatggataata

SEQ ID NO: 152283 - DNA, 22 bp, Artificial Sequence
  chemically synthesized
tggtggcaacatggataatact

SEQ ID NO: 152284 - DNA, 22 bp, Artificial Sequence
  chemically synthesized
ttccccatctagatggtctcat

SEQ ID NO: 152285 - DNA, 22 bp, Artificial Sequence
  chemically synthesized
cccatctagatggtctcatttc

SEQ ID NO: 152286 - DNA, 22 bp, Artificial Sequence
  chemically synthesized
gatggtctcatttcttctgtat

SEQ ID NO: 152287 - DNA, 22 bp, Artificial Sequence
  chemically synthesized
atttcttctgtatctagtctga

SEQ ID NO: 152288 - DNA, 22 bp, Artificial Sequence
  chemically synthesized
cttctgtatctagtctgaagaa

SEQ ID NO: 152289 - DNA, 22 bp, Artificial Sequence
  chemically synthesized
ttctgtatctagtctgaagaag

SEQ ID NO: 152290 - DNA, 22 bp, Artificial Sequence
  chemically synthesized
ctgtatctagtctgaagaagcc

SEQ ID NO: 152291 - DNA, 22 bp, Artificial Sequence
  chemically synthesized
tgtatctagtctgaagaagcct

SEQ ID NO: 152292 - DNA, 22 bp, Artificial Sequence
  chemically synthesized
tatctagtctgaagaagcctga

SEQ ID NO: 152293 - DNA, 22 bp, Artificial Sequence
  chemically synthesized
gtctgaagaagcctgaatgaaa

SEQ ID NO: 152294 - DNA, 22 bp, Artificial Sequence
  chemically synthesized
aagaagcctgaatgaaagtaga

SEQ ID NO: 152295 - DNA, 22 bp, Artificial Sequence
  chemically synthesized
aatgaaagtagatttttaagct

SEQ ID NO: 152296 - DNA, 22 bp, Artificial Sequence
  chemically synthesized
ttaagctttgtagctagtctga

SEQ ID NO: 152297 - DNA, 22 bp, Artificial Sequence
  chemically synthesized
taagctttgtagctagtctgaa

SEQ ID NO: 152298 - DNA, 22 bp, Artificial Sequence
  chemically synthesized
aagctttgtagctagtctgaag

SEQ ID NO: 152299 - DNA, 22 bp, Artificial Sequence
  chemically synthesized
agctttgtagctagtctgaagc

SEQ ID NO: 152300 - DNA, 22 bp, Artificial Sequence
  chemically synthesized
tgtagctagtctgaagcctttg

SEQ ID NO: 152301 - DNA, 22 bp, Artificial Sequence
  chemically synthesized
gtagctagtctgaagcctttgt

SEQ ID NO: 152302 - DNA, 22 bp, Artificial Sequence
  chemically synthesized
tagctagtctgaagcctttgta

SEQ ID NO: 152303 - DNA, 22 bp, Artificial Sequence
  chemically synthesized
gtctgaagcctttgtagtcagt

SEQ ID NO: 152304 - DNA, 22 bp, Artificial Sequence
  chemically synthesized
aagcctttgtagtcagtctgaa

SEQ ID NO: 152305 - DNA, 22 bp, Artificial Sequence
  chemically synthesized
tgtagtcagtctgaagaaacct

SEQ ID NO: 152306 - DNA, 22 bp, Artificial Sequence
  chemically synthesized
gtagtcagtctgaagaaacctg

SEQ ID NO: 152307 - DNA, 22 bp, Artificial Sequence
  chemically synthesized
tagtcagtctgaagaaacctgc

SEQ ID NO: 152308 - DNA, 22 bp, Artificial Sequence
  chemically synthesized
aagaaacctgcatgaaaataga

SEQ ID NO: 152309 - DNA, 22 bp, Artificial Sequence
  chemically synthesized
catgaaaatagatttttttttt

SEQ ID NO: 152310 - DNA, 22 bp, Artificial Sequence
  chemically synthesized
tttttttcctttgggacagagt

SEQ ID NO: 152311 - DNA, 22 bp, Artificial Sequence
  chemically synthesized
ttttttcctttgggacagagtc

SEQ ID NO: 152312 - DNA, 22 bp, Artificial Sequence
  chemically synthesized
tttttcctttgggacagagtct

SEQ ID NO: 152313 - DNA, 22 bp, Artificial Sequence
  chemically synthesized
ttttcctttgggacagagtctt

SEQ ID NO: 152314 - DNA, 22 bp, Artificial Sequence
  chemically synthesized
tttcctttgggacagagtcttg

SEQ ID NO: 152315 - DNA, 22 bp, Artificial Sequence
  chemically synthesized
ttcctttgggacagagtcttgc

SEQ ID NO: 152316 - DNA, 22 bp, Artificial Sequence
  chemically synthesized
tcctttgggacagagtcttgct

SEQ ID NO: 152317 - DNA, 22 bp, Artificial Sequence
  chemically synthesized
cctttgggacagagtcttgctc

SEQ ID NO: 152318 - DNA, 22 bp, Artificial Sequence
  chemically synthesized
ctttgggacagagtcttgctct

SEQ ID NO: 152319 - DNA, 22 bp, Artificial Sequence
  chemically synthesized
tgggacagagtcttgctctgtc

SEQ ID NO: 152320 - DNA, 22 bp, Artificial Sequence
  chemically synthesized
gggacagagtcttgctctgtcg

SEQ ID NO: 152321 - DNA, 22 bp, Artificial Sequence
  chemically synthesized
ggacagagtcttgctctgtcgc

SEQ ID NO: 152322 - DNA, 22 bp, Artificial Sequence
  chemically synthesized
gctctgtcgcccagactggagt

SEQ ID NO: 152323 - DNA, 22 bp, Artificial Sequence
  chemically synthesized
ctctgtcgcccagactggagtg

SEQ ID NO: 152324 - DNA, 22 bp, Artificial Sequence
  chemically synthesized
tgtcgcccagactggagtgcaa

SEQ ID NO: 152325 - DNA, 22 bp, Artificial Sequence
  chemically synthesized
tcgcccagactggagtgcaatg

SEQ ID NO: 152326 - DNA, 22 bp, Artificial Sequence
  chemically synthesized
gagtgcaatggcgcgatctcgg

SEQ ID NO: 152327 - DNA, 22 bp, Artificial Sequence
  chemically synthesized
ggctcactgcaacttccacctc

SEQ ID NO: 152328 - DNA, 22 bp, Artificial Sequence
  chemically synthesized
actgcaacttccacctcccagg

SEQ ID NO: 152329 - DNA, 22 bp, Artificial Sequence
  chemically synthesized
caacttccacctcccaggatca

SEQ ID NO: 152330 - DNA, 22 bp, Artificial Sequence
  chemically synthesized
ccacctcccaggatcaagcaat

SEQ ID NO: 152331 - DNA, 22 bp, Artificial Sequence
  chemically synthesized
cacctcccaggatcaagcaatt

SEQ ID NO: 152332 - DNA, 22 bp, Artificial Sequence
  chemically synthesized
ccaggatcaagcaattctcctg

SEQ ID NO: 152333 - DNA, 22 bp, Artificial Sequence
  chemically synthesized
tcctgcctcagtctcccaagta

SEQ ID NO: 152334 - DNA, 22 bp, Artificial Sequence
  chemically synthesized
ctgcctcagtctcccaagtaac

SEQ ID NO: 152335 - DNA, 22 bp, Artificial Sequence
  chemically synthesized
cctcagtctcccaagtaactgg

SEQ ID NO: 152336 - DNA, 22 bp, Artificial Sequence
  chemically synthesized
agtctcccaagtaactgggatt

SEQ ID NO: 152337 - DNA, 22 bp, Artificial Sequence
  chemically synthesized
ccaagtaactgggattacagga

SEQ ID NO: 152338 - DNA, 22 bp, Artificial Sequence
  chemically synthesized
ggattacaggagcacactgcca

SEQ ID NO: 152339 - DNA, 22 bp, Artificial Sequence
  chemically synthesized
caggagcacactgccatgccca

SEQ ID NO: 152340 - DNA, 22 bp, Artificial Sequence
  chemically synthesized
ccatgcccagctaattattttt

SEQ ID NO: 152341 - DNA, 22 bp, Artificial Sequence
  chemically synthesized
attatttttgtgttttagtaga

SEQ ID NO: 152342 - DNA, 22 bp, Artificial Sequence
  chemically synthesized
tttttgtgttttagtagagaca

SEQ ID NO: 152343 - DNA, 22 bp, Artificial Sequence
  chemically synthesized
ttgtgttttagtagagacaggg

SEQ ID NO: 152344 - DNA, 22 bp, Artificial Sequence
  chemically synthesized
tgtgttttagtagagacagggt

SEQ ID NO: 152345 - DNA, 22 bp, Artificial Sequence
  chemically synthesized
gtgttttagtagagacagggtt

SEQ ID NO: 152346 - DNA, 22 bp, Artificial Sequence
  chemically synthesized
tgttttagtagagacagggttt

SEQ ID NO: 152347 - DNA, 22 bp, Artificial Sequence
  chemically synthesized
tagtagagacagggtttcacca

SEQ ID NO: 152348 - DNA, 22 bp, Artificial Sequence
  chemically synthesized
agtagagacagggtttcaccat

SEQ ID NO: 152349 - DNA, 22 bp, Artificial Sequence
  chemically synthesized
gtagagacagggtttcaccatt

SEQ ID NO: 152350 - DNA, 22 bp, Artificial Sequence
  chemically synthesized
caccattttgcccaggttggtc

SEQ ID NO: 152351 - DNA, 22 bp, Artificial Sequence
  chemically synthesized
accattttgcccaggttggtct

SEQ ID NO: 152352 - DNA, 22 bp, Artificial Sequence
  chemically synthesized
tgcccaggttggtctccaactc

SEQ ID NO: 152353 - DNA, 22 bp, Artificial Sequence
  chemically synthesized
gcccaggttggtctccaactcc

SEQ ID NO: 152354 - DNA, 22 bp, Artificial Sequence
  chemically synthesized
cccaggttggtctccaactcct

SEQ ID NO: 152355 - DNA, 22 bp, Artificial Sequence
  chemically synthesized
gtctccaactcctgagctcagc

SEQ ID NO: 152356 - DNA, 22 bp, Artificial Sequence
  chemically synthesized
caactcctgagctcagccaatc

SEQ ID NO: 152357 - DNA, 22 bp, Artificial Sequence
  chemically synthesized
ctgagctcagccaatccacctg

SEQ ID NO: 152358 - DNA, 22 bp, Artificial Sequence
  chemically synthesized
agctcagccaatccacctgcct

SEQ ID NO: 152359 - DNA, 22 bp, Artificial Sequence
  chemically synthesized
agccaatccacctgcctcggcc

SEQ ID NO: 152360 - DNA, 22 bp, Artificial Sequence
  chemically synthesized
cctcggcctcccaaagtgctag

SEQ ID NO: 152361 - DNA, 22 bp, Artificial Sequence
  chemically synthesized
ggcctcccaaagtgctaggatt

SEQ ID NO: 152362 - DNA, 22 bp, Artificial Sequence
  chemically synthesized
ccaaagtgctaggattacaggc

SEQ ID NO: 152363 - DNA, 22 bp, Artificial Sequence
  chemically synthesized
ggattacaggcgtgagccacca

SEQ ID NO: 152364 - DNA, 22 bp, Artificial Sequence
  chemically synthesized
caggcgtgagccaccaagcctg

SEQ ID NO: 152365 - DNA, 22 bp, Artificial Sequence
  chemically synthesized
gctgaaagtagatacttttaac

SEQ ID NO: 152366 - DNA, 22 bp, Artificial Sequence
  chemically synthesized
aaagtagatacttttaacacat

SEQ ID NO: 152367 - DNA, 22 bp, Artificial Sequence
  chemically synthesized
ttaacacatacctacattcaca

SEQ ID NO: 152368 - DNA, 22 bp, Artificial Sequence
  chemically synthesized
taacacatacctacattcacag

SEQ ID NO: 152369 - DNA, 22 bp, Artificial Sequence
  chemically synthesized
aacacatacctacattcacaga

SEQ ID NO: 152370 - DNA, 22 bp, Artificial Sequence
  chemically synthesized
acacatacctacattcacagaa

SEQ ID NO: 152371 - DNA, 22 bp, Artificial Sequence
  chemically synthesized
cattcacagaatattaaatctt

SEQ ID NO: 152372 - DNA, 22 bp, Artificial Sequence
  chemically synthesized
acagaatattaaatcttttgtg

SEQ ID NO: 152373 - DNA, 22 bp, Artificial Sequence
  chemically synthesized
aatcttttgtgatcaatcccag

SEQ ID NO: 152374 - DNA, 22 bp, Artificial Sequence
  chemically synthesized
ttgtgatcaatcccagatcctt

SEQ ID NO: 152375 - DNA, 22 bp, Artificial Sequence
  chemically synthesized
tgtgatcaatcccagatccttg

SEQ ID NO: 152376 - DNA, 22 bp, Artificial Sequence
  chemically synthesized
gtgatcaatcccagatccttga

SEQ ID NO: 152377 - DNA, 22 bp, Artificial Sequence
  chemically synthesized
tgatcaatcccagatccttgac

SEQ ID NO: 152378 - DNA, 22 bp, Artificial Sequence
  chemically synthesized
gacgatatgtctgagtcaggct

SEQ ID NO: 152379 - DNA, 22 bp, Artificial Sequence
  chemically synthesized
acgatatgtctgagtcaggctg

SEQ ID NO: 152380 - DNA, 22 bp, Artificial Sequence
  chemically synthesized
agtcaggctggaaatgagagaa

SEQ ID NO: 152381 - DNA, 22 bp, Artificial Sequence
  chemically synthesized
gaaatgagagaaatcatgtttg

SEQ ID NO: 152382 - DNA, 22 bp, Artificial Sequence
  chemically synthesized
gaaattggagtgttgtattcaa

SEQ ID NO: 152383 - DNA, 22 bp, Artificial Sequence
  chemically synthesized
aaattggagtgttgtattcaag

SEQ ID NO: 152384 - DNA, 22 bp, Artificial Sequence
  chemically synthesized
gagtgttgtattcaaggtcagc

SEQ ID NO: 152385 - DNA, 22 bp, Artificial Sequence
  chemically synthesized
tattcaaggtcagcaagatccc

SEQ ID NO: 152386 - DNA, 22 bp, Artificial Sequence
  chemically synthesized
aaggtcagcaagatccctggag

SEQ ID NO: 152387 - DNA, 22 bp, Artificial Sequence
  chemically synthesized
gagcagcatctgttttataaac

SEQ ID NO: 152388 - DNA, 22 bp, Artificial Sequence
  chemically synthesized
ttttataaaccattcaaacttg

SEQ ID NO: 152389 - DNA, 22 bp, Artificial Sequence
  chemically synthesized
tataaaccattcaaacttggta

SEQ ID NO: 152390 - DNA, 22 bp, Artificial Sequence
  chemically synthesized
ataaaccattcaaacttggtat

SEQ ID NO: 152391 - DNA, 22 bp, Artificial Sequence
  chemically synthesized
taaaccattcaaacttggtata

SEQ ID NO: 152392 - DNA, 22 bp, Artificial Sequence
  chemically synthesized
aaacttggtatatgatgactca

SEQ ID NO: 152393 - DNA, 22 bp, Artificial Sequence
  chemically synthesized
ggtatatgatgactcaattggt

SEQ ID NO: 152394 - DNA, 22 bp, Artificial Sequence
  chemically synthesized
gtatatgatgactcaattggtg

SEQ ID NO: 152395 - DNA, 22 bp, Artificial Sequence
  chemically synthesized
aattggtggccaaaggtcagaa

SEQ ID NO: 152396 - DNA, 22 bp, Artificial Sequence
  chemically synthesized
gtggccaaaggtcagaaaagac

SEQ ID NO: 152397 - DNA, 22 bp, Artificial Sequence
  chemically synthesized
agtgtacacagatgattttaca

SEQ ID NO: 152398 - DNA, 22 bp, Artificial Sequence
  chemically synthesized
tacacacactttgataggagtg

SEQ ID NO: 152399 - DNA, 22 bp, Artificial Sequence
  chemically synthesized
acacacactttgataggagtgt

SEQ ID NO: 152400 - DNA, 22 bp, Artificial Sequence
  chemically synthesized
cacacactttgataggagtgtt

SEQ ID NO: 152401 - DNA, 22 bp, Artificial Sequence
  chemically synthesized
tgataggagtgttcacattcat

SEQ ID NO: 152402 - DNA, 22 bp, Artificial Sequence
  chemically synthesized
gataggagtgttcacattcata

SEQ ID NO: 152403 - DNA, 22 bp, Artificial Sequence
  chemically synthesized
ataggagtgttcacattcatat

SEQ ID NO: 152404 - DNA, 22 bp, Artificial Sequence
  chemically synthesized
acattcatattatctttatatc

SEQ ID NO: 152405 - DNA, 22 bp, Artificial Sequence
  chemically synthesized
atattatctttatatctctgtg

SEQ ID NO: 152406 - DNA, 22 bp, Artificial Sequence
  chemically synthesized
tctttatatctctgtgattgtc

SEQ ID NO: 152407 - DNA, 22 bp, Artificial Sequence
  chemically synthesized
tatatctctgtgattgtctagc

SEQ ID NO: 152408 - DNA, 22 bp, Artificial Sequence
  chemically synthesized
atatctctgtgattgtctagct

SEQ ID NO: 152409 - DNA, 22 bp, Artificial Sequence
  chemically synthesized
tatctctgtgattgtctagctc

SEQ ID NO: 152410 - DNA, 22 bp, Artificial Sequence
  chemically synthesized
tgtgattgtctagctcttattt

SEQ ID NO: 152411 - DNA, 22 bp, Artificial Sequence
  chemically synthesized
tgattgtctagctcttatttca

SEQ ID NO: 152412 - DNA, 22 bp, Artificial Sequence
  chemically synthesized
tctagctcttatttcatagaat

SEQ ID NO: 152413 - DNA, 22 bp, Artificial Sequence
  chemically synthesized
gctcttatttcatagaataatt

SEQ ID NO: 152414 - DNA, 22 bp, Artificial Sequence
  chemically synthesized
ttatttcatagaataattaatt

SEQ ID NO: 152415 - DNA, 22 bp, Artificial Sequence
  chemically synthesized
atttcatagaataattaattaa

SEQ ID NO: 152416 - DNA, 22 bp, Artificial Sequence
  chemically synthesized
tttcatagaataattaattaaa

SEQ ID NO: 152417 - DNA, 22 bp, Artificial Sequence
  chemically synthesized
catagaataattaattaaaaat

SEQ ID NO: 152418 - DNA, 22 bp, Artificial Sequence
  chemically synthesized
atagaataattaattaaaaatt

SEQ ID NO: 152419 - DNA, 22 bp, Artificial Sequence
  chemically synthesized
attaaaaattatttgataagtg

SEQ ID NO: 152420 - DNA, 22 bp, Artificial Sequence
  chemically synthesized
aaaattatttgataagtgccca

SEQ ID NO: 152421 - DNA, 22 bp, Artificial Sequence
  chemically synthesized
tttgataagtgcccattctatg

SEQ ID NO: 152422 - DNA, 22 bp, Artificial Sequence
  chemically synthesized
gataagtgcccattctatgcta

SEQ ID NO: 152423 - DNA, 22 bp, Artificial Sequence
  chemically synthesized
ataagtgcccattctatgctaa

SEQ ID NO: 152424 - DNA, 22 bp, Artificial Sequence
  chemically synthesized
tatgctaacccttatttttcat

SEQ ID NO: 152425 - DNA, 22 bp, Artificial Sequence
  chemically synthesized
tgctaacccttatttttcatat

SEQ ID NO: 152426 - DNA, 22 bp, Artificial Sequence
  chemically synthesized
acccttatttttcatattcttg

SEQ ID NO: 152427 - DNA, 22 bp, Artificial Sequence
  chemically synthesized
atttttcatattcttgagcaaa

SEQ ID NO: 152428 - DNA, 22 bp, Artificial Sequence
  chemically synthesized
tttttcatattcttgagcaaaa

SEQ ID NO: 152429 - DNA, 22 bp, Artificial Sequence
  chemically synthesized
ttcatattcttgagcaaaaaac

SEQ ID NO: 152430 - DNA, 22 bp, Artificial Sequence
  chemically synthesized
tcatattcttgagcaaaaaaca

SEQ ID NO: 152431 - DNA, 22 bp, Artificial Sequence
  chemically synthesized
catattcttgagcaaaaaacag

SEQ ID NO: 152432 - DNA, 22 bp, Artificial Sequence
  chemically synthesized
atattcttgagcaaaaaacaga

SEQ ID NO: 152433 - DNA, 22 bp, Artificial Sequence
  chemically synthesized
ttgagcaaaaaacagatatggt

SEQ ID NO: 152434 - DNA, 22 bp, Artificial Sequence
  chemically synthesized
gagcaaaaaacagatatggttc

SEQ ID NO: 152435 - DNA, 22 bp, Artificial Sequence
  chemically synthesized
agcaaaaaacagatatggttcc

SEQ ID NO: 152436 - DNA, 22 bp, Artificial Sequence
  chemically synthesized
ctaatcttctacagcctctaat

SEQ ID NO: 152437 - DNA, 22 bp, Artificial Sequence
  chemically synthesized
atcttctacagcctctaatgaa

SEQ ID NO: 152438 - DNA, 22 bp, Artificial Sequence
  chemically synthesized
ctacagcctctaatgaatctaa

SEQ ID NO: 152439 - DNA, 22 bp, Artificial Sequence
  chemically synthesized
tacagcctctaatgaatctaat

SEQ ID NO: 152440 - DNA, 22 bp, Artificial Sequence
  chemically synthesized
cagcctctaatgaatctaatgg

SEQ ID NO: 152441 - DNA, 22 bp, Artificial Sequence
  chemically synthesized
taatgaatctaatggaaattca

SEQ ID NO: 152442 - DNA, 22 bp, Artificial Sequence
  chemically synthesized
atgaatctaatggaaattcagt

SEQ ID NO: 152443 - DNA, 22 bp, Artificial Sequence
  chemically synthesized
atggaaattcagtgtataataa

SEQ ID NO: 152444 - DNA, 22 bp, Artificial Sequence
  chemically synthesized
agtgtataataagtggtataaa

SEQ ID NO: 152445 - DNA, 22 bp, Artificial Sequence
  chemically synthesized
gtatactgtgatgagagtaagt

SEQ ID NO: 152446 - DNA, 22 bp, Artificial Sequence
  chemically synthesized
tgatgagagtaagttagttaag

SEQ ID NO: 152447 - DNA, 22 bp, Artificial Sequence
  chemically synthesized
gttaagggggttgaagaaatga

SEQ ID NO: 152448 - DNA, 22 bp, Artificial Sequence
  chemically synthesized
agggggttgaagaaatgagata

SEQ ID NO: 152449 - DNA, 22 bp, Artificial Sequence
  chemically synthesized
aagaaatgagataatctaggtg

SEQ ID NO: 152450 - DNA, 22 bp, Artificial Sequence
  chemically synthesized
ggtggggagcagtattagaaaa

SEQ ID NO: 152451 - DNA, 22 bp, Artificial Sequence
  chemically synthesized
gaaaaatccccctgaggaagta

SEQ ID NO: 152452 - DNA, 22 bp, Artificial Sequence
  chemically synthesized
aggaagtaatcattttaactca

SEQ ID NO: 152453 - DNA, 22 bp, Artificial Sequence
  chemically synthesized
taactcaaaagttaatggtgaa

SEQ ID NO: 152454 - DNA, 22 bp, Artificial Sequence
  chemically synthesized
aactcaaaagttaatggtgaaa

SEQ ID NO: 152455 - DNA, 22 bp, Artificial Sequence
  chemically synthesized
actcaaaagttaatggtgaaag

SEQ ID NO: 152456 - DNA, 22 bp, Artificial Sequence
  chemically synthesized
aaaagttaatggtgaaaggaat

SEQ ID NO: 152457 - DNA, 22 bp, Artificial Sequence
  chemically synthesized
atggtgaaaggaattgctgtgc

SEQ ID NO: 152458 - DNA, 22 bp, Artificial Sequence
  chemically synthesized
ctgtgcaaatacttggggtaga

SEQ ID NO: 152459 - DNA, 22 bp, Artificial Sequence
  chemically synthesized
tgcaaatacttggggtagataa

SEQ ID NO: 152460 - DNA, 22 bp, Artificial Sequence
  chemically synthesized
ggggtagataattcggagcaca

SEQ ID NO: 152461 - DNA, 22 bp, Artificial Sequence
  chemically synthesized
gggtagataattcggagcacag

SEQ ID NO: 152462 - DNA, 22 bp, Artificial Sequence
  chemically synthesized
ggagcacagagaagaccatggg

SEQ ID NO: 152463 - DNA, 22 bp, Artificial Sequence
  chemically synthesized
agacatgcatgtacttagcttg

SEQ ID NO: 152464 - DNA, 22 bp, Artificial Sequence
  chemically synthesized
agcttgttttgaggaagataaa

SEQ ID NO: 152465 - DNA, 22 bp, Artificial Sequence
  chemically synthesized
gcttgttttgaggaagataaag

SEQ ID NO: 152466 - DNA, 22 bp, Artificial Sequence
  chemically synthesized
gttttgaggaagataaagatac

SEQ ID NO: 152467 - DNA, 22 bp, Artificial Sequence
  chemically synthesized
ttttgaggaagataaagatacc

SEQ ID NO: 152468 - DNA, 22 bp, Artificial Sequence
  chemically synthesized
tgaggaagataaagatacctaa

SEQ ID NO: 152469 - DNA, 22 bp, Artificial Sequence
  chemically synthesized
gaggaagataaagatacctaaa

SEQ ID NO: 152470 - DNA, 22 bp, Artificial Sequence
  chemically synthesized
aggaagataaagatacctaaat

SEQ ID NO: 152471 - DNA, 22 bp, Artificial Sequence
  chemically synthesized
aatattaaggagtgtaggcagt

SEQ ID NO: 152472 - DNA, 22 bp, Artificial Sequence
  chemically synthesized
aggagtgtaggcagtagtggtc

SEQ ID NO: 152473 - DNA, 22 bp, Artificial Sequence
  chemically synthesized
aagatgtaatagaagaggcagg

SEQ ID NO: 152474 - DNA, 22 bp, Artificial Sequence
  chemically synthesized
tacaaggctttttgactatgat

SEQ ID NO: 152475 - DNA, 22 bp, Artificial Sequence
  chemically synthesized
tttgactatgataaagaatttg

SEQ ID NO: 152476 - DNA, 22 bp, Artificial Sequence
  chemically synthesized
ttgactatgataaagaatttgt

SEQ ID NO: 152477 - DNA, 22 bp, Artificial Sequence
  chemically synthesized
tgactatgataaagaatttgta

SEQ ID NO: 152478 - DNA, 22 bp, Artificial Sequence
  chemically synthesized
gactatgataaagaatttgtat

SEQ ID NO: 152479 - DNA, 22 bp, Artificial Sequence
  chemically synthesized
actatgataaagaatttgtatt

SEQ ID NO: 152480 - DNA, 22 bp, Artificial Sequence
  chemically synthesized
tgataaagaatttgtattttac

SEQ ID NO: 152481 - DNA, 22 bp, Artificial Sequence
  chemically synthesized
gtattttacattacgagcaatg

SEQ ID NO: 152482 - DNA, 22 bp, Artificial Sequence
  chemically synthesized
tattttacattacgagcaatgg

SEQ ID NO: 152483 - DNA, 22 bp, Artificial Sequence
  chemically synthesized
tacattacgagcaatgggtaag

SEQ ID NO: 152484 - DNA, 22 bp, Artificial Sequence
  chemically synthesized
acattacgagcaatgggtaagt

SEQ ID NO: 152485 - DNA, 22 bp, Artificial Sequence
  chemically synthesized
cattacgagcaatgggtaagtg

SEQ ID NO: 152486 - DNA, 22 bp, Artificial Sequence
  chemically synthesized
cgagcaatgggtaagtgaccat

SEQ ID NO: 152487 - DNA, 22 bp, Artificial Sequence
  chemically synthesized
tttcaacaaaggtttgtgtgat

SEQ ID NO: 152488 - DNA, 22 bp, Artificial Sequence
  chemically synthesized
ttcaacaaaggtttgtgtgatt

SEQ ID NO: 152489 - DNA, 22 bp, Artificial Sequence
  chemically synthesized
tcaacaaaggtttgtgtgattt

SEQ ID NO: 152490 - DNA, 22 bp, Artificial Sequence
  chemically synthesized
caacaaaggtttgtgtgattta

SEQ ID NO: 152491 - DNA, 22 bp, Artificial Sequence
  chemically synthesized
aacaaaggtttgtgtgatttag

SEQ ID NO: 152492 - DNA, 22 bp, Artificial Sequence
  chemically synthesized
gtgtgatttagtagatgtttgt

SEQ ID NO: 152493 - DNA, 22 bp, Artificial Sequence
  chemically synthesized
tgtgatttagtagatgtttgta

SEQ ID NO: 152494 - DNA, 22 bp, Artificial Sequence
  chemically synthesized
agtagatgtttgtagaaaagca

SEQ ID NO: 152495 - DNA, 22 bp, Artificial Sequence
  chemically synthesized
gtagatgtttgtagaaaagcaa

SEQ ID NO: 152496 - DNA, 22 bp, Artificial Sequence
  chemically synthesized
gtagaaaagcaatttggtttcc

SEQ ID NO: 152497 - DNA, 22 bp, Artificial Sequence
  chemically synthesized
tagaaaagcaatttggtttccc

SEQ ID NO: 152498 - DNA, 22 bp, Artificial Sequence
  chemically synthesized
ggtttccctggagataatacat

SEQ ID NO: 152499 - DNA, 22 bp, Artificial Sequence
  chemically synthesized
gtttccctggagataatacatt

SEQ ID NO: 152500 - DNA, 22 bp, Artificial Sequence
  chemically synthesized
ccctggagataatacatttttt

SEQ ID NO: 152501 - DNA, 22 bp, Artificial Sequence
  chemically synthesized
cctggagataatacatttttta

SEQ ID NO: 152502 - DNA, 22 bp, Artificial Sequence
  chemically synthesized
gagataatacattttttagagg

SEQ ID NO: 152503 - DNA, 22 bp, Artificial Sequence
  chemically synthesized
tttagaggacaaacagataaat

SEQ ID NO: 152504 - DNA, 22 bp, Artificial Sequence
  chemically synthesized
ttagaggacaaacagataaatc

SEQ ID NO: 152505 - DNA, 22 bp, Artificial Sequence
  chemically synthesized
tagaggacaaacagataaatca

SEQ ID NO: 152506 - DNA, 22 bp, Artificial Sequence
  chemically synthesized
agaggacaaacagataaatcat

SEQ ID NO: 152507 - DNA, 22 bp, Artificial Sequence
  chemically synthesized
gaggacaaacagataaatcatg

SEQ ID NO: 152508 - DNA, 22 bp, Artificial Sequence
  chemically synthesized
gctagtaataatattaaattat

SEQ ID NO: 152509 - DNA, 22 bp, Artificial Sequence
  chemically synthesized
gtaataatattaaattattatt

SEQ ID NO: 152510 - DNA, 22 bp, Artificial Sequence
  chemically synthesized
aattattattaatttaataaat

SEQ ID NO: 152511 - DNA, 22 bp, Artificial Sequence
  chemically synthesized
ttattaatttaataaattatca

SEQ ID NO: 152512 - DNA, 22 bp, Artificial Sequence
  chemically synthesized
ttaatttaataaattatcatag

SEQ ID NO: 152513 - DNA, 22 bp, Artificial Sequence
  chemically synthesized
atttaataaattatcatagtag

SEQ ID NO: 152514 - DNA, 22 bp, Artificial Sequence
  chemically synthesized
aataaattatcatagtagccag

SEQ ID NO: 152515 - DNA, 22 bp, Artificial Sequence
  chemically synthesized
ataaattatcatagtagccagg

SEQ ID NO: 152516 - DNA, 22 bp, Artificial Sequence
  chemically synthesized
tcatagtagccagggaaacaat

SEQ ID NO: 152517 - DNA, 22 bp, Artificial Sequence
  chemically synthesized
taaaccaagacgggcaatgtgt

SEQ ID NO: 152518 - DNA, 22 bp, Artificial Sequence
  chemically synthesized
tctgggatgtgtttctggtaga

SEQ ID NO: 152519 - DNA, 22 bp, Artificial Sequence
  chemically synthesized
ggatgtgtttctggtagaaatg

SEQ ID NO: 152520 - DNA, 22 bp, Artificial Sequence
  chemically synthesized
ctggtagaaatggtagaaattg

SEQ ID NO: 152521 - DNA, 22 bp, Artificial Sequence
  chemically synthesized
tggtagaaatggtagaaattga

SEQ ID NO: 152522 - DNA, 22 bp, Artificial Sequence
  chemically synthesized
gtagaaatggtagaaattgatg

SEQ ID NO: 152523 - DNA, 22 bp, Artificial Sequence
  chemically synthesized
atgaaagatttgatggagagag

SEQ ID NO: 152524 - DNA, 22 bp, Artificial Sequence
  chemically synthesized
gatggagagaggaaagggaagg

SEQ ID NO: 152525 - DNA, 22 bp, Artificial Sequence
  chemically synthesized
atggagagaggaaagggaagga

SEQ ID NO: 152526 - DNA, 22 bp, Artificial Sequence
  chemically synthesized
taaaaatgactcaagacttgtc

SEQ ID NO: 152527 - DNA, 22 bp, Artificial Sequence
  chemically synthesized
aaaaatgactcaagacttgtct

SEQ ID NO: 152528 - DNA, 22 bp, Artificial Sequence
  chemically synthesized
aaaatgactcaagacttgtctt

SEQ ID NO: 152529 - DNA, 22 bp, Artificial Sequence
  chemically synthesized
aagacttgtcttatgcaattgt

SEQ ID NO: 152530 - DNA, 22 bp, Artificial Sequence
  chemically synthesized
gtcttatgcaattgtgttattg

SEQ ID NO: 152531 - DNA, 22 bp, Artificial Sequence
  chemically synthesized
tcttatgcaattgtgttattgg

SEQ ID NO: 152532 - DNA, 22 bp, Artificial Sequence
  chemically synthesized
atgcaattgtgttattggtgga

SEQ ID NO: 152533 - DNA, 22 bp, Artificial Sequence
  chemically synthesized
tgcaattgtgttattggtggag

SEQ ID NO: 152534 - DNA, 22 bp, Artificial Sequence
  chemically synthesized
tgttattggtggagtcacttta

SEQ ID NO: 152535 - DNA, 22 bp, Artificial Sequence
  chemically synthesized
ttggtggagtcactttataata

SEQ ID NO: 152536 - DNA, 22 bp, Artificial Sequence
  chemically synthesized
gtggagtcactttataatatta

SEQ ID NO: 152537 - DNA, 22 bp, Artificial Sequence
  chemically synthesized
tataatattaggagaaaaggga

SEQ ID NO: 152538 - DNA, 22 bp, Artificial Sequence
  chemically synthesized
ataatattaggagaaaagggac

SEQ ID NO: 152539 - DNA, 22 bp, Artificial Sequence
  chemically synthesized
taatattaggagaaaagggaca

SEQ ID NO: 152540 - DNA, 22 bp, Artificial Sequence
  chemically synthesized
ggagaaaagggacagaaaatag

SEQ ID NO: 152541 - DNA, 22 bp, Artificial Sequence
  chemically synthesized
tggggggaaaatcaagtacttt

SEQ ID NO: 152542 - DNA, 22 bp, Artificial Sequence
  chemically synthesized
ggggggaaaatcaagtacttta

SEQ ID NO: 152543 - DNA, 22 bp, Artificial Sequence
  chemically synthesized
gggggaaaatcaagtactttat

SEQ ID NO: 152544 - DNA, 22 bp, Artificial Sequence
  chemically synthesized
tattggcatcattcttatttta

SEQ ID NO: 152545 - DNA, 22 bp, Artificial Sequence
  chemically synthesized
attggcatcattcttattttaa

SEQ ID NO: 152546 - DNA, 22 bp, Artificial Sequence
  chemically synthesized
ttggcatcattcttattttaag

SEQ ID NO: 152547 - DNA, 22 bp, Artificial Sequence
  chemically synthesized
gcatcattcttattttaagatt

SEQ ID NO: 152548 - DNA, 22 bp, Artificial Sequence
  chemically synthesized
ttattttaagattaaacactca

SEQ ID NO: 152549 - DNA, 22 bp, Artificial Sequence
  chemically synthesized
attttaagattaaacactcaga

SEQ ID NO: 152550 - DNA, 22 bp, Artificial Sequence
  chemically synthesized
ttttaagattaaacactcagat

SEQ ID NO: 152551 - DNA, 22 bp, Artificial Sequence
  chemically synthesized
taagattaaacactcagatgaa

SEQ ID NO: 152552 - DNA, 22 bp, Artificial Sequence
  chemically synthesized
aagattaaacactcagatgaat

SEQ ID NO: 152553 - DNA, 22 bp, Artificial Sequence
  chemically synthesized
agattaaacactcagatgaata

SEQ ID NO: 152554 - DNA, 22 bp, Artificial Sequence
  chemically synthesized
aacactcagatgaatatattaa

SEQ ID NO: 152555 - DNA, 22 bp, Artificial Sequence
  chemically synthesized
agatgaatatattaaatagcca

SEQ ID NO: 152556 - DNA, 22 bp, Artificial Sequence
  chemically synthesized
aatagccagttgtattcatgaa

SEQ ID NO: 152557 - DNA, 22 bp, Artificial Sequence
  chemically synthesized
tattcatgaatttgagctctca

SEQ ID NO: 152558 - DNA, 22 bp, Artificial Sequence
  chemically synthesized
atgaatttgagctctcaggagt

SEQ ID NO: 152559 - DNA, 22 bp, Artificial Sequence
  chemically synthesized
gagctctcaggagtggtcagga

SEQ ID NO: 152560 - DNA, 22 bp, Artificial Sequence
  chemically synthesized
agctctcaggagtggtcaggaa

SEQ ID NO: 152561 - DNA, 22 bp, Artificial Sequence
  chemically synthesized
tcaggagtggtcaggaatcaga

SEQ ID NO: 152562 - DNA, 22 bp, Artificial Sequence
  chemically synthesized
aggagtggtcaggaatcagagg

SEQ ID NO: 152563 - DNA, 22 bp, Artificial Sequence
  chemically synthesized
gtttcaaataataagaaaaagt

SEQ ID NO: 152564 - DNA, 22 bp, Artificial Sequence
  chemically synthesized
caaataataagaaaaagttgac

SEQ ID NO: 152565 - DNA, 22 bp, Artificial Sequence
  chemically synthesized
aaataataagaaaaagttgaca

SEQ ID NO: 152566 - DNA, 22 bp, Artificial Sequence
  chemically synthesized
acatagtctgcacattaaggaa

SEQ ID NO: 152567 - DNA, 22 bp, Artificial Sequence
  chemically synthesized
cacattaaggaactgagaattt

SEQ ID NO: 152568 - DNA, 22 bp, Artificial Sequence
  chemically synthesized
aggaactgagaatttagtttgt

SEQ ID NO: 152569 - DNA, 22 bp, Artificial Sequence
  chemically synthesized
agaatttagtttgtaacagaga

SEQ ID NO: 152570 - DNA, 22 bp, Artificial Sequence
  chemically synthesized
agtttgtaacagagatattagt

SEQ ID NO: 152571 - DNA, 22 bp, Artificial Sequence
  chemically synthesized
gtttgtaacagagatattagtt

SEQ ID NO: 152572 - DNA, 22 bp, Artificial Sequence
  chemically synthesized
gtaacagagatattagttaaat

SEQ ID NO: 152573 - DNA, 22 bp, Artificial Sequence
  chemically synthesized
taacagagatattagttaaata

SEQ ID NO: 152574 - DNA, 22 bp, Artificial Sequence
  chemically synthesized
gttaaatatttagtttaaatat

SEQ ID NO: 152575 - DNA, 22 bp, Artificial Sequence
  chemically synthesized
aatatttagtttaaatattagt

SEQ ID NO: 152576 - DNA, 22 bp, Artificial Sequence
  chemically synthesized
agtttaaatattagttaaatat

SEQ ID NO: 152577 - DNA, 22 bp, Artificial Sequence
  chemically synthesized
gtttaaatattagttaaatatt

SEQ ID NO: 152578 - DNA, 22 bp, Artificial Sequence
  chemically synthesized
aaatattagttaaatatttagc

SEQ ID NO: 152579 - DNA, 22 bp, Artificial Sequence
  chemically synthesized
aatattagttaaatatttagct

SEQ ID NO: 152580 - DNA, 22 bp, Artificial Sequence
  chemically synthesized
gttaaatatttagctaataaat

SEQ ID NO: 152581 - DNA, 22 bp, Artificial Sequence
  chemically synthesized
aatatttagctaataaatacaa

SEQ ID NO: 152582 - DNA, 22 bp, Artificial Sequence
  chemically synthesized
agctaataaatacaaaattata

SEQ ID NO: 152583 - DNA, 22 bp, Artificial Sequence
  chemically synthesized
gctaataaatacaaaattataa

SEQ ID NO: 152584 - DNA, 22 bp, Artificial Sequence
  chemically synthesized
ataaatacaaaattataagttt

SEQ ID NO: 152585 - DNA, 22 bp, Artificial Sequence
  chemically synthesized
taagttttatttaaaattgaaa

SEQ ID NO: 152586 - DNA, 22 bp, Artificial Sequence
  chemically synthesized
tatttaaaattgaaacatgata

SEQ ID NO: 152587 - DNA, 22 bp, Artificial Sequence
  chemically synthesized
atttaaaattgaaacatgatac

SEQ ID NO: 152588 - DNA, 22 bp, Artificial Sequence
  chemically synthesized
tttaaaattgaaacatgatacc

SEQ ID NO: 152589 - DNA, 22 bp, Artificial Sequence
  chemically synthesized
aaaattgaaacatgataccaaa

SEQ ID NO: 152590 - DNA, 22 bp, Artificial Sequence
  chemically synthesized
aaattgaaacatgataccaaaa

SEQ ID NO: 152591 - DNA, 22 bp, Artificial Sequence
  chemically synthesized
aaacatgataccaaaataatag

SEQ ID NO: 152592 - DNA, 22 bp, Artificial Sequence
  chemically synthesized
gtcttaagaaacttcttgaaaa

SEQ ID NO: 152593 - DNA, 22 bp, Artificial Sequence
  chemically synthesized
tcttaagaaacttcttgaaaag

SEQ ID NO: 152594 - DNA, 22 bp, Artificial Sequence
  chemically synthesized
aagaaacttcttgaaaagtgat

SEQ ID NO: 152595 - DNA, 22 bp, Artificial Sequence
  chemically synthesized
agaaacttcttgaaaagtgatt

SEQ ID NO: 152596 - DNA, 22 bp, Artificial Sequence
  chemically synthesized
cttgaaaagtgattgttgagtt

SEQ ID NO: 152597 - DNA, 22 bp, Artificial Sequence
  chemically synthesized
ttgaaaagtgattgttgagttg

SEQ ID NO: 152598 - DNA, 22 bp, Artificial Sequence
  chemically synthesized
gaaaagtgattgttgagttgca

SEQ ID NO: 152599 - DNA, 22 bp, Artificial Sequence
  chemically synthesized
aaaagtgattgttgagttgcaa

SEQ ID NO: 152600 - DNA, 22 bp, Artificial Sequence
  chemically synthesized
ttgagttgcaagatcgttttaa

SEQ ID NO: 152601 - DNA, 22 bp, Artificial Sequence
  chemically synthesized
agttgcaagatcgttttaaaaa

SEQ ID NO: 152602 - DNA, 22 bp, Artificial Sequence
  chemically synthesized
caagatcgttttaaaaagggta

SEQ ID NO: 152603 - DNA, 22 bp, Artificial Sequence
  chemically synthesized
taaaaagggtaggaagaaattg

SEQ ID NO: 152604 - DNA, 22 bp, Artificial Sequence
  chemically synthesized
aaaaagggtaggaagaaattga

SEQ ID NO: 152605 - DNA, 22 bp, Artificial Sequence
  chemically synthesized
aaaagggtaggaagaaattgag

SEQ ID NO: 152606 - DNA, 22 bp, Artificial Sequence
  chemically synthesized
aggaaaagatgatgaataattt

SEQ ID NO: 152607 - DNA, 22 bp, Artificial Sequence
  chemically synthesized
aggcagatagaacatttcgaga

SEQ ID NO: 152608 - DNA, 22 bp, Artificial Sequence
  chemically synthesized
ggcagatagaacatttcgagaa

SEQ ID NO: 152609 - DNA, 22 bp, Artificial Sequence
  chemically synthesized
cgagaaaaattttacgaaagaa

SEQ ID NO: 152610 - DNA, 22 bp, Artificial Sequence
  chemically synthesized
gagaaaaattttacgaaagaag

SEQ ID NO: 152611 - DNA, 22 bp, Artificial Sequence
  chemically synthesized
tacgaaagaagagaaattcgat

SEQ ID NO: 152612 - DNA, 22 bp, Artificial Sequence
  chemically synthesized
acgaaagaagagaaattcgatt

SEQ ID NO: 152613 - DNA, 22 bp, Artificial Sequence
  chemically synthesized
cgaaagaagagaaattcgattt

SEQ ID NO: 152614 - DNA, 22 bp, Artificial Sequence
  chemically synthesized
gatttagagaaatgaaagaaga

SEQ ID NO: 152615 - DNA, 22 bp, Artificial Sequence
  chemically synthesized
agagaaatgaaagaagatacgt

SEQ ID NO: 152616 - DNA, 22 bp, Artificial Sequence
  chemically synthesized
gagaaatgaaagaagatacgta

SEQ ID NO: 152617 - DNA, 22 bp, Artificial Sequence
  chemically synthesized
aaaagactgaaaaatcctctgc

SEQ ID NO: 152618 - DNA, 22 bp, Artificial Sequence
  chemically synthesized
aaaaatcctctgcaagaaacga

SEQ ID NO: 152619 - DNA, 22 bp, Artificial Sequence
  chemically synthesized
tgcaagaaacgaagaaacttca

SEQ ID NO: 152620 - DNA, 22 bp, Artificial Sequence
  chemically synthesized
caagaaacgaagaaacttcaag

SEQ ID NO: 152621 - DNA, 22 bp, Artificial Sequence
  chemically synthesized
caagcattctatggagaaaaaa

SEQ ID NO: 152622 - DNA, 22 bp, Artificial Sequence
  chemically synthesized
aagcattctatggagaaaaaag

SEQ ID NO: 152623 - DNA, 22 bp, Artificial Sequence
  chemically synthesized
tatggagaaaaaagtattaaaa

SEQ ID NO: 152624 - DNA, 22 bp, Artificial Sequence
  chemically synthesized
tggagaaaaaagtattaaaaat

SEQ ID NO: 152625 - DNA, 22 bp, Artificial Sequence
  chemically synthesized
aaaatagtgagctaagttattc

SEQ ID NO: 152626 - DNA, 22 bp, Artificial Sequence
  chemically synthesized
agttattcaatgctgagaagga

SEQ ID NO: 152627 - DNA, 22 bp, Artificial Sequence
  chemically synthesized
ttcaatgctgagaaggagtcag

SEQ ID NO: 152628 - DNA, 22 bp, Artificial Sequence
  chemically synthesized
aatgctgagaaggagtcagggc

SEQ ID NO: 152629 - DNA, 22 bp, Artificial Sequence
  chemically synthesized
agaaggagtcagggcaagaaaa

SEQ ID NO: 152630 - DNA, 22 bp, Artificial Sequence
  chemically synthesized
gactgctagaagacgtcagtgt

SEQ ID NO: 152631 - DNA, 22 bp, Artificial Sequence
  chemically synthesized
ctagaagacgtcagtgtagtat

SEQ ID NO: 152632 - DNA, 22 bp, Artificial Sequence
  chemically synthesized
gaagacgtcagtgtagtataga

SEQ ID NO: 152633 - DNA, 22 bp, Artificial Sequence
  chemically synthesized
agaagaaagtctgtggaactgt

SEQ ID NO: 152634 - DNA, 22 bp, Artificial Sequence
  chemically synthesized
tggaactgtgttgtgaggctaa

SEQ ID NO: 152635 - DNA, 22 bp, Artificial Sequence
  chemically synthesized
tgttgtgaggctaataagacaa

SEQ ID NO: 152636 - DNA, 22 bp, Artificial Sequence
  chemically synthesized
tgaggctaataagacaaagctg

SEQ ID NO: 152637 - DNA, 22 bp, Artificial Sequence
  chemically synthesized
ataagacaaagctgaaaagtag

SEQ ID NO: 152638 - DNA, 22 bp, Artificial Sequence
  chemically synthesized
aaaagtaggacataaagggcag

SEQ ID NO: 152639 - DNA, 22 bp, Artificial Sequence
  chemically synthesized
aagttactttaacatctcgaag

SEQ ID NO: 152640 - DNA, 22 bp, Artificial Sequence
  chemically synthesized
ctttaacatctcgaagttactc

SEQ ID NO: 152641 - DNA, 22 bp, Artificial Sequence
  chemically synthesized
taacatctcgaagttactcaat

SEQ ID NO: 152642 - DNA, 22 bp, Artificial Sequence
  chemically synthesized
aacatctcgaagttactcaatc

SEQ ID NO: 152643 - DNA, 22 bp, Artificial Sequence
  chemically synthesized
acatctcgaagttactcaatca

SEQ ID NO: 152644 - DNA, 22 bp, Artificial Sequence
  chemically synthesized
gaagttactcaatcaaacatga

SEQ ID NO: 152645 - DNA, 22 bp, Artificial Sequence
  chemically synthesized
ctcaatcaaacatgaaagtatg

SEQ ID NO: 152646 - DNA, 22 bp, Artificial Sequence
  chemically synthesized
aatcaaacatgaaagtatggac

SEQ ID NO: 152647 - DNA, 22 bp, Artificial Sequence
  chemically synthesized
ttgaacatctgtttacattatt

SEQ ID NO: 152648 - DNA, 22 bp, Artificial Sequence
  chemically synthesized
tgaacatctgtttacattatta

SEQ ID NO: 152649 - DNA, 22 bp, Artificial Sequence
  chemically synthesized
gaacatctgtttacattattag

SEQ ID NO: 152650 - DNA, 22 bp, Artificial Sequence
  chemically synthesized
aacatctgtttacattattaga

SEQ ID NO: 152651 - DNA, 22 bp, Artificial Sequence
  chemically synthesized
tttacattattagagctttaaa

SEQ ID NO: 152652 - DNA, 22 bp, Artificial Sequence
  chemically synthesized
acattattagagctttaaaaaa

SEQ ID NO: 152653 - DNA, 22 bp, Artificial Sequence
  chemically synthesized
cattattagagctttaaaaaaa

SEQ ID NO: 152654 - DNA, 22 bp, Artificial Sequence
  chemically synthesized
ttagagctttaaaaaaacttat

SEQ ID NO: 152655 - DNA, 22 bp, Artificial Sequence
  chemically synthesized
gagctttaaaaaaacttatgat

SEQ ID NO: 152656 - DNA, 22 bp, Artificial Sequence
  chemically synthesized
taaaaaaacttatgatgattct

SEQ ID NO: 152657 - DNA, 22 bp, Artificial Sequence
  chemically synthesized
aaaaaaacttatgatgattctc

SEQ ID NO: 152658 - DNA, 22 bp, Artificial Sequence
  chemically synthesized
aaaaaacttatgatgattctca

SEQ ID NO: 152659 - DNA, 22 bp, Artificial Sequence
  chemically synthesized
atgatgattctcaggtctggaa

SEQ ID NO: 152660 - DNA, 22 bp, Artificial Sequence
  chemically synthesized
tgatgattctcaggtctggaac

SEQ ID NO: 152661 - DNA, 22 bp, Artificial Sequence
  chemically synthesized
tcaggtctggaacttaaagcag

SEQ ID NO: 152662 - DNA, 22 bp, Artificial Sequence
  chemically synthesized
aggtctggaacttaaagcaggc

SEQ ID NO: 152663 - DNA, 22 bp, Artificial Sequence
  chemically synthesized
gaacttaaagcaggcaaacaat

SEQ ID NO: 152664 - DNA, 22 bp, Artificial Sequence
  chemically synthesized
aaagcaggcaaacaatgtaaag

SEQ ID NO: 152665 - DNA, 22 bp, Artificial Sequence
  chemically synthesized
aagcaggcaaacaatgtaaaga

SEQ ID NO: 152666 - DNA, 22 bp, Artificial Sequence
  chemically synthesized
attctgctaccatgaggctttt

SEQ ID NO: 152667 - DNA, 22 bp, Artificial Sequence
  chemically synthesized
tgctaccatgaggcttttgaaa

SEQ ID NO: 152668 - DNA, 22 bp, Artificial Sequence
  chemically synthesized
ctaccatgaggcttttgaaatt

SEQ ID NO: 152669 - DNA, 22 bp, Artificial Sequence
  chemically synthesized
ccatgaggcttttgaaattata

SEQ ID NO: 152670 - DNA, 22 bp, Artificial Sequence
  chemically synthesized
ttgaaattataagcttgcttgt

SEQ ID NO: 152671 - DNA, 22 bp, Artificial Sequence
  chemically synthesized
tgaaattataagcttgcttgtt

SEQ ID NO: 152672 - DNA, 22 bp, Artificial Sequence
  chemically synthesized
gaaattataagcttgcttgttt

SEQ ID NO: 152673 - DNA, 22 bp, Artificial Sequence
  chemically synthesized
aaattataagcttgcttgtttg

SEQ ID NO: 152674 - DNA, 22 bp, Artificial Sequence
  chemically synthesized
taagcttgcttgtttgagcctg

SEQ ID NO: 152675 - DNA, 22 bp, Artificial Sequence
  chemically synthesized
gcttgtttgagcctggctttgt

SEQ ID NO: 152676 - DNA, 22 bp, Artificial Sequence
  chemically synthesized
cttgtttgagcctggctttgtg

SEQ ID NO: 152677 - DNA, 22 bp, Artificial Sequence
  chemically synthesized
gtttgagcctggctttgtgatc

SEQ ID NO: 152678 - DNA, 22 bp, Artificial Sequence
  chemically synthesized
tttgagcctggctttgtgatct

SEQ ID NO: 152679 - DNA, 22 bp, Artificial Sequence
  chemically synthesized
gagcctggctttgtgatctgta

SEQ ID NO: 152680 - DNA, 22 bp, Artificial Sequence
  chemically synthesized
agcctggctttgtgatctgtag

SEQ ID NO: 152681 - DNA, 22 bp, Artificial Sequence
  chemically synthesized
gctttgtgatctgtagaactgc

SEQ ID NO: 152682 - DNA, 22 bp, Artificial Sequence
  chemically synthesized
tgtgatctgtagaactgcaggt

SEQ ID NO: 152683 - DNA, 22 bp, Artificial Sequence
  chemically synthesized
gtgatctgtagaactgcaggtt

SEQ ID NO: 152684 - DNA, 22 bp, Artificial Sequence
  chemically synthesized
tgatctgtagaactgcaggttc

SEQ ID NO: 152685 - DNA, 22 bp, Artificial Sequence
  chemically synthesized
tagaactgcaggttctaagaaa

SEQ ID NO: 152686 - DNA, 22 bp, Artificial Sequence
  chemically synthesized
caggttctaagaaagaaaacac

SEQ ID NO: 152687 - DNA, 22 bp, Artificial Sequence
  chemically synthesized
taagaaagaaaacacaattggc

SEQ ID NO: 152688 - DNA, 22 bp, Artificial Sequence
  chemically synthesized
agaaagaaaacacaattggcca

SEQ ID NO: 152689 - DNA, 22 bp, Artificial Sequence
  chemically synthesized
gccaatacattgaataaatgta

SEQ ID NO: 152690 - DNA, 22 bp, Artificial Sequence
  chemically synthesized
aataaatgtatattgaataaat

SEQ ID NO: 152691 - DNA, 22 bp, Artificial Sequence
  chemically synthesized
aataaatagttaatcagctcat

SEQ ID NO: 152692 - DNA, 22 bp, Artificial Sequence
  chemically synthesized
atcagctcattaactgaataaa

SEQ ID NO: 152693 - DNA, 22 bp, Artificial Sequence
  chemically synthesized
attaactgaataaataaaggaa

SEQ ID NO: 152694 - DNA, 22 bp, Artificial Sequence
  chemically synthesized
actgaataaataaaggaatggg

SEQ ID NO: 152695 - DNA, 22 bp, Artificial Sequence
  chemically synthesized
aataaataaaggaatgggaagc

SEQ ID NO: 152696 - DNA, 22 bp, Artificial Sequence
  chemically synthesized
agctgctatcaaaggctcagtg

SEQ ID NO: 152697 - DNA, 22 bp, Artificial Sequence
  chemically synthesized
ctatcaaaggctcagtgtcttc

SEQ ID NO: 152698 - DNA, 22 bp, Artificial Sequence
  chemically synthesized
tcaaaggctcagtgtcttcaat

SEQ ID NO: 152699 - DNA, 22 bp, Artificial Sequence
  chemically synthesized
agtgtcttcaatctaattctct

SEQ ID NO: 152700 - DNA, 22 bp, Artificial Sequence
  chemically synthesized
caatctaattctctacatcaca

SEQ ID NO: 152701 - DNA, 22 bp, Artificial Sequence
  chemically synthesized
aatctaattctctacatcacaa

SEQ ID NO: 152702 - DNA, 22 bp, Artificial Sequence
  chemically synthesized
attctctacatcacaaaggcac

SEQ ID NO: 152703 - DNA, 22 bp, Artificial Sequence
  chemically synthesized
tctacatcacaaaggcacaaat

SEQ ID NO: 152704 - DNA, 22 bp, Artificial Sequence
  chemically synthesized
tacatcacaaaggcacaaatga

SEQ ID NO: 152705 - DNA, 22 bp, Artificial Sequence
  chemically synthesized
catcacaaaggcacaaatgagt

SEQ ID NO: 152706 - DNA, 22 bp, Artificial Sequence
  chemically synthesized
aacatctcaagaggccagagct

SEQ ID NO: 152707 - DNA, 22 bp, Artificial Sequence
  chemically synthesized
aagaggccagagctccagtgag

SEQ ID NO: 152708 - DNA, 22 bp, Artificial Sequence
  chemically synthesized
cagtgagaaatcatttacccaa

SEQ ID NO: 152709 - DNA, 22 bp, Artificial Sequence
  chemically synthesized
acccaaggtctcatgcataaat

SEQ ID NO: 152710 - DNA, 22 bp, Artificial Sequence
  chemically synthesized
cccaaggtctcatgcataaata

SEQ ID NO: 152711 - DNA, 22 bp, Artificial Sequence
  chemically synthesized
atgcataaatattcctgtctgc

SEQ ID NO: 152712 - DNA, 22 bp, Artificial Sequence
  chemically synthesized
ctgtctgcttatcaccaatgaa

SEQ ID NO: 152713 - DNA, 22 bp, Artificial Sequence
  chemically synthesized
tctgcttatcaccaatgaagaa

SEQ ID NO: 152714 - DNA, 22 bp, Artificial Sequence
  chemically synthesized
cttatcaccaatgaagaaaaag

SEQ ID NO: 152715 - DNA, 22 bp, Artificial Sequence
  chemically synthesized
atcaccaatgaagaaaaagtaa

SEQ ID NO: 152716 - DNA, 22 bp, Artificial Sequence
  chemically synthesized
tcaccaatgaagaaaaagtaat

SEQ ID NO: 152717 - DNA, 22 bp, Artificial Sequence
  chemically synthesized
ctggctacgtcatctggagggg

SEQ ID NO: 152718 - DNA, 22 bp, Artificial Sequence
  chemically synthesized
gctacgtcatctggagggggag

SEQ ID NO: 152719 - DNA, 22 bp, Artificial Sequence
  chemically synthesized
cgtcatctggagggggagaaaa

SEQ ID NO: 152720 - DNA, 22 bp, Artificial Sequence
  chemically synthesized
gagggggagaaaacaggagtat

SEQ ID NO: 152721 - DNA, 22 bp, Artificial Sequence
  chemically synthesized
cattaaatagtatttggagaaa

SEQ ID NO: 152722 - DNA, 22 bp, Artificial Sequence
  chemically synthesized
attaaatagtatttggagaaaa

SEQ ID NO: 152723 - DNA, 22 bp, Artificial Sequence
  chemically synthesized
aatagtatttggagaaaaaata

SEQ ID NO: 152724 - DNA, 22 bp, Artificial Sequence
  chemically synthesized
ggagaaaaaatatacttggaga

SEQ ID NO: 152725 - DNA, 22 bp, Artificial Sequence
  chemically synthesized
gagaaaaaatatacttggagac

SEQ ID NO: 152726 - DNA, 22 bp, Artificial Sequence
  chemically synthesized
ggagacggcacaaaatggaaaa

SEQ ID NO: 152727 - DNA, 22 bp, Artificial Sequence
  chemically synthesized
gagacggcacaaaatggaaaat

SEQ ID NO: 152728 - DNA, 22 bp, Artificial Sequence
  chemically synthesized
tttaatagacttatgatattta

SEQ ID NO: 152729 - DNA, 22 bp, Artificial Sequence
  chemically synthesized
aatagacttatgatatttaaag

SEQ ID NO: 152730 - DNA, 22 bp, Artificial Sequence
  chemically synthesized
atagacttatgatatttaaagc

SEQ ID NO: 152731 - DNA, 22 bp, Artificial Sequence
  chemically synthesized
atgatatttaaagcccaaagat

SEQ ID NO: 152732 - DNA, 22 bp, Artificial Sequence
  chemically synthesized
tgatatttaaagcccaaagatt

SEQ ID NO: 152733 - DNA, 22 bp, Artificial Sequence
  chemically synthesized
aaagcccaaagattactcttca

SEQ ID NO: 152734 - DNA, 22 bp, Artificial Sequence
  chemically synthesized
aagcccaaagattactcttcac

SEQ ID NO: 152735 - DNA, 22 bp, Artificial Sequence
  chemically synthesized
ctcttcacttcgaatgtttaat

SEQ ID NO: 152736 - DNA, 22 bp, Artificial Sequence
  chemically synthesized
ttcacttcgaatgtttaatgaa

SEQ ID NO: 152737 - DNA, 22 bp, Artificial Sequence
  chemically synthesized
cacttcgaatgtttaatgaatt

SEQ ID NO: 152738 - DNA, 22 bp, Artificial Sequence
  chemically synthesized
acttcgaatgtttaatgaattg

SEQ ID NO: 152739 - DNA, 22 bp, Artificial Sequence
  chemically synthesized
cgaatgtttaatgaattggaga

SEQ ID NO: 152740 - DNA, 22 bp, Artificial Sequence
  chemically synthesized
gaatgtttaatgaattggagag

SEQ ID NO: 152741 - DNA, 22 bp, Artificial Sequence
  chemically synthesized
aatgaattggagagaagaaaat

SEQ ID NO: 152742 - DNA, 22 bp, Artificial Sequence
  chemically synthesized
atgaattggagagaagaaaata

SEQ ID NO: 152743 - DNA, 22 bp, Artificial Sequence
  chemically synthesized
gagagaagaaaataatttttca

SEQ ID NO: 152744 - DNA, 22 bp, Artificial Sequence
  chemically synthesized
ttcaagaacctcggctctttac

SEQ ID NO: 152745 - DNA, 22 bp, Artificial Sequence
  chemically synthesized
tcaagaacctcggctctttact

SEQ ID NO: 152746 - DNA, 22 bp, Artificial Sequence
  chemically synthesized
caagaacctcggctctttactg

SEQ ID NO: 152747 - DNA, 22 bp, Artificial Sequence
  chemically synthesized
aagaacctcggctctttactgg

SEQ ID NO: 152748 - DNA, 22 bp, Artificial Sequence
  chemically synthesized
ggctctttactggtataaaatt

SEQ ID NO: 152749 - DNA, 22 bp, Artificial Sequence
  chemically synthesized
tttactggtataaaatttttac

SEQ ID NO: 152750 - DNA, 22 bp, Artificial Sequence
  chemically synthesized
tactggtataaaatttttacca

SEQ ID NO: 152751 - DNA, 22 bp, Artificial Sequence
  chemically synthesized
actggtataaaatttttaccac

SEQ ID NO: 152752 - DNA, 22 bp, Artificial Sequence
  chemically synthesized
ctggtataaaatttttaccact

SEQ ID NO: 152753 - DNA, 22 bp, Artificial Sequence
  chemically synthesized
gtataaaatttttaccactatc

SEQ ID NO: 152754 - DNA, 22 bp, Artificial Sequence
  chemically synthesized
ttaccactatccttgggaaaat

SEQ ID NO: 152755 - DNA, 22 bp, Artificial Sequence
  chemically synthesized
taccactatccttgggaaaatg

SEQ ID NO: 152756 - DNA, 22 bp, Artificial Sequence
  chemically synthesized
accactatccttgggaaaatgt

SEQ ID NO: 152757 - DNA, 22 bp, Artificial Sequence
  chemically synthesized
ccactatccttgggaaaatgtc

SEQ ID NO: 152758 - DNA, 22 bp, Artificial Sequence
  chemically synthesized
tccttgggaaaatgtctaagca

SEQ ID NO: 152759 - DNA, 22 bp, Artificial Sequence
  chemically synthesized
gggaaaatgtctaagcaacgta

SEQ ID NO: 152760 - DNA, 22 bp, Artificial Sequence
  chemically synthesized
ggaaaatgtctaagcaacgtat

SEQ ID NO: 152761 - DNA, 22 bp, Artificial Sequence
  chemically synthesized
agcaacgtatttttttaaaact

SEQ ID NO: 152762 - DNA, 22 bp, Artificial Sequence
  chemically synthesized
ttttaaaactagccttctcctt

SEQ ID NO: 152763 - DNA, 22 bp, Artificial Sequence
  chemically synthesized
tttaaaactagccttctccttt

SEQ ID NO: 152764 - DNA, 22 bp, Artificial Sequence
  chemically synthesized
ttaaaactagccttctcctttt

SEQ ID NO: 152765 - DNA, 22 bp, Artificial Sequence
  chemically synthesized
taaaactagccttctcctttta

SEQ ID NO: 152766 - DNA, 22 bp, Artificial Sequence
  chemically synthesized
aaaactagccttctccttttac

SEQ ID NO: 152767 - DNA, 22 bp, Artificial Sequence
  chemically synthesized
aaactagccttctccttttact

SEQ ID NO: 152768 - DNA, 22 bp, Artificial Sequence
  chemically synthesized
gccttctccttttactaatctc

SEQ ID NO: 152769 - DNA, 22 bp, Artificial Sequence
  chemically synthesized
ctccttttactaatctcttcct

SEQ ID NO: 152770 - DNA, 22 bp, Artificial Sequence
  chemically synthesized
tccttttactaatctcttcctt

SEQ ID NO: 152771 - DNA, 22 bp, Artificial Sequence
  chemically synthesized
cttttactaatctcttccttat

SEQ ID NO: 152772 - DNA, 22 bp, Artificial Sequence
  chemically synthesized
ttactaatctcttccttatttg

SEQ ID NO: 152773 - DNA, 22 bp, Artificial Sequence
  chemically synthesized
tactaatctcttccttatttgt

SEQ ID NO: 152774 - DNA, 22 bp, Artificial Sequence
  chemically synthesized
actaatctcttccttatttgtt

SEQ ID NO: 152775 - DNA, 22 bp, Artificial Sequence
  chemically synthesized
ctaatctcttccttatttgttt

SEQ ID NO: 152776 - DNA, 22 bp, Artificial Sequence
  chemically synthesized
atctcttccttatttgtttttg

SEQ ID NO: 152777 - DNA, 22 bp, Artificial Sequence
  chemically synthesized
ttccttatttgtttttgcttat

SEQ ID NO: 152778 - DNA, 22 bp, Artificial Sequence
  chemically synthesized
ccttatttgtttttgcttatgg

SEQ ID NO: 152779 - DNA, 22 bp, Artificial Sequence
  chemically synthesized
cttatttgtttttgcttatggc

SEQ ID NO: 152780 - DNA, 22 bp, Artificial Sequence
  chemically synthesized
atttgtttttgcttatggcttc

SEQ ID NO: 152781 - DNA, 22 bp, Artificial Sequence
  chemically synthesized
tttgtttttgcttatggcttct

SEQ ID NO: 152782 - DNA, 22 bp, Artificial Sequence
  chemically synthesized
gtttttgcttatggcttctaag

SEQ ID NO: 152783 - DNA, 22 bp, Artificial Sequence
  chemically synthesized
tttttgcttatggcttctaagg

SEQ ID NO: 152784 - DNA, 22 bp, Artificial Sequence
  chemically synthesized
ttgcttatggcttctaaggata

SEQ ID NO: 152785 - DNA, 22 bp, Artificial Sequence
  chemically synthesized
tgcttatggcttctaaggatat

SEQ ID NO: 152786 - DNA, 22 bp, Artificial Sequence
  chemically synthesized
gcttatggcttctaaggatatg

SEQ ID NO: 152787 - DNA, 22 bp, Artificial Sequence
  chemically synthesized
cttatggcttctaaggatatgt

SEQ ID NO: 152788 - DNA, 22 bp, Artificial Sequence
  chemically synthesized
atggcttctaaggatatgttca

SEQ ID NO: 152789 - DNA, 22 bp, Artificial Sequence
  chemically synthesized
tggcttctaaggatatgttcac

SEQ ID NO: 152790 - DNA, 22 bp, Artificial Sequence
  chemically synthesized
ctaaggatatgttcacatccag

SEQ ID NO: 152791 - DNA, 22 bp, Artificial Sequence
  chemically synthesized
taaggatatgttcacatccaga

SEQ ID NO: 152792 - DNA, 22 bp, Artificial Sequence
  chemically synthesized
aggatatgttcacatccagaca

SEQ ID NO: 152793 - DNA, 22 bp, Artificial Sequence
  chemically synthesized
acatccagacagtgaaaaaata

SEQ ID NO: 152794 - DNA, 22 bp, Artificial Sequence
  chemically synthesized
ttaaatgacatcaaaagaagac

SEQ ID NO: 152795 - DNA, 22 bp, Artificial Sequence
  chemically synthesized
taaatgacatcaaaagaagacc

SEQ ID NO: 152796 - DNA, 22 bp, Artificial Sequence
  chemically synthesized
aaatgacatcaaaagaagacca

SEQ ID NO: 152797 - DNA, 22 bp, Artificial Sequence
  chemically synthesized
aatgacatcaaaagaagaccat

SEQ ID NO: 152798 - DNA, 22 bp, Artificial Sequence
  chemically synthesized
tctcaaaggcaatggatactat

SEQ ID NO: 152799 - DNA, 22 bp, Artificial Sequence
  chemically synthesized
ctcaaaggcaatggatactatg

SEQ ID NO: 152800 - DNA, 22 bp, Artificial Sequence
  chemically synthesized
tcaaaggcaatggatactatgt

SEQ ID NO: 152801 - DNA, 22 bp, Artificial Sequence
  chemically synthesized
aaaggcaatggatactatgtct

SEQ ID NO: 152802 - DNA, 22 bp, Artificial Sequence
  chemically synthesized
tgtctcaaagaaacagaatttc

SEQ ID NO: 152803 - DNA, 22 bp, Artificial Sequence
  chemically synthesized
aaagaaacagaatttctcagct

SEQ ID NO: 152804 - DNA, 22 bp, Artificial Sequence
  chemically synthesized
ctcagctgttttttttaagtca

SEQ ID NO: 152805 - DNA, 22 bp, Artificial Sequence
  chemically synthesized
tcagctgttttttttaagtcag

SEQ ID NO: 152806 - DNA, 22 bp, Artificial Sequence
  chemically synthesized
agctgttttttttaagtcagta

SEQ ID NO: 152807 - DNA, 22 bp, Artificial Sequence
  chemically synthesized
ttttttttaagtcagtaagttt

SEQ ID NO: 152808 - DNA, 22 bp, Artificial Sequence
  chemically synthesized
tttttaagtcagtaagttttag

SEQ ID NO: 152809 - DNA, 22 bp, Artificial Sequence
  chemically synthesized
ttttaagtcagtaagttttagg

SEQ ID NO: 152810 - DNA, 22 bp, Artificial Sequence
  chemically synthesized
tttaagtcagtaagttttaggg

SEQ ID NO: 152811 - DNA, 22 bp, Artificial Sequence
  chemically synthesized
ttaagtcagtaagttttagggt

SEQ ID NO: 152812 - DNA, 22 bp, Artificial Sequence
  chemically synthesized
taagtcagtaagttttagggta

SEQ ID NO: 152813 - DNA, 22 bp, Artificial Sequence
  chemically synthesized
aagtcagtaagttttagggtat

SEQ ID NO: 152814 - DNA, 22 bp, Artificial Sequence
  chemically synthesized
agtcagtaagttttagggtatt

SEQ ID NO: 152815 - DNA, 22 bp, Artificial Sequence
  chemically synthesized
tagggtatttcatttacttaga

SEQ ID NO: 152816 - DNA, 22 bp, Artificial Sequence
  chemically synthesized
agggtatttcatttacttagaa

SEQ ID NO: 152817 - DNA, 22 bp, Artificial Sequence
  chemically synthesized
gggtatttcatttacttagaaa

SEQ ID NO: 152818 - DNA, 22 bp, Artificial Sequence
  chemically synthesized
catttacttagaaatttcattg

SEQ ID NO: 152819 - DNA, 22 bp, Artificial Sequence
  chemically synthesized
atttacttagaaatttcattgt

SEQ ID NO: 152820 - DNA, 22 bp, Artificial Sequence
  chemically synthesized
acttagaaatttcattgtattc

SEQ ID NO: 152821 - DNA, 22 bp, Artificial Sequence
  chemically synthesized
cttagaaatttcattgtattca

SEQ ID NO: 152822 - DNA, 22 bp, Artificial Sequence
  chemically synthesized
agaaatttcattgtattcaggt

SEQ ID NO: 152823 - DNA, 22 bp, Artificial Sequence
  chemically synthesized
gaaatttcattgtattcaggtg

SEQ ID NO: 152824 - DNA, 22 bp, Artificial Sequence
  chemically synthesized
cattgtattcaggtgaaattga

SEQ ID NO: 152825 - DNA, 22 bp, Artificial Sequence
  chemically synthesized
attgtattcaggtgaaattgaa

SEQ ID NO: 152826 - DNA, 22 bp, Artificial Sequence
  chemically synthesized
tattcaggtgaaattgaaacat

SEQ ID NO: 152827 - DNA, 22 bp, Artificial Sequence
  chemically synthesized
aggtgaaattgaaacatttcct

SEQ ID NO: 152828 - DNA, 22 bp, Artificial Sequence
  chemically synthesized
aaacatttcctttgaaaaaata

SEQ ID NO: 152829 - DNA, 22 bp, Artificial Sequence
  chemically synthesized
cctttgaaaaaatactctcaca

SEQ ID NO: 152830 - DNA, 22 bp, Artificial Sequence
  chemically synthesized
ctttgaaaaaatactctcacat

SEQ ID NO: 152831 - DNA, 22 bp, Artificial Sequence
  chemically synthesized
tgaaaaaatactctcacatgtt

SEQ ID NO: 152832 - DNA, 22 bp, Artificial Sequence
  chemically synthesized
gaaaaaatactctcacatgttt

SEQ ID NO: 152833 - DNA, 22 bp, Artificial Sequence
  chemically synthesized
aaaaaatactctcacatgtttc

SEQ ID NO: 152834 - DNA, 22 bp, Artificial Sequence
  chemically synthesized
tcacatgtttctcagttccaga

SEQ ID NO: 152835 - DNA, 22 bp, Artificial Sequence
  chemically synthesized
acatgtttctcagttccagaat

SEQ ID NO: 152836 - DNA, 22 bp, Artificial Sequence
  chemically synthesized
ctcagttccagaatgattactt

SEQ ID NO: 152837 - DNA, 22 bp, Artificial Sequence
  chemically synthesized
tcagttccagaatgattacttc

SEQ ID NO: 152838 - DNA, 22 bp, Artificial Sequence
  chemically synthesized
agttccagaatgattacttcag

SEQ ID NO: 152839 - DNA, 22 bp, Artificial Sequence
  chemically synthesized
cagaatgattacttcagtaagc

SEQ ID NO: 152840 - DNA, 22 bp, Artificial Sequence
  chemically synthesized
cttcagtaagccctagcaccag

SEQ ID NO: 152841 - DNA, 22 bp, Artificial Sequence
  chemically synthesized
cagtaagccctagcaccagcac

SEQ ID NO: 152842 - DNA, 22 bp, Artificial Sequence
  chemically synthesized
agtaagccctagcaccagcacg

SEQ ID NO: 152843 - DNA, 22 bp, Artificial Sequence
  chemically synthesized
gcaccagcacgaattcttcctt

SEQ ID NO: 152844 - DNA, 22 bp, Artificial Sequence
  chemically synthesized
ttcctttcttctcactggattt

SEQ ID NO: 152845 - DNA, 22 bp, Artificial Sequence
  chemically synthesized
cctttcttctcactggattttc

SEQ ID NO: 152846 - DNA, 22 bp, Artificial Sequence
  chemically synthesized
ctttcttctcactggattttct

SEQ ID NO: 152847 - DNA, 22 bp, Artificial Sequence
  chemically synthesized
tcttctcactggattttctggc

SEQ ID NO: 152848 - DNA, 22 bp, Artificial Sequence
  chemically synthesized
cttctcactggattttctggca

SEQ ID NO: 152849 - DNA, 22 bp, Artificial Sequence
  chemically synthesized
ttctcactggattttctggcat

SEQ ID NO: 152850 - DNA, 22 bp, Artificial Sequence
  chemically synthesized
ctcactggattttctggcatgg

SEQ ID NO: 152851 - DNA, 22 bp, Artificial Sequence
  chemically synthesized
tcactggattttctggcatgga

SEQ ID NO: 152852 - DNA, 22 bp, Artificial Sequence
  chemically synthesized
actggattttctggcatggagc

SEQ ID NO: 152853 - DNA, 22 bp, Artificial Sequence
  chemically synthesized
gattttctggcatggagcagca

SEQ ID NO: 152854 - DNA, 22 bp, Artificial Sequence
  chemically synthesized
tctggcatggagcagcaatacc

SEQ ID NO: 152855 - DNA, 22 bp, Artificial Sequence
  chemically synthesized
ctggcatggagcagcaataccc

SEQ ID NO: 152856 - DNA, 22 bp, Artificial Sequence
  chemically synthesized
tggcatggagcagcaatacccc

SEQ ID NO: 152857 - DNA, 22 bp, Artificial Sequence
  chemically synthesized
gcatggagcagcaatacccctg

SEQ ID NO: 152858 - DNA, 22 bp, Artificial Sequence
  chemically synthesized
gctttccatccccttctcctca

SEQ ID NO: 152859 - DNA, 22 bp, Artificial Sequence
  chemically synthesized
tccatccccttctcctcaatct

SEQ ID NO: 152860 - DNA, 22 bp, Artificial Sequence
  chemically synthesized
ccatccccttctcctcaatcta

SEQ ID NO: 152861 - DNA, 22 bp, Artificial Sequence
  chemically synthesized
catccccttctcctcaatctat

SEQ ID NO: 152862 - DNA, 22 bp, Artificial Sequence
  chemically synthesized
ctcctcaatctatgccatggtg

SEQ ID NO: 152863 - DNA, 22 bp, Artificial Sequence
  chemically synthesized
tcctcaatctatgccatggtgc

SEQ ID NO: 152864 - DNA, 22 bp, Artificial Sequence
  chemically synthesized
ctcaatctatgccatggtgctt

SEQ ID NO: 152865 - DNA, 22 bp, Artificial Sequence
  chemically synthesized
aatctatgccatggtgcttttg

SEQ ID NO: 152866 - DNA, 22 bp, Artificial Sequence
  chemically synthesized
tgccatggtgcttttgggcaat

SEQ ID NO: 152867 - DNA, 22 bp, Artificial Sequence
  chemically synthesized
ttgggcaattgcatggttctcc

SEQ ID NO: 152868 - DNA, 22 bp, Artificial Sequence
  chemically synthesized
tgggcaattgcatggttctcca

SEQ ID NO: 152869 - DNA, 22 bp, Artificial Sequence
  chemically synthesized
gggcaattgcatggttctccat

SEQ ID NO: 152870 - DNA, 22 bp, Artificial Sequence
  chemically synthesized
ggcaattgcatggttctccatg

SEQ ID NO: 152871 - DNA, 22 bp, Artificial Sequence
  chemically synthesized
catggttctccatgtgatatgg

SEQ ID NO: 152872 - DNA, 22 bp, Artificial Sequence
  chemically synthesized
tccatgtgatatggactgagcc

SEQ ID NO: 152873 - DNA, 22 bp, Artificial Sequence
  chemically synthesized
catgtgatatggactgagccaa

SEQ ID NO: 152874 - DNA, 22 bp, Artificial Sequence
  chemically synthesized
agccaagcctgcaccagcctat

SEQ ID NO: 152875 - DNA, 22 bp, Artificial Sequence
  chemically synthesized
caccagcctatgttttacttcc

SEQ ID NO: 152876 - DNA, 22 bp, Artificial Sequence
  chemically synthesized
tgttttacttcctgtccatgct

SEQ ID NO: 152877 - DNA, 22 bp, Artificial Sequence
  chemically synthesized
tacttcctgtccatgctggccc

SEQ ID NO: 152878 - DNA, 22 bp, Artificial Sequence
  chemically synthesized
acttcctgtccatgctggccct

SEQ ID NO: 152879 - DNA, 22 bp, Artificial Sequence
  chemically synthesized
cttcctgtccatgctggccctc

SEQ ID NO: 152880 - DNA, 22 bp, Artificial Sequence
  chemically synthesized
cctgtccatgctggccctcact

SEQ ID NO: 152881 - DNA, 22 bp, Artificial Sequence
  chemically synthesized
ctgtccatgctggccctcactg

SEQ ID NO: 152882 - DNA, 22 bp, Artificial Sequence
  chemically synthesized
tccatgctggccctcactgacc

SEQ ID NO: 152883 - DNA, 22 bp, Artificial Sequence
  chemically synthesized
gccctcactgacctgtgcatgg

SEQ ID NO: 152884 - DNA, 22 bp, Artificial Sequence
  chemically synthesized
actgacctgtgcatggggctgt

SEQ ID NO: 152885 - DNA, 22 bp, Artificial Sequence
  chemically synthesized
acctgtgcatggggctgtccac

SEQ ID NO: 152886 - DNA, 22 bp, Artificial Sequence
  chemically synthesized
tgcatggggctgtccactgtgt

SEQ ID NO: 152887 - DNA, 22 bp, Artificial Sequence
  chemically synthesized
tccactgtgtacacagtgctgg

SEQ ID NO: 152888 - DNA, 22 bp, Artificial Sequence
  chemically synthesized
tgtacacagtgctggggatcct

SEQ ID NO: 152889 - DNA, 22 bp, Artificial Sequence
  chemically synthesized
gggatcctgtgggggatcattc

SEQ ID NO: 152890 - DNA, 22 bp, Artificial Sequence
  chemically synthesized
tgggggatcattcgagagatca

SEQ ID NO: 152891 - DNA, 22 bp, Artificial Sequence
  chemically synthesized
gagagatcagcttggattcctg

SEQ ID NO: 152892 - DNA, 22 bp, Artificial Sequence
  chemically synthesized
ggattcctgcattgcccagtcc

SEQ ID NO: 152893 - DNA, 22 bp, Artificial Sequence
  chemically synthesized
gattcctgcattgcccagtcct

SEQ ID NO: 152894 - DNA, 22 bp, Artificial Sequence
  chemically synthesized
ctgcattgcccagtcctatttc

SEQ ID NO: 152895 - DNA, 22 bp, Artificial Sequence
  chemically synthesized
cattgcccagtcctatttcatc

SEQ ID NO: 152896 - DNA, 22 bp, Artificial Sequence
  chemically synthesized
cccagtcctatttcatccatgg

SEQ ID NO: 152897 - DNA, 22 bp, Artificial Sequence
  chemically synthesized
tttcatccatggtctgtccttc

SEQ ID NO: 152898 - DNA, 22 bp, Artificial Sequence
  chemically synthesized
catccatggtctgtccttcatg

SEQ ID NO: 152899 - DNA, 22 bp, Artificial Sequence
  chemically synthesized
atccatggtctgtccttcatgg

SEQ ID NO: 152900 - DNA, 22 bp, Artificial Sequence
  chemically synthesized
tccttcatggagtcctctgtcc

SEQ ID NO: 152901 - DNA, 22 bp, Artificial Sequence
  chemically synthesized
catggagtcctctgtcctcctc

SEQ ID NO: 152902 - DNA, 22 bp, Artificial Sequence
  chemically synthesized
atggagtcctctgtcctcctca

SEQ ID NO: 152903 - DNA, 22 bp, Artificial Sequence
  chemically synthesized
tgtcctcctcactatggccttt

SEQ ID NO: 152904 - DNA, 22 bp, Artificial Sequence
  chemically synthesized
tcctcctcactatggcctttga

SEQ ID NO: 152905 - DNA, 22 bp, Artificial Sequence
  chemically synthesized
ctcactatggcctttgaccggt

SEQ ID NO: 152906 - DNA, 22 bp, Artificial Sequence
  chemically synthesized
actatggcctttgaccggtaca

SEQ ID NO: 152907 - DNA, 22 bp, Artificial Sequence
  chemically synthesized
tggcctttgaccggtacattgc

SEQ ID NO: 152908 - DNA, 22 bp, Artificial Sequence
  chemically synthesized
tgaccggtacattgcaatttgc

SEQ ID NO: 152909 - DNA, 22 bp, Artificial Sequence
  chemically synthesized
gaccggtacattgcaatttgca

SEQ ID NO: 152910 - DNA, 22 bp, Artificial Sequence
  chemically synthesized
accggtacattgcaatttgcaa

SEQ ID NO: 152911 - DNA, 22 bp, Artificial Sequence
  chemically synthesized
caatttgcaatccactacgtta

SEQ ID NO: 152912 - DNA, 22 bp, Artificial Sequence
  chemically synthesized
gcaatccactacgttattcctc

SEQ ID NO: 152913 - DNA, 22 bp, Artificial Sequence
  chemically synthesized
caatccactacgttattcctcc

SEQ ID NO: 152914 - DNA, 22 bp, Artificial Sequence
  chemically synthesized
cgttattcctccatcctgacta

SEQ ID NO: 152915 - DNA, 22 bp, Artificial Sequence
  chemically synthesized
ttcctccatcctgactaattcc

SEQ ID NO: 152916 - DNA, 22 bp, Artificial Sequence
  chemically synthesized
ctccatcctgactaattccaga

SEQ ID NO: 152917 - DNA, 22 bp, Artificial Sequence
  chemically synthesized
catcctgactaattccagaatt

SEQ ID NO: 152918 - DNA, 22 bp, Artificial Sequence
  chemically synthesized
actaattccagaattatcaaaa

SEQ ID NO: 152919 - DNA, 22 bp, Artificial Sequence
  chemically synthesized
attccagaattatcaaaattgg

SEQ ID NO: 152920 - DNA, 22 bp, Artificial Sequence
  chemically synthesized
cagaattatcaaaattgggctc

SEQ ID NO: 152921 - DNA, 22 bp, Artificial Sequence
  chemically synthesized
tcaaaattgggctcactataat

SEQ ID NO: 152922 - DNA, 22 bp, Artificial Sequence
  chemically synthesized
ggctcactataataggtaggag

SEQ ID NO: 152923 - DNA, 22 bp, Artificial Sequence
  chemically synthesized
actataataggtaggagttttt

SEQ ID NO: 152924 - DNA, 22 bp, Artificial Sequence
  chemically synthesized
taataggtaggagttttttctt

SEQ ID NO: 152925 - DNA, 22 bp, Artificial Sequence
  chemically synthesized
tttctttattacaccccccatc

SEQ ID NO: 152926 - DNA, 22 bp, Artificial Sequence
  chemically synthesized
ttctttattacaccccccatca

SEQ ID NO: 152927 - DNA, 22 bp, Artificial Sequence
  chemically synthesized
tctttattacaccccccatcat

SEQ ID NO: 152928 - DNA, 22 bp, Artificial Sequence
  chemically synthesized
ctttattacaccccccatcatc

SEQ ID NO: 152929 - DNA, 22 bp, Artificial Sequence
  chemically synthesized
tttattacaccccccatcatct

SEQ ID NO: 152930 - DNA, 22 bp, Artificial Sequence
  chemically synthesized
tattacaccccccatcatctgt

SEQ ID NO: 152931 - DNA, 22 bp, Artificial Sequence
  chemically synthesized
attacaccccccatcatctgtc

SEQ ID NO: 152932 - DNA, 22 bp, Artificial Sequence
  chemically synthesized
ttacaccccccatcatctgtct

SEQ ID NO: 152933 - DNA, 22 bp, Artificial Sequence
  chemically synthesized
caccccccatcatctgtctgaa

SEQ ID NO: 152934 - DNA, 22 bp, Artificial Sequence
  chemically synthesized
tctgaaattttttaattactgt

SEQ ID NO: 152935 - DNA, 22 bp, Artificial Sequence
  chemically synthesized
aaattttttaattactgtcatt

SEQ ID NO: 152936 - DNA, 22 bp, Artificial Sequence
  chemically synthesized
tttaattactgtcatttccaca

SEQ ID NO: 152937 - DNA, 22 bp, Artificial Sequence
  chemically synthesized
ttaattactgtcatttccacat

SEQ ID NO: 152938 - DNA, 22 bp, Artificial Sequence
  chemically synthesized
taattactgtcatttccacatc

SEQ ID NO: 152939 - DNA, 22 bp, Artificial Sequence
  chemically synthesized
aattactgtcatttccacatcc

SEQ ID NO: 152940 - DNA, 22 bp, Artificial Sequence
  chemically synthesized
attactgtcatttccacatcct

SEQ ID NO: 152941 - DNA, 22 bp, Artificial Sequence
  chemically synthesized
ctgtcatttccacatcctttct

SEQ ID NO: 152942 - DNA, 22 bp, Artificial Sequence
  chemically synthesized
tcatttccacatcctttctcac

SEQ ID NO: 152943 - DNA, 22 bp, Artificial Sequence
  chemically synthesized
ccacatcctttctcactctttc

SEQ ID NO: 152944 - DNA, 22 bp, Artificial Sequence
  chemically synthesized
cacatcctttctcactctttct

SEQ ID NO: 152945 - DNA, 22 bp, Artificial Sequence
  chemically synthesized
tctcactctttctgcctgcacc

SEQ ID NO: 152946 - DNA, 22 bp, Artificial Sequence
  chemically synthesized
ctcactctttctgcctgcacca

SEQ ID NO: 152947 - DNA, 22 bp, Artificial Sequence
  chemically synthesized
tcactctttctgcctgcaccag

SEQ ID NO: 152948 - DNA, 22 bp, Artificial Sequence
  chemically synthesized
actctttctgcctgcaccagga

SEQ ID NO: 152949 - DNA, 22 bp, Artificial Sequence
  chemically synthesized
tttctgcctgcaccaggatctt

SEQ ID NO: 152950 - DNA, 22 bp, Artificial Sequence
  chemically synthesized
tctgcctgcaccaggatcttct

SEQ ID NO: 152951 - DNA, 22 bp, Artificial Sequence
  chemically synthesized
ctgcctgcaccaggatcttctc

SEQ ID NO: 152952 - DNA, 22 bp, Artificial Sequence
  chemically synthesized
tgcctgcaccaggatcttctcc

SEQ ID NO: 152953 - DNA, 22 bp, Artificial Sequence
  chemically synthesized
cctgcaccaggatcttctccgc

SEQ ID NO: 152954 - DNA, 22 bp, Artificial Sequence
  chemically synthesized
caccaggatcttctccgcttag

SEQ ID NO: 152955 - DNA, 22 bp, Artificial Sequence
  chemically synthesized
ctccgcttagcctgttcagaca

SEQ ID NO: 152956 - DNA, 22 bp, Artificial Sequence
  chemically synthesized
tccgcttagcctgttcagacat

SEQ ID NO: 152957 - DNA, 22 bp, Artificial Sequence
  chemically synthesized
cgcttagcctgttcagacatcc

SEQ ID NO: 152958 - DNA, 22 bp, Artificial Sequence
  chemically synthesized
agcctgttcagacatccgattc

SEQ ID NO: 152959 - DNA, 22 bp, Artificial Sequence
  chemically synthesized
gcctgttcagacatccgattca

SEQ ID NO: 152960 - DNA, 22 bp, Artificial Sequence
  chemically synthesized
ttcagacatccgattcaatagt

SEQ ID NO: 152961 - DNA, 22 bp, Artificial Sequence
  chemically synthesized
agacatccgattcaatagttac

SEQ ID NO: 152962 - DNA, 22 bp, Artificial Sequence
  chemically synthesized
aatagttactatgccctgatgc

SEQ ID NO: 152963 - DNA, 22 bp, Artificial Sequence
  chemically synthesized
ctatgccctgatgctggttatt

SEQ ID NO: 152964 - DNA, 22 bp, Artificial Sequence
  chemically synthesized
tgccctgatgctggttatttgc

SEQ ID NO: 152965 - DNA, 22 bp, Artificial Sequence
  chemically synthesized
atgctggttatttgcatactgt

SEQ ID NO: 152966 - DNA, 22 bp, Artificial Sequence
  chemically synthesized
gttatttgcatactgttgttgg

SEQ ID NO: 152967 - DNA, 22 bp, Artificial Sequence
  chemically synthesized
tttgcatactgttgttggatgc

SEQ ID NO: 152968 - DNA, 22 bp, Artificial Sequence
  chemically synthesized
gcatactgttgttggatgctat

SEQ ID NO: 152969 - DNA, 22 bp, Artificial Sequence
  chemically synthesized
catactgttgttggatgctata

SEQ ID NO: 152970 - DNA, 22 bp, Artificial Sequence
  chemically synthesized
ttgttggatgctatactcatcc

SEQ ID NO: 152971 - DNA, 22 bp, Artificial Sequence
  chemically synthesized
ttggatgctatactcatccttt

SEQ ID NO: 152972 - DNA, 22 bp, Artificial Sequence
  chemically synthesized
gatgctatactcatccttttct

SEQ ID NO: 152973 - DNA, 22 bp, Artificial Sequence
  chemically synthesized
tactcatccttttctcctacat

SEQ ID NO: 152974 - DNA, 22 bp, Artificial Sequence
  chemically synthesized
atccttttctcctacatcctga

SEQ ID NO: 152975 - DNA, 22 bp, Artificial Sequence
  chemically synthesized
ttctcctacatcctgattctta

SEQ ID NO: 152976 - DNA, 22 bp, Artificial Sequence
  chemically synthesized
tctcctacatcctgattcttaa

SEQ ID NO: 152977 - DNA, 22 bp, Artificial Sequence
  chemically synthesized
ctcctacatcctgattcttaag

SEQ ID NO: 152978 - DNA, 22 bp, Artificial Sequence
  chemically synthesized
tcctacatcctgattcttaagt

SEQ ID NO: 152979 - DNA, 22 bp, Artificial Sequence
  chemically synthesized
ctacatcctgattcttaagtca

SEQ ID NO: 152980 - DNA, 22 bp, Artificial Sequence
  chemically synthesized
catcctgattcttaagtcagtc

SEQ ID NO: 152981 - DNA, 22 bp, Artificial Sequence
  chemically synthesized
attcttaagtcagtcctggcag

SEQ ID NO: 152982 - DNA, 22 bp, Artificial Sequence
  chemically synthesized
ttaagtcagtcctggcagttgc

SEQ ID NO: 152983 - DNA, 22 bp, Artificial Sequence
  chemically synthesized
aagtcagtcctggcagttgcct

SEQ ID NO: 152984 - DNA, 22 bp, Artificial Sequence
  chemically synthesized
agtcagtcctggcagttgcctc

SEQ ID NO: 152985 - DNA, 22 bp, Artificial Sequence
  chemically synthesized
gcagttgcctctcaggaagaga

SEQ ID NO: 152986 - DNA, 22 bp, Artificial Sequence
  chemically synthesized
cctctcaggaagagaggcataa

SEQ ID NO: 152987 - DNA, 22 bp, Artificial Sequence
  chemically synthesized
tcaggaagagaggcataaatta

SEQ ID NO: 152988 - DNA, 22 bp, Artificial Sequence
  chemically synthesized
aggaagagaggcataaattatt

SEQ ID NO: 152989 - DNA, 22 bp, Artificial Sequence
  chemically synthesized
tttcagacctgcatctcccaca

SEQ ID NO: 152990 - DNA, 22 bp, Artificial Sequence
  chemically synthesized
cagacctgcatctcccacatct

SEQ ID NO: 152991 - DNA, 22 bp, Artificial Sequence
  chemically synthesized
agacctgcatctcccacatctg

SEQ ID NO: 152992 - DNA, 22 bp, Artificial Sequence
  chemically synthesized
catctcccacatctgtgctgtc

SEQ ID NO: 152993 - DNA, 22 bp, Artificial Sequence
  chemically synthesized
ccacatctgtgctgtccttgtg

SEQ ID NO: 152994 - DNA, 22 bp, Artificial Sequence
  chemically synthesized
tgctgtccttgtgttctacatc

SEQ ID NO: 152995 - DNA, 22 bp, Artificial Sequence
  chemically synthesized
tccttgtgttctacatccctat

SEQ ID NO: 152996 - DNA, 22 bp, Artificial Sequence
  chemically synthesized
gtgttctacatccctatcatta

SEQ ID NO: 152997 - DNA, 22 bp, Artificial Sequence
  chemically synthesized
tgttctacatccctatcattag

SEQ ID NO: 152998 - DNA, 22 bp, Artificial Sequence
  chemically synthesized
tacatccctatcattagcctca

SEQ ID NO: 152999 - DNA, 22 bp, Artificial Sequence
  chemically synthesized
catccctatcattagcctcaca

SEQ ID NO: 153000 - DNA, 22 bp, Artificial Sequence
  chemically synthesized
tcattagcctcacaatggtgca

SEQ ID NO: 153001 - DNA, 22 bp, Artificial Sequence
  chemically synthesized
gcctcacaatggtgcaccgttt

SEQ ID NO: 153002 - DNA, 22 bp, Artificial Sequence
  chemically synthesized
acaatggtgcaccgttttggca

SEQ ID NO: 153003 - DNA, 22 bp, Artificial Sequence
  chemically synthesized
tggcaagcacctttcccccgtg

SEQ ID NO: 153004 - DNA, 22 bp, Artificial Sequence
  chemically synthesized
ggcaagcacctttcccccgtgg

SEQ ID NO: 153005 - DNA, 22 bp, Artificial Sequence
  chemically synthesized
gcaagcacctttcccccgtggc

SEQ ID NO: 153006 - DNA, 22 bp, Artificial Sequence
  chemically synthesized
tcccccgtggcccacgttctca

SEQ ID NO: 153007 - DNA, 22 bp, Artificial Sequence
  chemically synthesized
cccccgtggcccacgttctcat

SEQ ID NO: 153008 - DNA, 22 bp, Artificial Sequence
  chemically synthesized
ccccgtggcccacgttctcatt

SEQ ID NO: 153009 - DNA, 22 bp, Artificial Sequence
  chemically synthesized
tcattggcaacatctacatcct

SEQ ID NO: 153010 - DNA, 22 bp, Artificial Sequence
  chemically synthesized
attggcaacatctacatccttt

SEQ ID NO: 153011 - DNA, 22 bp, Artificial Sequence
  chemically synthesized
gcaacatctacatccttttccc

SEQ ID NO: 153012 - DNA, 22 bp, Artificial Sequence
  chemically synthesized
catccttttcccacctttaatg

SEQ ID NO: 153013 - DNA, 22 bp, Artificial Sequence
  chemically synthesized
ttcccacctttaatgaatccca

SEQ ID NO: 153014 - DNA, 22 bp, Artificial Sequence
  chemically synthesized
tcccacctttaatgaatcccat

SEQ ID NO: 153015 - DNA, 22 bp, Artificial Sequence
  chemically synthesized
cccacctttaatgaatcccatc

SEQ ID NO: 153016 - DNA, 22 bp, Artificial Sequence
  chemically synthesized
ccacctttaatgaatcccatca

SEQ ID NO: 153017 - DNA, 22 bp, Artificial Sequence
  chemically synthesized
taatgaatcccatcatctacag

SEQ ID NO: 153018 - DNA, 22 bp, Artificial Sequence
  chemically synthesized
aatgaatcccatcatctacagt

SEQ ID NO: 153019 - DNA, 22 bp, Artificial Sequence
  chemically synthesized
atgaatcccatcatctacagtg

SEQ ID NO: 153020 - DNA, 22 bp, Artificial Sequence
  chemically synthesized
cagtgtcaagacccaacagatt

SEQ ID NO: 153021 - DNA, 22 bp, Artificial Sequence
  chemically synthesized
ataccagaatgcttagactctt

SEQ ID NO: 153022 - DNA, 22 bp, Artificial Sequence
  chemically synthesized
agactcttttctctgaaaagat

SEQ ID NO: 153023 - DNA, 22 bp, Artificial Sequence
  chemically synthesized
gactcttttctctgaaaagata

SEQ ID NO: 153024 - DNA, 22 bp, Artificial Sequence
  chemically synthesized
ttttctctgaaaagatattgag

SEQ ID NO: 153025 - DNA, 22 bp, Artificial Sequence
  chemically synthesized
ttctctgaaaagatattgagag

SEQ ID NO: 153026 - DNA, 22 bp, Artificial Sequence
  chemically synthesized
tctctgaaaagatattgagaga

SEQ ID NO: 153027 - DNA, 22 bp, Artificial Sequence
  chemically synthesized
ctctgaaaagatattgagagat

SEQ ID NO: 153028 - DNA, 22 bp, Artificial Sequence
  chemically synthesized
tctgaaaagatattgagagata

SEQ ID NO: 153029 - DNA, 22 bp, Artificial Sequence
  chemically synthesized
tgaaaagatattgagagatatt

SEQ ID NO: 153030 - DNA, 22 bp, Artificial Sequence
  chemically synthesized
aaaagatattgagagatattga

SEQ ID NO: 153031 - DNA, 22 bp, Artificial Sequence
  chemically synthesized
agagatattgagatgtattgcc

SEQ ID NO: 153032 - DNA, 22 bp, Artificial Sequence
  chemically synthesized
agatgtattgcctaaaaaaaag

SEQ ID NO: 153033 - DNA, 22 bp, Artificial Sequence
  chemically synthesized
cctaaaaaaaagaaagaaaagc

SEQ ID NO: 153034 - DNA, 22 bp, Artificial Sequence
  chemically synthesized
aaaaaaagaaagaaaagcagca

SEQ ID NO: 153035 - DNA, 22 bp, Artificial Sequence
  chemically synthesized
ttaaaattgtagatttactctg

SEQ ID NO: 153036 - DNA, 22 bp, Artificial Sequence
  chemically synthesized
aaattgtagatttactctgagt

SEQ ID NO: 153037 - DNA, 22 bp, Artificial Sequence
  chemically synthesized
tagatttactctgagtccatga

SEQ ID NO: 153038 - DNA, 22 bp, Artificial Sequence
  chemically synthesized
actctgagtccatgacaaatga

SEQ ID NO: 153039 - DNA, 22 bp, Artificial Sequence
  chemically synthesized
ctctgagtccatgacaaatgac

SEQ ID NO: 153040 - DNA, 22 bp, Artificial Sequence
  chemically synthesized
tgagtccatgacaaatgacctt

SEQ ID NO: 153041 - DNA, 22 bp, Artificial Sequence
  chemically synthesized
agtccatgacaaatgaccttaa

SEQ ID NO: 153042 - DNA, 22 bp, Artificial Sequence
  chemically synthesized
aaaaaatatttaaatatagtca

SEQ ID NO: 153043 - DNA, 22 bp, Artificial Sequence
  chemically synthesized
aaaaatatttaaatatagtcag

SEQ ID NO: 153044 - DNA, 22 bp, Artificial Sequence
  chemically synthesized
aaatatagtcagagaatcaaca

SEQ ID NO: 153045 - DNA, 22 bp, Artificial Sequence
  chemically synthesized
aatatagtcagagaatcaacaa

SEQ ID NO: 153046 - DNA, 22 bp, Artificial Sequence
  chemically synthesized
cattgtgtcagcctggacacat

SEQ ID NO: 153047 - DNA, 22 bp, Artificial Sequence
  chemically synthesized
tgtcagcctggacacatgtagg

SEQ ID NO: 153048 - DNA, 22 bp, Artificial Sequence
  chemically synthesized
gacacatgtaggtcactctatc

SEQ ID NO: 153049 - DNA, 22 bp, Artificial Sequence
  chemically synthesized
tatcagtctgaccatatttaag

SEQ ID NO: 153050 - DNA, 22 bp, Artificial Sequence
  chemically synthesized
tcagtctgaccatatttaagaa

SEQ ID NO: 153051 - DNA, 22 bp, Artificial Sequence
  chemically synthesized
accatatttaagaaagaggaaa

SEQ ID NO: 153052 - DNA, 22 bp, Artificial Sequence
  chemically synthesized
aagaaagaggaaaaaattgttt

SEQ ID NO: 153053 - DNA, 22 bp, Artificial Sequence
  chemically synthesized
agaaagaggaaaaaattgttta

SEQ ID NO: 153054 - DNA, 22 bp, Artificial Sequence
  chemically synthesized
tttatttgcctgaaatgtactt

SEQ ID NO: 153055 - DNA, 22 bp, Artificial Sequence
  chemically synthesized
atttgcctgaaatgtacttttg

SEQ ID NO: 153056 - DNA, 22 bp, Artificial Sequence
  chemically synthesized
tttgcctgaaatgtacttttga

SEQ ID NO: 153057 - DNA, 22 bp, Artificial Sequence
  chemically synthesized
gcctgaaatgtacttttgagca

SEQ ID NO: 153058 - DNA, 22 bp, Artificial Sequence
  chemically synthesized
cctgaaatgtacttttgagcat

SEQ ID NO: 153059 - DNA, 22 bp, Artificial Sequence
  chemically synthesized
aaatgtacttttgagcatttcc

SEQ ID NO: 153060 - DNA, 22 bp, Artificial Sequence
  chemically synthesized
ttgagcatttcctttgctgtaa

SEQ ID NO: 153061 - DNA, 22 bp, Artificial Sequence
  chemically synthesized
tgagcatttcctttgctgtaaa

SEQ ID NO: 153062 - DNA, 22 bp, Artificial Sequence
  chemically synthesized
gagcatttcctttgctgtaaaa

SEQ ID NO: 153063 - DNA, 22 bp, Artificial Sequence
  chemically synthesized
agcatttcctttgctgtaaaac

SEQ ID NO: 153064 - DNA, 22 bp, Artificial Sequence
  chemically synthesized
cctttgctgtaaaacaaagctg

SEQ ID NO: 153065 - DNA, 22 bp, Artificial Sequence
  chemically synthesized
ctttgctgtaaaacaaagctgg

SEQ ID NO: 153066 - DNA, 22 bp, Artificial Sequence
  chemically synthesized
tgctgtaaaacaaagctggatt

SEQ ID NO: 153067 - DNA, 22 bp, Artificial Sequence
  chemically synthesized
gctgtaaaacaaagctggatta

SEQ ID NO: 153068 - DNA, 22 bp, Artificial Sequence
  chemically synthesized
ctgtaaaacaaagctggattaa

SEQ ID NO: 153069 - DNA, 22 bp, Artificial Sequence
  chemically synthesized
taaaacaaagctggattaaaaa

SEQ ID NO: 153070 - DNA, 22 bp, Artificial Sequence
  chemically synthesized
gattaaaaacctaggttttcaa

SEQ ID NO: 153071 - DNA, 22 bp, Artificial Sequence
  chemically synthesized
aaaacctaggttttcaagtttc

SEQ ID NO: 153072 - DNA, 22 bp, Artificial Sequence
  chemically synthesized
ggttttcaagtttcaaagtaga

SEQ ID NO: 153073 - DNA, 22 bp, Artificial Sequence
  chemically synthesized
tcaagtttcaaagtagaaaact

SEQ ID NO: 153074 - DNA, 22 bp, Artificial Sequence
  chemically synthesized
caagtttcaaagtagaaaactt

SEQ ID NO: 153075 - DNA, 22 bp, Artificial Sequence
  chemically synthesized
aagtttcaaagtagaaaacttg

SEQ ID NO: 153076 - DNA, 22 bp, Artificial Sequence
  chemically synthesized
caaagtagaaaacttgaagttt

SEQ ID NO: 153077 - DNA, 22 bp, Artificial Sequence
  chemically synthesized
aaagtagaaaacttgaagtttc

SEQ ID NO: 153078 - DNA, 22 bp, Artificial Sequence
  chemically synthesized
gaagtttctttcattctctgag

SEQ ID NO: 153079 - DNA, 22 bp, Artificial Sequence
  chemically synthesized
aagtttctttcattctctgagg

SEQ ID NO: 153080 - DNA, 22 bp, Artificial Sequence
  chemically synthesized
ctttcattctctgaggtttact

SEQ ID NO: 153081 - DNA, 22 bp, Artificial Sequence
  chemically synthesized
tttcattctctgaggtttactt

SEQ ID NO: 153082 - DNA, 22 bp, Artificial Sequence
  chemically synthesized
tcattctctgaggtttacttaa

SEQ ID NO: 153083 - DNA, 22 bp, Artificial Sequence
  chemically synthesized
cattctctgaggtttacttaat

SEQ ID NO: 153084 - DNA, 22 bp, Artificial Sequence
  chemically synthesized
attctctgaggtttacttaatt

SEQ ID NO: 153085 - DNA, 22 bp, Artificial Sequence
  chemically synthesized
tctgaggtttacttaattaacc

SEQ ID NO: 153086 - DNA, 22 bp, Artificial Sequence
  chemically synthesized
tgaggtttacttaattaacctt

SEQ ID NO: 153087 - DNA, 22 bp, Artificial Sequence
  chemically synthesized
aggtttacttaattaaccttca

SEQ ID NO: 153088 - DNA, 22 bp, Artificial Sequence
  chemically synthesized
acttaattaaccttcaaaatgg

SEQ ID NO: 153089 - DNA, 22 bp, Artificial Sequence
  chemically synthesized
cttaattaaccttcaaaatgga

SEQ ID NO: 153090 - DNA, 22 bp, Artificial Sequence
  chemically synthesized
aattaaccttcaaaatggagac

SEQ ID NO: 153091 - DNA, 22 bp, Artificial Sequence
  chemically synthesized
attaaccttcaaaatggagact

SEQ ID NO: 153092 - DNA, 22 bp, Artificial Sequence
  chemically synthesized
accttcaaaatggagactatag

SEQ ID NO: 153093 - DNA, 22 bp, Artificial Sequence
  chemically synthesized
caaaatggagactatagccaac

SEQ ID NO: 153094 - DNA, 22 bp, Artificial Sequence
  chemically synthesized
aaaatggagactatagccaact

SEQ ID NO: 153095 - DNA, 22 bp, Artificial Sequence
  chemically synthesized
tagccaactcacaggaatgttg

SEQ ID NO: 153096 - DNA, 22 bp, Artificial Sequence
  chemically synthesized
acaggaatgttgtgatatctgt

SEQ ID NO: 153097 - DNA, 22 bp, Artificial Sequence
  chemically synthesized
tgatatctgtatggaccagaat

SEQ ID NO: 153098 - DNA, 22 bp, Artificial Sequence
  chemically synthesized
tatggaccagaattgtccaagg

SEQ ID NO: 153099 - DNA, 22 bp, Artificial Sequence
  chemically synthesized
tccaagggaacttttctaaact

SEQ ID NO: 153100 - DNA, 22 bp, Artificial Sequence
  chemically synthesized
ttctaaactgatggcgatgttc

SEQ ID NO: 153101 - DNA, 22 bp, Artificial Sequence
  chemically synthesized
tctaaactgatggcgatgttct

SEQ ID NO: 153102 - DNA, 22 bp, Artificial Sequence
  chemically synthesized
ctaaactgatggcgatgttcta

SEQ ID NO: 153103 - DNA, 22 bp, Artificial Sequence
  chemically synthesized
taaactgatggcgatgttctat

SEQ ID NO: 153104 - DNA, 22 bp, Artificial Sequence
  chemically synthesized
aactgatggcgatgttctataa

SEQ ID NO: 153105 - DNA, 22 bp, Artificial Sequence
  chemically synthesized
atggcgatgttctataaaatac

SEQ ID NO: 153106 - DNA, 22 bp, Artificial Sequence
  chemically synthesized
tataaaataccataaaatggct

SEQ ID NO: 153107 - DNA, 22 bp, Artificial Sequence
  chemically synthesized
taaaataccataaaatggctaa

SEQ ID NO: 153108 - DNA, 22 bp, Artificial Sequence
  chemically synthesized
aagtggaatatatggctcctgt

SEQ ID NO: 153109 - DNA, 22 bp, Artificial Sequence
  chemically synthesized
ctgtgcgcttgaaatgatggta

SEQ ID NO: 153110 - DNA, 22 bp, Artificial Sequence
  chemically synthesized
tgcgcttgaaatgatggtagtg

SEQ ID NO: 153111 - DNA, 22 bp, Artificial Sequence
  chemically synthesized
gaaatgatggtagtgtaattga

SEQ ID NO: 153112 - DNA, 22 bp, Artificial Sequence
  chemically synthesized
aaatgatggtagtgtaattgaa

SEQ ID NO: 153113 - DNA, 22 bp, Artificial Sequence
  chemically synthesized
aacaactgcatttacaatttca

SEQ ID NO: 153114 - DNA, 22 bp, Artificial Sequence
  chemically synthesized
catttacaatttcagttacttt

SEQ ID NO: 153115 - DNA, 22 bp, Artificial Sequence
  chemically synthesized
acaatttcagttactttaagtt

SEQ ID NO: 153116 - DNA, 22 bp, Artificial Sequence
  chemically synthesized
caatttcagttactttaagtta

SEQ ID NO: 153117 - DNA, 22 bp, Artificial Sequence
  chemically synthesized
cagttactttaagttaatttat

SEQ ID NO: 153118 - DNA, 22 bp, Artificial Sequence
  chemically synthesized
agttactttaagttaatttata

SEQ ID NO: 153119 - DNA, 22 bp, Artificial Sequence
  chemically synthesized
ctttaagttaatttatatttaa

SEQ ID NO: 153120 - DNA, 22 bp, Artificial Sequence
  chemically synthesized
taagttaatttatatttaaatg

SEQ ID NO: 153121 - DNA, 22 bp, Artificial Sequence
  chemically synthesized
aagttaatttatatttaaatgt

SEQ ID NO: 153122 - DNA, 22 bp, Artificial Sequence
  chemically synthesized
agttaatttatatttaaatgtt

SEQ ID NO: 153123 - DNA, 22 bp, Artificial Sequence
  chemically synthesized
atttatatttaaatgtttaatg

SEQ ID NO: 153124 - DNA, 22 bp, Artificial Sequence
  chemically synthesized
atatttaaatgtttaatgtcct

SEQ ID NO: 153125 - DNA, 22 bp, Artificial Sequence
  chemically synthesized
tatttaaatgtttaatgtcctt

SEQ ID NO: 153126 - DNA, 22 bp, Artificial Sequence
  chemically synthesized
aaatgtttaatgtccttgtatt

SEQ ID NO: 153127 - DNA, 22 bp, Artificial Sequence
  chemically synthesized
aatgtttaatgtccttgtattg

SEQ ID NO: 153128 - DNA, 22 bp, Artificial Sequence
  chemically synthesized
aatgtccttgtattggacagtt

SEQ ID NO: 153129 - DNA, 22 bp, Artificial Sequence
  chemically synthesized
atgtccttgtattggacagttc

SEQ ID NO: 153130 - DNA, 22 bp, Artificial Sequence
  chemically synthesized
gtattggacagttcagttcagc

SEQ ID NO: 153131 - DNA, 22 bp, Artificial Sequence
  chemically synthesized
tattggacagttcagttcagca

SEQ ID NO: 153132 - DNA, 22 bp, Artificial Sequence
  chemically synthesized
gacagttcagttcagcagccac

SEQ ID NO: 153133 - DNA, 22 bp, Artificial Sequence
  chemically synthesized
agttcagcagccactatattgg

SEQ ID NO: 153134 - DNA, 22 bp, Artificial Sequence
  chemically synthesized
agcagccactatattggacagg

SEQ ID NO: 153135 - DNA, 22 bp, Artificial Sequence
  chemically synthesized
tattggacagggaagctacagt

SEQ ID NO: 153136 - DNA, 22 bp, Artificial Sequence
  chemically synthesized
gacagggaagctacagttcata

SEQ ID NO: 153137 - DNA, 22 bp, Artificial Sequence
  chemically synthesized
cagttcataaagaggacacaaa

SEQ ID NO: 153138 - DNA, 22 bp, Artificial Sequence
  chemically synthesized
ataaagaggacacaaagaaata

SEQ ID NO: 153139 - DNA, 22 bp, Artificial Sequence
  chemically synthesized
tggattcaacttctaccatgtc

SEQ ID NO: 153140 - DNA, 22 bp, Artificial Sequence
  chemically synthesized
ggattcaacttctaccatgtct

SEQ ID NO: 153141 - DNA, 22 bp, Artificial Sequence
  chemically synthesized
gattcaacttctaccatgtcta

SEQ ID NO: 153142 - DNA, 22 bp, Artificial Sequence
  chemically synthesized
aacttctaccatgtctaattta

SEQ ID NO: 153143 - DNA, 22 bp, Artificial Sequence
  chemically synthesized
ctaccatgtctaatttaaatta

SEQ ID NO: 153144 - DNA, 22 bp, Artificial Sequence
  chemically synthesized
taccatgtctaatttaaattag

SEQ ID NO: 153145 - DNA, 22 bp, Artificial Sequence
  chemically synthesized
ccatgtctaatttaaattagaa

SEQ ID NO: 153146 - DNA, 22 bp, Artificial Sequence
  chemically synthesized
atttaaattagaatccttattt

SEQ ID NO: 153147 - DNA, 22 bp, Artificial Sequence
  chemically synthesized
aaattagaatccttatttttta

SEQ ID NO: 153148 - DNA, 22 bp, Artificial Sequence
  chemically synthesized
aattagaatccttattttttag

SEQ ID NO: 153149 - DNA, 22 bp, Artificial Sequence
  chemically synthesized
gaatccttattttttagatttt

SEQ ID NO: 153150 - DNA, 22 bp, Artificial Sequence
  chemically synthesized
attttttagattttatatgtgg

SEQ ID NO: 153151 - DNA, 22 bp, Artificial Sequence
  chemically synthesized
ttttttagattttatatgtgga

SEQ ID NO: 153152 - DNA, 22 bp, Artificial Sequence
  chemically synthesized
tttagattttatatgtggactc

SEQ ID NO: 153153 - DNA, 22 bp, Artificial Sequence
  chemically synthesized
ttagattttatatgtggactcc

SEQ ID NO: 153154 - DNA, 22 bp, Artificial Sequence
  chemically synthesized
tagattttatatgtggactcca

SEQ ID NO: 153155 - DNA, 22 bp, Artificial Sequence
  chemically synthesized
agattttatatgtggactccac

SEQ ID NO: 153156 - DNA, 22 bp, Artificial Sequence
  chemically synthesized
gattttatatgtggactccact

SEQ ID NO: 153157 - DNA, 22 bp, Artificial Sequence
  chemically synthesized
tatatgtggactccactgctac

SEQ ID NO: 153158 - DNA, 22 bp, Artificial Sequence
  chemically synthesized
atatgtggactccactgctaca

SEQ ID NO: 153159 - DNA, 22 bp, Artificial Sequence
  chemically synthesized
tatgtggactccactgctacaa

SEQ ID NO: 153160 - DNA, 22 bp, Artificial Sequence
  chemically synthesized
cactgctacaaggctggaagca

SEQ ID NO: 153161 - DNA, 22 bp, Artificial Sequence
  chemically synthesized
ctacaaggctggaagcagattt

SEQ ID NO: 153162 - DNA, 22 bp, Artificial Sequence
  chemically synthesized
caaggctggaagcagattttgc

SEQ ID NO: 153163 - DNA, 22 bp, Artificial Sequence
  chemically synthesized
gaagcagattttgctctagatc

SEQ ID NO: 153164 - DNA, 22 bp, Artificial Sequence
  chemically synthesized
tgctctagatcttttgctttta

SEQ ID NO: 153165 - DNA, 22 bp, Artificial Sequence
  chemically synthesized
gctctagatcttttgcttttat

SEQ ID NO: 153166 - DNA, 22 bp, Artificial Sequence
  chemically synthesized
ctctagatcttttgcttttata

SEQ ID NO: 153167 - DNA, 22 bp, Artificial Sequence
  chemically synthesized
tagatcttttgcttttatatct

SEQ ID NO: 153168 - DNA, 22 bp, Artificial Sequence
  chemically synthesized
gatcttttgcttttatatctaa

SEQ ID NO: 153169 - DNA, 22 bp, Artificial Sequence
  chemically synthesized
ttgcttttatatctaagtgggg

SEQ ID NO: 153170 - DNA, 22 bp, Artificial Sequence
  chemically synthesized
tgcttttatatctaagtggggg

SEQ ID NO: 153171 - DNA, 22 bp, Artificial Sequence
  chemically synthesized
gcttttatatctaagtggggga

SEQ ID NO: 153172 - DNA, 22 bp, Artificial Sequence
  chemically synthesized
cttttatatctaagtgggggat

SEQ ID NO: 153173 - DNA, 22 bp, Artificial Sequence
  chemically synthesized
ttatatctaagtgggggatctt

SEQ ID NO: 153174 - DNA, 22 bp, Artificial Sequence
  chemically synthesized
tatatctaagtgggggatcttc

SEQ ID NO: 153175 - DNA, 22 bp, Artificial Sequence
  chemically synthesized
atatctaagtgggggatcttct

SEQ ID NO: 153176 - DNA, 22 bp, Artificial Sequence
  chemically synthesized
tatctaagtgggggatcttctg

SEQ ID NO: 153177 - DNA, 22 bp, Artificial Sequence
  chemically synthesized
agtgggggatcttctgaacaga

SEQ ID NO: 153178 - DNA, 22 bp, Artificial Sequence
  chemically synthesized
ctgaacagatgagactgtccgc

SEQ ID NO: 153179 - DNA, 22 bp, Artificial Sequence
  chemically synthesized
tgaacagatgagactgtccgct

SEQ ID NO: 153180 - DNA, 22 bp, Artificial Sequence
  chemically synthesized
aacagatgagactgtccgctac

SEQ ID NO: 153181 - DNA, 22 bp, Artificial Sequence
  chemically synthesized
tccgctaccgacttattctgag

SEQ ID NO: 153182 - DNA, 22 bp, Artificial Sequence
  chemically synthesized
ccgacttattctgagtttaaaa

SEQ ID NO: 153183 - DNA, 22 bp, Artificial Sequence
  chemically synthesized
attctgagtttaaaagaaaaaa

SEQ ID NO: 153184 - DNA, 22 bp, Artificial Sequence
  chemically synthesized
ttctgagtttaaaagaaaaaag

SEQ ID NO: 153185 - DNA, 22 bp, Artificial Sequence
  chemically synthesized
tgagtttaaaagaaaaaagata

SEQ ID NO: 153186 - DNA, 22 bp, Artificial Sequence
  chemically synthesized
agtttaaaagaaaaaagataaa

SEQ ID NO: 153187 - DNA, 22 bp, Artificial Sequence
  chemically synthesized
aaaagaaaaaagataaaagaac

SEQ ID NO: 153188 - DNA, 22 bp, Artificial Sequence
  chemically synthesized
aaagaaaaaagataaaagaaca

SEQ ID NO: 153189 - DNA, 22 bp, Artificial Sequence
  chemically synthesized
ttttctaagtaagctagtgcag

SEQ ID NO: 153190 - DNA, 22 bp, Artificial Sequence
  chemically synthesized
ttctaagtaagctagtgcagct

SEQ ID NO: 153191 - DNA, 22 bp, Artificial Sequence
  chemically synthesized
tctaagtaagctagtgcagctt

SEQ ID NO: 153192 - DNA, 22 bp, Artificial Sequence
  chemically synthesized
ctaagtaagctagtgcagcttt

SEQ ID NO: 153193 - DNA, 22 bp, Artificial Sequence
  chemically synthesized
taagtaagctagtgcagctttc

SEQ ID NO: 153194 - DNA, 22 bp, Artificial Sequence
  chemically synthesized
agtaagctagtgcagctttcca

SEQ ID NO: 153195 - DNA, 22 bp, Artificial Sequence
  chemically synthesized
gtgcagctttccaaagaaggaa

SEQ ID NO: 153196 - DNA, 22 bp, Artificial Sequence
  chemically synthesized
tccaaagaaggaaagaaaggaa

SEQ ID NO: 153197 - DNA, 22 bp, Artificial Sequence
  chemically synthesized
ccaaagaaggaaagaaaggaag

SEQ ID NO: 153198 - DNA, 22 bp, Artificial Sequence
  chemically synthesized
caaagaaggaaagaaaggaagg

SEQ ID NO: 153199 - DNA, 22 bp, Artificial Sequence
  chemically synthesized
tgcatggataacaagaaaataa

SEQ ID NO: 153200 - DNA, 22 bp, Artificial Sequence
  chemically synthesized
ttttaatcttcctatattctat

SEQ ID NO: 153201 - DNA, 22 bp, Artificial Sequence
  chemically synthesized
taatcttcctatattctattag

SEQ ID NO: 153202 - DNA, 22 bp, Artificial Sequence
  chemically synthesized
aatcttcctatattctattagg

SEQ ID NO: 153203 - DNA, 22 bp, Artificial Sequence
  chemically synthesized
atcttcctatattctattaggt

SEQ ID NO: 153204 - DNA, 22 bp, Artificial Sequence
  chemically synthesized
cctatattctattaggtatcta

SEQ ID NO: 153205 - DNA, 22 bp, Artificial Sequence
  chemically synthesized
ctatattctattaggtatctaa

SEQ ID NO: 153206 - DNA, 22 bp, Artificial Sequence
  chemically synthesized
tattctattaggtatctaagaa

SEQ ID NO: 153207 - DNA, 22 bp, Artificial Sequence
  chemically synthesized
tattaggtatctaagaaggtaa

SEQ ID NO: 153208 - DNA, 22 bp, Artificial Sequence
  chemically synthesized
ttaggtatctaagaaggtaagt

SEQ ID NO: 153209 - DNA, 22 bp, Artificial Sequence
  chemically synthesized
ggtatctaagaaggtaagtgtt

SEQ ID NO: 153210 - DNA, 22 bp, Artificial Sequence
  chemically synthesized
agaaggtaagtgttaaaattgg

SEQ ID NO: 153211 - DNA, 22 bp, Artificial Sequence
  chemically synthesized
aaattggacaaattaatgcata

SEQ ID NO: 153212 - DNA, 22 bp, Artificial Sequence
  chemically synthesized
gacaaattaatgcataagagtc

SEQ ID NO: 153213 - DNA, 22 bp, Artificial Sequence
  chemically synthesized
atgcataagagtcattttacac

SEQ ID NO: 153214 - DNA, 22 bp, Artificial Sequence
  chemically synthesized
tacaccaaaaagcaaatattta

SEQ ID NO: 153215 - DNA, 22 bp, Artificial Sequence
  chemically synthesized
acaccaaaaagcaaatatttat

SEQ ID NO: 153216 - DNA, 22 bp, Artificial Sequence
  chemically synthesized
caccaaaaagcaaatatttatt

SEQ ID NO: 153217 - DNA, 22 bp, Artificial Sequence
  chemically synthesized
atttttatttttagatatcaac

SEQ ID NO: 153218 - DNA, 22 bp, Artificial Sequence
  chemically synthesized
tttttatttttagatatcaact

SEQ ID NO: 153219 - DNA, 22 bp, Artificial Sequence
  chemically synthesized
ttatttttagatatcaactaaa

SEQ ID NO: 153220 - DNA, 22 bp, Artificial Sequence
  chemically synthesized
tatttttagatatcaactaaaa

SEQ ID NO: 153221 - DNA, 22 bp, Artificial Sequence
  chemically synthesized
atttttagatatcaactaaaac

SEQ ID NO: 153222 - DNA, 22 bp, Artificial Sequence
  chemically synthesized
tttttagatatcaactaaaaca

SEQ ID NO: 153223 - DNA, 22 bp, Artificial Sequence
  chemically synthesized
ttagatatcaactaaaacaacc

SEQ ID NO: 153224 - DNA, 22 bp, Artificial Sequence
  chemically synthesized
tagatatcaactaaaacaacca

SEQ ID NO: 153225 - DNA, 22 bp, Artificial Sequence
  chemically synthesized
agatatcaactaaaacaaccag

SEQ ID NO: 153226 - DNA, 22 bp, Artificial Sequence
  chemically synthesized
gatatcaactaaaacaaccaga

SEQ ID NO: 153227 - DNA, 22 bp, Artificial Sequence
  chemically synthesized
aaacaaccagatttgtcttcct

SEQ ID NO: 153228 - DNA, 22 bp, Artificial Sequence
  chemically synthesized
gtcttcctgtaattatgccttc

SEQ ID NO: 153229 - DNA, 22 bp, Artificial Sequence
  chemically synthesized
tcttcctgtaattatgccttcc

SEQ ID NO: 153230 - DNA, 22 bp, Artificial Sequence
  chemically synthesized
cctgtaattatgccttcctttc

SEQ ID NO: 153231 - DNA, 22 bp, Artificial Sequence
  chemically synthesized
ctgtaattatgccttcctttcc

SEQ ID NO: 153232 - DNA, 22 bp, Artificial Sequence
  chemically synthesized
taattatgccttcctttccttt

SEQ ID NO: 153233 - DNA, 22 bp, Artificial Sequence
  chemically synthesized
tgccttcctttcctttcacttt

SEQ ID NO: 153234 - DNA, 22 bp, Artificial Sequence
  chemically synthesized
cctttcctttcactttggactt

SEQ ID NO: 153235 - DNA, 22 bp, Artificial Sequence
  chemically synthesized
ctttcctttcactttggacttc

SEQ ID NO: 153236 - DNA, 22 bp, Artificial Sequence
  chemically synthesized
tcctttcactttggacttcatt

SEQ ID NO: 153237 - DNA, 22 bp, Artificial Sequence
  chemically synthesized
cctttcactttggacttcattc

SEQ ID NO: 153238 - DNA, 22 bp, Artificial Sequence
  chemically synthesized
ctttcactttggacttcattca

SEQ ID NO: 153239 - DNA, 22 bp, Artificial Sequence
  chemically synthesized
tcactttggacttcattcaata

SEQ ID NO: 153240 - DNA, 22 bp, Artificial Sequence
  chemically synthesized
cactttggacttcattcaataa

SEQ ID NO: 153241 - DNA, 22 bp, Artificial Sequence
  chemically synthesized
actttggacttcattcaataac

SEQ ID NO: 153242 - DNA, 22 bp, Artificial Sequence
  chemically synthesized
tggacttcattcaataacatag

SEQ ID NO: 153243 - DNA, 22 bp, Artificial Sequence
  chemically synthesized
ggacttcattcaataacatagc

SEQ ID NO: 153244 - DNA, 22 bp, Artificial Sequence
  chemically synthesized
gacttcattcaataacatagcc

SEQ ID NO: 153245 - DNA, 22 bp, Artificial Sequence
  chemically synthesized
cattcaataacatagcctctgt

SEQ ID NO: 153246 - DNA, 22 bp, Artificial Sequence
  chemically synthesized
attcaataacatagcctctgtc

SEQ ID NO: 153247 - DNA, 22 bp, Artificial Sequence
  chemically synthesized
aataacatagcctctgtctact

SEQ ID NO: 153248 - DNA, 22 bp, Artificial Sequence
  chemically synthesized
tgtctacttatttgactcagag

SEQ ID NO: 153249 - DNA, 22 bp, Artificial Sequence
  chemically synthesized
tctacttatttgactcagaggg

SEQ ID NO: 153250 - DNA, 22 bp, Artificial Sequence
  chemically synthesized
cttatttgactcagagggaaac

SEQ ID NO: 153251 - DNA, 22 bp, Artificial Sequence
  chemically synthesized
atttgactcagagggaaacaaa

SEQ ID NO: 153252 - DNA, 22 bp, Artificial Sequence
  chemically synthesized
tttgactcagagggaaacaaaa

SEQ ID NO: 153253 - DNA, 22 bp, Artificial Sequence
  chemically synthesized
gactcagagggaaacaaaaata

SEQ ID NO: 153254 - DNA, 22 bp, Artificial Sequence
  chemically synthesized
actcagagggaaacaaaaatac

SEQ ID NO: 153255 - DNA, 22 bp, Artificial Sequence
  chemically synthesized
agagggaaacaaaaatacaggc

SEQ ID NO: 153256 - DNA, 22 bp, Artificial Sequence
  chemically synthesized
tggtttctaatagcttaagcct

SEQ ID NO: 153257 - DNA, 22 bp, Artificial Sequence
  chemically synthesized
ggtttctaatagcttaagcctc

SEQ ID NO: 153258 - DNA, 22 bp, Artificial Sequence
  chemically synthesized
gtttctaatagcttaagcctca

SEQ ID NO: 153259 - DNA, 22 bp, Artificial Sequence
  chemically synthesized
ctaatagcttaagcctcaaagt

SEQ ID NO: 153260 - DNA, 22 bp, Artificial Sequence
  chemically synthesized
taatagcttaagcctcaaagtg

SEQ ID NO: 153261 - DNA, 22 bp, Artificial Sequence
  chemically synthesized
atagcttaagcctcaaagtgag

SEQ ID NO: 153262 - DNA, 22 bp, Artificial Sequence
  chemically synthesized
aagcctcaaagtgaggaaattg

SEQ ID NO: 153263 - DNA, 22 bp, Artificial Sequence
  chemically synthesized
agcctcaaagtgaggaaattgt

SEQ ID NO: 153264 - DNA, 22 bp, Artificial Sequence
  chemically synthesized
aaagtgaggaaattgtttctgg

SEQ ID NO: 153265 - DNA, 22 bp, Artificial Sequence
  chemically synthesized
tttctggacagagtaaagtatc

SEQ ID NO: 153266 - DNA, 22 bp, Artificial Sequence
  chemically synthesized
ctggacagagtaaagtatctgg

SEQ ID NO: 153267 - DNA, 22 bp, Artificial Sequence
  chemically synthesized
tggacagagtaaagtatctggt

SEQ ID NO: 153268 - DNA, 22 bp, Artificial Sequence
  chemically synthesized
gacagagtaaagtatctggtta

SEQ ID NO: 153269 - DNA, 22 bp, Artificial Sequence
  chemically synthesized
gttagaaagataagtgtaaaat

SEQ ID NO: 153270 - DNA, 22 bp, Artificial Sequence
  chemically synthesized
gaaagataagtgtaaaattatt

SEQ ID NO: 153271 - DNA, 22 bp, Artificial Sequence
  chemically synthesized
ttcctagaacaataaattaggt

SEQ ID NO: 153272 - DNA, 22 bp, Artificial Sequence
  chemically synthesized
ctagaacaataaattaggtctt

SEQ ID NO: 153273 - DNA, 22 bp, Artificial Sequence
  chemically synthesized
gaacaataaattaggtcttctg

SEQ ID NO: 153274 - DNA, 22 bp, Artificial Sequence
  chemically synthesized
ggtcttctgggttacagtataa

SEQ ID NO: 153275 - DNA, 22 bp, Artificial Sequence
  chemically synthesized
ctgggttacagtataaggttaa

SEQ ID NO: 153276 - DNA, 22 bp, Artificial Sequence
  chemically synthesized
tgggttacagtataaggttaat

SEQ ID NO: 153277 - DNA, 22 bp, Artificial Sequence
  chemically synthesized
ggttacagtataaggttaattt

SEQ ID NO: 153278 - DNA, 22 bp, Artificial Sequence
  chemically synthesized
cagtataaggttaatttgaagg

SEQ ID NO: 153279 - DNA, 22 bp, Artificial Sequence
  chemically synthesized
atttgaaggataaaggagtgaa

SEQ ID NO: 153280 - DNA, 22 bp, Artificial Sequence
  chemically synthesized
gaaggataaaggagtgaatttc

SEQ ID NO: 153281 - DNA, 22 bp, Artificial Sequence
  chemically synthesized
aaggataaaggagtgaatttcc

SEQ ID NO: 153282 - DNA, 22 bp, Artificial Sequence
  chemically synthesized
cctgatgtcaaagaggatctag

SEQ ID NO: 153283 - DNA, 22 bp, Artificial Sequence
  chemically synthesized
ctgatgtcaaagaggatctagt

SEQ ID NO: 153284 - DNA, 22 bp, Artificial Sequence
  chemically synthesized
atgtcaaagaggatctagtgca

SEQ ID NO: 153285 - DNA, 22 bp, Artificial Sequence
  chemically synthesized
gtgcatcttctggtatagctat

SEQ ID NO: 153286 - DNA, 22 bp, Artificial Sequence
  chemically synthesized
ctggtatagctatcagaagtga

SEQ ID NO: 153287 - DNA, 22 bp, Artificial Sequence
  chemically synthesized
tggtatagctatcagaagtgaa

SEQ ID NO: 153288 - DNA, 22 bp, Artificial Sequence
  chemically synthesized
gtatagctatcagaagtgaaaa

SEQ ID NO: 153289 - DNA, 22 bp, Artificial Sequence
  chemically synthesized
tcagaagtgaaaactgtgaggt

SEQ ID NO: 153290 - DNA, 22 bp, Artificial Sequence
  chemically synthesized
tgaggtaggttctagaggggaa

SEQ ID NO: 153291 - DNA, 22 bp, Artificial Sequence
  chemically synthesized
tagaggggaaaatgtcaatata

SEQ ID NO: 153292 - DNA, 22 bp, Artificial Sequence
  chemically synthesized
gaggggaaaatgtcaatatata

SEQ ID NO: 153293 - DNA, 22 bp, Artificial Sequence
  chemically synthesized
tttactatataatcatagtagc

SEQ ID NO: 153294 - DNA, 22 bp, Artificial Sequence
  chemically synthesized
ttactatataatcatagtagct

SEQ ID NO: 153295 - DNA, 22 bp, Artificial Sequence
  chemically synthesized
tactatataatcatagtagctg

SEQ ID NO: 153296 - DNA, 22 bp, Artificial Sequence
  chemically synthesized
actatataatcatagtagctgc

SEQ ID NO: 153297 - DNA, 22 bp, Artificial Sequence
  chemically synthesized
ctatataatcatagtagctgcc

SEQ ID NO: 153298 - DNA, 22 bp, Artificial Sequence
  chemically synthesized
tataatcatagtagctgccgag

SEQ ID NO: 153299 - DNA, 22 bp, Artificial Sequence
  chemically synthesized
ccgaggcgggcggatcatgagg

SEQ ID NO: 153300 - DNA, 22 bp, Artificial Sequence
  chemically synthesized
gccagcaatggtgaaaccccgt

SEQ ID NO: 153301 - DNA, 22 bp, Artificial Sequence
  chemically synthesized
tactaaaaaaacacaagaaagt

SEQ ID NO: 153302 - DNA, 22 bp, Artificial Sequence
  chemically synthesized
ctaaaaaaacacaagaaagtat

SEQ ID NO: 153303 - DNA, 22 bp, Artificial Sequence
  chemically synthesized
aaaaaacacaagaaagtatcca

SEQ ID NO: 153304 - DNA, 22 bp, Artificial Sequence
  chemically synthesized
tagtcccaggtactcgggaggc

SEQ ID NO: 153305 - DNA, 22 bp, Artificial Sequence
  chemically synthesized
gggaggctgagacaggagaatg

SEQ ID NO: 153306 - DNA, 22 bp, Artificial Sequence
  chemically synthesized
agacaggagaatggcgtgaacc

SEQ ID NO: 153307 - DNA, 22 bp, Artificial Sequence
  chemically synthesized
gcagtgagtcgagatcacgcca

SEQ ID NO: 153308 - DNA, 22 bp, Artificial Sequence
  chemically synthesized
cagtgagtcgagatcacgccac

SEQ ID NO: 153309 - DNA, 22 bp, Artificial Sequence
  chemically synthesized
cactccagcctgggcgacagag

SEQ ID NO: 153310 - DNA, 22 bp, Artificial Sequence
  chemically synthesized
cagcctgggcgacagagagaga

SEQ ID NO: 153311 - DNA, 22 bp, Artificial Sequence
  chemically synthesized
ggcgacagagagagactctgtc

SEQ ID NO: 153312 - DNA, 22 bp, Artificial Sequence
  chemically synthesized
tgtctcaaaaaaaaaaaaaaaa

SEQ ID NO: 153313 - DNA, 22 bp, Artificial Sequence
  chemically synthesized
tctcaaaaaaaaaaaaaaaaag

SEQ ID NO: 153314 - DNA, 22 bp, Artificial Sequence
  chemically synthesized
aaaaaaaaaaaaaaaaagagaa

SEQ ID NO: 153315 - DNA, 22 bp, Artificial Sequence
  chemically synthesized
atatgaatgtcaggtggtagta

SEQ ID NO: 153316 - DNA, 22 bp, Artificial Sequence
  chemically synthesized
ctccaggttccctaatgataat

SEQ ID NO: 153317 - DNA, 22 bp, Artificial Sequence
  chemically synthesized
caggttccctaatgataataaa

SEQ ID NO: 153318 - DNA, 22 bp, Artificial Sequence
  chemically synthesized
cctaatgataataaatgtctgc

SEQ ID NO: 153319 - DNA, 22 bp, Artificial Sequence
  chemically synthesized
atgataataaatgtctgcatgg

SEQ ID NO: 153320 - DNA, 22 bp, Artificial Sequence
  chemically synthesized
catggtccctcctggccgactg

SEQ ID NO: 153321 - DNA, 22 bp, Artificial Sequence
  chemically synthesized
ctggccgactggaatgtggcca

SEQ ID NO: 153322 - DNA, 22 bp, Artificial Sequence
  chemically synthesized
gccgactggaatgtggccaatc

SEQ ID NO: 153323 - DNA, 22 bp, Artificial Sequence
  chemically synthesized
gaatgtggccaatctgacaaga

SEQ ID NO: 153324 - DNA, 22 bp, Artificial Sequence
  chemically synthesized
acaagattcctatgccccagtt

SEQ ID NO: 153325 - DNA, 22 bp, Artificial Sequence
  chemically synthesized
ctatgccccagttttataatga

SEQ ID NO: 153326 - DNA, 22 bp, Artificial Sequence
  chemically synthesized
tgccccagttttataatgaaaa

SEQ ID NO: 153327 - DNA, 22 bp, Artificial Sequence
  chemically synthesized
tataatgaaaagagaagttagc

SEQ ID NO: 153328 - DNA, 22 bp, Artificial Sequence
  chemically synthesized
ataatgaaaagagaagttagct

SEQ ID NO: 153329 - DNA, 22 bp, Artificial Sequence
  chemically synthesized
taatgaaaagagaagttagctg

SEQ ID NO: 153330 - DNA, 22 bp, Artificial Sequence
  chemically synthesized
gctgctgaatctgtagaggtca

SEQ ID NO: 153331 - DNA, 22 bp, Artificial Sequence
  chemically synthesized
ctgaatctgtagaggtcatgtg

SEQ ID NO: 153332 - DNA, 22 bp, Artificial Sequence
  chemically synthesized
aatctgtagaggtcatgtgaat

SEQ ID NO: 153333 - DNA, 22 bp, Artificial Sequence
  chemically synthesized
tagaggtcatgtgaatgtctca

SEQ ID NO: 153334 - DNA, 22 bp, Artificial Sequence
  chemically synthesized
atagatttctcaatggccaaag

SEQ ID NO: 153335 - DNA, 22 bp, Artificial Sequence
  chemically synthesized
ctcaatggccaaagaagcttcc

SEQ ID NO: 153336 - DNA, 22 bp, Artificial Sequence
  chemically synthesized
tcaatggccaaagaagcttcct

SEQ ID NO: 153337 - DNA, 22 bp, Artificial Sequence
  chemically synthesized
aatggccaaagaagcttccttc

SEQ ID NO: 153338 - DNA, 22 bp, Artificial Sequence
  chemically synthesized
ccttctaatgctttgaaagtga

SEQ ID NO: 153339 - DNA, 22 bp, Artificial Sequence
  chemically synthesized
cttctaatgctttgaaagtgaa

SEQ ID NO: 153340 - DNA, 22 bp, Artificial Sequence
  chemically synthesized
ctaatgctttgaaagtgaataa

SEQ ID NO: 153341 - DNA, 22 bp, Artificial Sequence
  chemically synthesized
taatgctttgaaagtgaataag

SEQ ID NO: 153342 - DNA, 22 bp, Artificial Sequence
  chemically synthesized
atgctttgaaagtgaataagca

SEQ ID NO: 153343 - DNA, 22 bp, Artificial Sequence
  chemically synthesized
tgaaagtgaataagcatccacc

SEQ ID NO: 153344 - DNA, 22 bp, Artificial Sequence
  chemically synthesized
gaaagtgaataagcatccaccc

SEQ ID NO: 153345 - DNA, 22 bp, Artificial Sequence
  chemically synthesized
aaagtgaataagcatccaccct

SEQ ID NO: 153346 - DNA, 22 bp, Artificial Sequence
  chemically synthesized
ccatacgccggagagctgacac

SEQ ID NO: 153347 - DNA, 22 bp, Artificial Sequence
  chemically synthesized
acacaacactggggaagcagag

SEQ ID NO: 153348 - DNA, 22 bp, Artificial Sequence
  chemically synthesized
gggaagcagagaattcttcaac

SEQ ID NO: 153349 - DNA, 22 bp, Artificial Sequence
  chemically synthesized
ttcaacaactgacaatatgttt

SEQ ID NO: 153350 - DNA, 22 bp, Artificial Sequence
  chemically synthesized
caacaactgacaatatgttttc

SEQ ID NO: 153351 - DNA, 22 bp, Artificial Sequence
  chemically synthesized
aacaactgacaatatgttttcc

SEQ ID NO: 153352 - DNA, 22 bp, Artificial Sequence
  chemically synthesized
acaatatgttttccaccagcca

SEQ ID NO: 153353 - DNA, 22 bp, Artificial Sequence
  chemically synthesized
tccaccagccactcatagggaa

SEQ ID NO: 153354 - DNA, 22 bp, Artificial Sequence
  chemically synthesized
ccaccagccactcatagggaag

SEQ ID NO: 153355 - DNA, 22 bp, Artificial Sequence
  chemically synthesized
caccagccactcatagggaagc

SEQ ID NO: 153356 - DNA, 22 bp, Artificial Sequence
  chemically synthesized
atagggaagcatcagaatgaat

SEQ ID NO: 153357 - DNA, 22 bp, Artificial Sequence
  chemically synthesized
atatttattatttgaacaatat

SEQ ID NO: 153358 - DNA, 22 bp, Artificial Sequence
  chemically synthesized
tatttattatttgaacaatatt

SEQ ID NO: 153359 - DNA, 22 bp, Artificial Sequence
  chemically synthesized
attatttgaacaatattacatg

SEQ ID NO: 153360 - DNA, 22 bp, Artificial Sequence
  chemically synthesized
ttatttgaacaatattacatgt

SEQ ID NO: 153361 - DNA, 22 bp, Artificial Sequence
  chemically synthesized
tttgaacaatattacatgtctg

SEQ ID NO: 153362 - DNA, 22 bp, Artificial Sequence
  chemically synthesized
gaacaatattacatgtctgaca

SEQ ID NO: 153363 - DNA, 22 bp, Artificial Sequence
  chemically synthesized
aacaatattacatgtctgacac

SEQ ID NO: 153364 - DNA, 22 bp, Artificial Sequence
  chemically synthesized
catgtctgacacaactgagttg

SEQ ID NO: 153365 - DNA, 22 bp, Artificial Sequence
  chemically synthesized
acacaactgagttgttggtttg

SEQ ID NO: 153366 - DNA, 22 bp, Artificial Sequence
  chemically synthesized
agttgttggtttgagagttatg

SEQ ID NO: 153367 - DNA, 22 bp, Artificial Sequence
  chemically synthesized
ttggtttgagagttatgtttaa

SEQ ID NO: 153368 - DNA, 22 bp, Artificial Sequence
  chemically synthesized
gtttgagagttatgtttaacag

SEQ ID NO: 153369 - DNA, 22 bp, Artificial Sequence
  chemically synthesized
gagagttatgtttaacagggag

SEQ ID NO: 153370 - DNA, 22 bp, Artificial Sequence
  chemically synthesized
agagttatgtttaacagggaga

SEQ ID NO: 153371 - DNA, 22 bp, Artificial Sequence
  chemically synthesized
tgtttaacagggagagtaggaa

SEQ ID NO: 153372 - DNA, 22 bp, Artificial Sequence
  chemically synthesized
aacagggagagtaggaaggctc

SEQ ID NO: 153373 - DNA, 22 bp, Artificial Sequence
  chemically synthesized
acagggagagtaggaaggctca

SEQ ID NO: 153374 - DNA, 22 bp, Artificial Sequence
  chemically synthesized
atctgaagacttcatactatga

SEQ ID NO: 153375 - DNA, 22 bp, Artificial Sequence
  chemically synthesized
aagacttcatactatgagtgtt

SEQ ID NO: 153376 - DNA, 22 bp, Artificial Sequence
  chemically synthesized
catactatgagtgtttgtgctt

SEQ ID NO: 153377 - DNA, 22 bp, Artificial Sequence
  chemically synthesized
atactatgagtgtttgtgcttc

SEQ ID NO: 153378 - DNA, 22 bp, Artificial Sequence
  chemically synthesized
tgagtgtttgtgcttcagatta

SEQ ID NO: 153379 - DNA, 22 bp, Artificial Sequence
  chemically synthesized
gtgcttcagattaggcaaccta

SEQ ID NO: 153380 - DNA, 22 bp, Artificial Sequence
  chemically synthesized
tgcttcagattaggcaacctat

SEQ ID NO: 153381 - DNA, 22 bp, Artificial Sequence
  chemically synthesized
cagattaggcaacctatagaat

SEQ ID NO: 153382 - DNA, 22 bp, Artificial Sequence
  chemically synthesized
agattaggcaacctatagaatg

SEQ ID NO: 153383 - DNA, 22 bp, Artificial Sequence
  chemically synthesized
ggcaacctatagaatgtgaacc

SEQ ID NO: 153384 - DNA, 22 bp, Artificial Sequence
  chemically synthesized
tagaatgtgaaccaaaatagtt

SEQ ID NO: 153385 - DNA, 22 bp, Artificial Sequence
  chemically synthesized
gaaataatggccgtgacaaaac

SEQ ID NO: 153386 - DNA, 22 bp, Artificial Sequence
  chemically synthesized
aaataatggccgtgacaaaaca

SEQ ID NO: 153387 - DNA, 22 bp, Artificial Sequence
  chemically synthesized
ataaaaaatacctaagagtatc

SEQ ID NO: 153388 - DNA, 22 bp, Artificial Sequence
  chemically synthesized
agagtatcctcagaaatcattg

SEQ ID NO: 153389 - DNA, 22 bp, Artificial Sequence
  chemically synthesized
agaaatcattgcttattttaga

SEQ ID NO: 153390 - DNA, 22 bp, Artificial Sequence
  chemically synthesized
cttattttagagctatataatt

SEQ ID NO: 153391 - DNA, 22 bp, Artificial Sequence
  chemically synthesized
attttagagctatataattgta

SEQ ID NO: 153392 - DNA, 22 bp, Artificial Sequence
  chemically synthesized
ttttagagctatataattgtac

SEQ ID NO: 153393 - DNA, 22 bp, Artificial Sequence
  chemically synthesized
tagagctatataattgtactat

SEQ ID NO: 153394 - DNA, 22 bp, Artificial Sequence
  chemically synthesized
agagctatataattgtactatg

SEQ ID NO: 153395 - DNA, 22 bp, Artificial Sequence
  chemically synthesized
gagctatataattgtactatga

SEQ ID NO: 153396 - DNA, 22 bp, Artificial Sequence
  chemically synthesized
tataattgtactatgatgataa

SEQ ID NO: 153397 - DNA, 22 bp, Artificial Sequence
  chemically synthesized
tactatgatgataagatttatg

SEQ ID NO: 153398 - DNA, 22 bp, Artificial Sequence
  chemically synthesized
tgatgataagatttatgaagaa

SEQ ID NO: 153399 - DNA, 22 bp, Artificial Sequence
  chemically synthesized
atgaagaacttcagaatcttta

SEQ ID NO: 153400 - DNA, 22 bp, Artificial Sequence
  chemically synthesized
tgaagaacttcagaatctttac

SEQ ID NO: 153401 - DNA, 22 bp, Artificial Sequence
  chemically synthesized
cagaatctttacaattcagcca

SEQ ID NO: 153402 - DNA, 22 bp, Artificial Sequence
  chemically synthesized
agaatctttacaattcagccaa

SEQ ID NO: 153403 - DNA, 22 bp, Artificial Sequence
  chemically synthesized
tacaattcagccaaagggagga

SEQ ID NO: 153404 - DNA, 22 bp, Artificial Sequence
  chemically synthesized
acaattcagccaaagggaggaa

SEQ ID NO: 153405 - DNA, 22 bp, Artificial Sequence
  chemically synthesized
caattcagccaaagggaggaaa

SEQ ID NO: 153406 - DNA, 22 bp, Artificial Sequence
  chemically synthesized
agccaaagggaggaaaatcagt

SEQ ID NO: 153407 - DNA, 22 bp, Artificial Sequence
  chemically synthesized
tatatgattactgggctttata

SEQ ID NO: 153408 - DNA, 22 bp, Artificial Sequence
  chemically synthesized
atatgattactgggctttatac

SEQ ID NO: 153409 - DNA, 22 bp, Artificial Sequence
  chemically synthesized
tatgattactgggctttataca

SEQ ID NO: 153410 - DNA, 22 bp, Artificial Sequence
  chemically synthesized
ctgggctttatacagaaagaaa

SEQ ID NO: 153411 - DNA, 22 bp, Artificial Sequence
  chemically synthesized
ggctttatacagaaagaaacag

SEQ ID NO: 153412 - DNA, 22 bp, Artificial Sequence
  chemically synthesized
tatacagaaagaaacaggttta

SEQ ID NO: 153413 - DNA, 22 bp, Artificial Sequence
  chemically synthesized
atacagaaagaaacaggtttag

SEQ ID NO: 153414 - DNA, 22 bp, Artificial Sequence
  chemically synthesized
tacagaaagaaacaggtttaga

SEQ ID NO: 153415 - DNA, 22 bp, Artificial Sequence
  chemically synthesized
agaacattagtagtttagattg

SEQ ID NO: 153416 - DNA, 22 bp, Artificial Sequence
  chemically synthesized
gaacattagtagtttagattgt

SEQ ID NO: 153417 - DNA, 22 bp, Artificial Sequence
  chemically synthesized
gtagtttagattgtttgttttg

SEQ ID NO: 153418 - DNA, 22 bp, Artificial Sequence
  chemically synthesized
agattgtttgttttgcaaaggc

SEQ ID NO: 153419 - DNA, 22 bp, Artificial Sequence
  chemically synthesized
gattgtttgttttgcaaaggcc

SEQ ID NO: 153420 - DNA, 22 bp, Artificial Sequence
  chemically synthesized
tttgttttgcaaaggcctctat

SEQ ID NO: 153421 - DNA, 22 bp, Artificial Sequence
  chemically synthesized
gttttgcaaaggcctctatctg

SEQ ID NO: 153422 - DNA, 22 bp, Artificial Sequence
  chemically synthesized
ttttgcaaaggcctctatctgg

SEQ ID NO: 153423 - DNA, 22 bp, Artificial Sequence
  chemically synthesized
tgcaaaggcctctatctggaag

SEQ ID NO: 153424 - DNA, 22 bp, Artificial Sequence
  chemically synthesized
gcaaaggcctctatctggaagc

SEQ ID NO: 153425 - DNA, 22 bp, Artificial Sequence
  chemically synthesized
caaaggcctctatctggaagca

SEQ ID NO: 153426 - DNA, 22 bp, Artificial Sequence
  chemically synthesized
tatctggaagcaattacttaaa

SEQ ID NO: 153427 - DNA, 22 bp, Artificial Sequence
  chemically synthesized
tctggaagcaattacttaaaaa

SEQ ID NO: 153428 - DNA, 22 bp, Artificial Sequence
  chemically synthesized
gaagcaattacttaaaaaaata

SEQ ID NO: 153429 - DNA, 22 bp, Artificial Sequence
  chemically synthesized
cttaaaaaaataactaaacctc

SEQ ID NO: 153430 - DNA, 22 bp, Artificial Sequence
  chemically synthesized
aaaaaaataactaaacctctcc

SEQ ID NO: 153431 - DNA, 22 bp, Artificial Sequence
  chemically synthesized
aaaaaataactaaacctctcct

SEQ ID NO: 153432 - DNA, 22 bp, Artificial Sequence
  chemically synthesized
aacctctcctgaggaagaaaag

SEQ ID NO: 153433 - DNA, 22 bp, Artificial Sequence
  chemically synthesized
tcctgaggaagaaaaggcaatt

SEQ ID NO: 153434 - DNA, 22 bp, Artificial Sequence
  chemically synthesized
ctgaggaagaaaaggcaatttc

SEQ ID NO: 153435 - DNA, 22 bp, Artificial Sequence
  chemically synthesized
aggaagaaaaggcaatttcaga

SEQ ID NO: 153436 - DNA, 22 bp, Artificial Sequence
  chemically synthesized
cagagacatcagcccaggtcct

SEQ ID NO: 153437 - DNA, 22 bp, Artificial Sequence
  chemically synthesized
agagacatcagcccaggtcctg

SEQ ID NO: 153438 - DNA, 22 bp, Artificial Sequence
  chemically synthesized
aaaggaagagcagatggagaca

SEQ ID NO: 153439 - DNA, 22 bp, Artificial Sequence
  chemically synthesized
aaaacactgtctgttttgaaaa

SEQ ID NO: 153440 - DNA, 22 bp, Artificial Sequence
  chemically synthesized
aaacactgtctgttttgaaaag

SEQ ID NO: 153441 - DNA, 22 bp, Artificial Sequence
  chemically synthesized
tctgttttgaaaagctacatag

SEQ ID NO: 153442 - DNA, 22 bp, Artificial Sequence
  chemically synthesized
ttttgaaaagctacatagtagc

SEQ ID NO: 153443 - DNA, 22 bp, Artificial Sequence
  chemically synthesized
tgaaaagctacatagtagccag

SEQ ID NO: 153444 - DNA, 22 bp, Artificial Sequence
  chemically synthesized
gaaaagctacatagtagccagg

SEQ ID NO: 153445 - DNA, 22 bp, Artificial Sequence
  chemically synthesized
aaaagctacatagtagccaggt

SEQ ID NO: 153446 - DNA, 22 bp, Artificial Sequence
  chemically synthesized
catagtagccaggtggagacat

SEQ ID NO: 153447 - DNA, 22 bp, Artificial Sequence
  chemically synthesized
ttccatatatctcaaaaagcca

SEQ ID NO: 153448 - DNA, 22 bp, Artificial Sequence
  chemically synthesized
tccatatatctcaaaaagccag

SEQ ID NO: 153449 - DNA, 22 bp, Artificial Sequence
  chemically synthesized
ccatatatctcaaaaagccagc

SEQ ID NO: 153450 - DNA, 22 bp, Artificial Sequence
  chemically synthesized
catatatctcaaaaagccagct

SEQ ID NO: 153451 - DNA, 22 bp, Artificial Sequence
  chemically synthesized
aaaaagccagcttctaaggaaa

SEQ ID NO: 153452 - DNA, 22 bp, Artificial Sequence
  chemically synthesized
ctaaggaaacttgttttccatg

SEQ ID NO: 153453 - DNA, 22 bp, Artificial Sequence
  chemically synthesized
taaggaaacttgttttccatga

SEQ ID NO: 153454 - DNA, 22 bp, Artificial Sequence
  chemically synthesized
aggaaacttgttttccatgaat

SEQ ID NO: 153455 - DNA, 22 bp, Artificial Sequence
  chemically synthesized
gttttccatgaattaggcaaca

SEQ ID NO: 153456 - DNA, 22 bp, Artificial Sequence
  chemically synthesized
ttttccatgaattaggcaacaa

SEQ ID NO: 153457 - DNA, 22 bp, Artificial Sequence
  chemically synthesized
tccatgaattaggcaacaacag

SEQ ID NO: 153458 - DNA, 22 bp, Artificial Sequence
  chemically synthesized
ccatgaattaggcaacaacagc

SEQ ID NO: 153459 - DNA, 22 bp, Artificial Sequence
  chemically synthesized
catgaattaggcaacaacagct

SEQ ID NO: 153460 - DNA, 22 bp, Artificial Sequence
  chemically synthesized
ggcaacaacagctgaaactgtt

SEQ ID NO: 153461 - DNA, 22 bp, Artificial Sequence
  chemically synthesized
aaactgttgttgatgtggtagc

SEQ ID NO: 153462 - DNA, 22 bp, Artificial Sequence
  chemically synthesized
ttgttgatgtggtagcctgcag

SEQ ID NO: 153463 - DNA, 22 bp, Artificial Sequence
  chemically synthesized
ttgatgtggtagcctgcagagc

SEQ ID NO: 153464 - DNA, 22 bp, Artificial Sequence
  chemically synthesized
atgtggtagcctgcagagccag

SEQ ID NO: 153465 - DNA, 22 bp, Artificial Sequence
  chemically synthesized
cagagccagtgagaagcagtta

SEQ ID NO: 153466 - DNA, 22 bp, Artificial Sequence
  chemically synthesized
tcagattcctttgtaaggcctg

SEQ ID NO: 153467 - DNA, 22 bp, Artificial Sequence
  chemically synthesized
ctttgtaaggcctgcaaggcta

SEQ ID NO: 153468 - DNA, 22 bp, Artificial Sequence
  chemically synthesized
tgtaaggcctgcaaggctacta

SEQ ID NO: 153469 - DNA, 22 bp, Artificial Sequence
  chemically synthesized
gtaaggcctgcaaggctactat

SEQ ID NO: 153470 - DNA, 22 bp, Artificial Sequence
  chemically synthesized
taaggcctgcaaggctactatc

SEQ ID NO: 153471 - DNA, 22 bp, Artificial Sequence
  chemically synthesized
caaggctactatccagcgtcac

SEQ ID NO: 153472 - DNA, 22 bp, Artificial Sequence
  chemically synthesized
ctatccagcgtcactgagaaac

SEQ ID NO: 153473 - DNA, 22 bp, Artificial Sequence
  chemically synthesized
tccagcgtcactgagaaacgtt

SEQ ID NO: 153474 - DNA, 22 bp, Artificial Sequence
  chemically synthesized
agaaacgttacgaaaacagcca

SEQ ID NO: 153475 - DNA, 22 bp, Artificial Sequence
  chemically synthesized
cgaaaacagccacagtgatgtt

SEQ ID NO: 153476 - DNA, 22 bp, Artificial Sequence
  chemically synthesized
gggaaacacagttctcttttgc

SEQ ID NO: 153477 - DNA, 22 bp, Artificial Sequence
  chemically synthesized
tcttttgcctttttttttttaa

SEQ ID NO: 153478 - DNA, 22 bp, Artificial Sequence
  chemically synthesized
ttttgcctttttttttttaata

SEQ ID NO: 153479 - DNA, 22 bp, Artificial Sequence
  chemically synthesized
ttgcctttttttttttaatagg

SEQ ID NO: 153480 - DNA, 22 bp, Artificial Sequence
  chemically synthesized
tgcctttttttttttaataggt

SEQ ID NO: 153481 - DNA, 22 bp, Artificial Sequence
  chemically synthesized
gcctttttttttttaataggta

SEQ ID NO: 153482 - DNA, 22 bp, Artificial Sequence
  chemically synthesized
cctttttttttttaataggtag

SEQ ID NO: 153483 - DNA, 22 bp, Artificial Sequence
  chemically synthesized
tttttttttaataggtagactg

SEQ ID NO: 153484 - DNA, 22 bp, Artificial Sequence
  chemically synthesized
ttttttttaataggtagactgt

SEQ ID NO: 153485 - DNA, 22 bp, Artificial Sequence
  chemically synthesized
tttttttaataggtagactgtc

SEQ ID NO: 153486 - DNA, 22 bp, Artificial Sequence
  chemically synthesized
ttttttaataggtagactgtca

SEQ ID NO: 153487 - DNA, 22 bp, Artificial Sequence
  chemically synthesized
tttttaataggtagactgtcat

SEQ ID NO: 153488 - DNA, 22 bp, Artificial Sequence
  chemically synthesized
ttttaataggtagactgtcata

SEQ ID NO: 153489 - DNA, 22 bp, Artificial Sequence
  chemically synthesized
tttaataggtagactgtcatat

SEQ ID NO: 153490 - DNA, 22 bp, Artificial Sequence
  chemically synthesized
ttaataggtagactgtcatatc

SEQ ID NO: 153491 - DNA, 22 bp, Artificial Sequence
  chemically synthesized
taataggtagactgtcatatca

SEQ ID NO: 153492 - DNA, 22 bp, Artificial Sequence
  chemically synthesized
aataggtagactgtcatatcat

SEQ ID NO: 153493 - DNA, 22 bp, Artificial Sequence
  chemically synthesized
ataggtagactgtcatatcatt

SEQ ID NO: 153494 - DNA, 22 bp, Artificial Sequence
  chemically synthesized
tcatatcattgtaactgctgcc

SEQ ID NO: 153495 - DNA, 22 bp, Artificial Sequence
  chemically synthesized
taactgctgccttaaatgaagt

SEQ ID NO: 153496 - DNA, 22 bp, Artificial Sequence
  chemically synthesized
ctgccttaaatgaagtcacggt

SEQ ID NO: 153497 - DNA, 22 bp, Artificial Sequence
  chemically synthesized
ccttaaatgaagtcacggttat

SEQ ID NO: 153498 - DNA, 22 bp, Artificial Sequence
  chemically synthesized
aaatgaagtcacggttattata

SEQ ID NO: 153499 - DNA, 22 bp, Artificial Sequence
  chemically synthesized
aatgaagtcacggttattataa

SEQ ID NO: 153500 - DNA, 22 bp, Artificial Sequence
  chemically synthesized
ttataataaggagaaaacaaaa

SEQ ID NO: 153501 - DNA, 22 bp, Artificial Sequence
  chemically synthesized
taataaggagaaaacaaaaata

SEQ ID NO: 153502 - DNA, 22 bp, Artificial Sequence
  chemically synthesized
ccgagaacaaggtgacaaaagt

SEQ ID NO: 153503 - DNA, 22 bp, Artificial Sequence
  chemically synthesized
agaaaatcagaaagtctagtcc

SEQ ID NO: 153504 - DNA, 22 bp, Artificial Sequence
  chemically synthesized
gtccattcaattgctattcatt

SEQ ID NO: 153505 - DNA, 22 bp, Artificial Sequence
  chemically synthesized
aattgctattcatttaactctt

SEQ ID NO: 153506 - DNA, 22 bp, Artificial Sequence
  chemically synthesized
ctattcatttaactcttacacc

SEQ ID NO: 153507 - DNA, 22 bp, Artificial Sequence
  chemically synthesized
ttcatttaactcttacaccgaa

SEQ ID NO: 153508 - DNA, 22 bp, Artificial Sequence
  chemically synthesized
atttaactcttacaccgaaaag

SEQ ID NO: 153509 - DNA, 22 bp, Artificial Sequence
  chemically synthesized
aactcttacaccgaaaagctaa

SEQ ID NO: 153510 - DNA, 22 bp, Artificial Sequence
  chemically synthesized
actcttacaccgaaaagctaag

SEQ ID NO: 153511 - DNA, 22 bp, Artificial Sequence
  chemically synthesized
ttacaccgaaaagctaaggtcc

SEQ ID NO: 153512 - DNA, 22 bp, Artificial Sequence
  chemically synthesized
acaccgaaaagctaaggtccag

SEQ ID NO: 153513 - DNA, 22 bp, Artificial Sequence
  chemically synthesized
caccgaaaagctaaggtccagt

SEQ ID NO: 153514 - DNA, 22 bp, Artificial Sequence
  chemically synthesized
aggtccagtgggagaaatcagt

SEQ ID NO: 153515 - DNA, 22 bp, Artificial Sequence
  chemically synthesized
ttagaagtgagaggacatgatt

SEQ ID NO: 153516 - DNA, 22 bp, Artificial Sequence
  chemically synthesized
agaagtgagaggacatgattca

SEQ ID NO: 153517 - DNA, 22 bp, Artificial Sequence
  chemically synthesized
gaagtgagaggacatgattcag

SEQ ID NO: 153518 - DNA, 22 bp, Artificial Sequence
  chemically synthesized
aggattagaaatgtgtttttag

SEQ ID NO: 153519 - DNA, 22 bp, Artificial Sequence
  chemically synthesized
gaaatgtgtttttagtaaaaat

SEQ ID NO: 153520 - DNA, 22 bp, Artificial Sequence
  chemically synthesized
ttagtaaaaatgatctgctaat

SEQ ID NO: 153521 - DNA, 22 bp, Artificial Sequence
  chemically synthesized
tagtaaaaatgatctgctaata

SEQ ID NO: 153522 - DNA, 22 bp, Artificial Sequence
  chemically synthesized
agtaaaaatgatctgctaataa

SEQ ID NO: 153523 - DNA, 22 bp, Artificial Sequence
  chemically synthesized
gtaaaaatgatctgctaataat

SEQ ID NO: 153524 - DNA, 22 bp, Artificial Sequence
  chemically synthesized
ctaataataaatccacaggcag

SEQ ID NO: 153525 - DNA, 22 bp, Artificial Sequence
  chemically synthesized
ataataaatccacaggcagatg

SEQ ID NO: 153526 - DNA, 22 bp, Artificial Sequence
  chemically synthesized
actgtacaccagcagtcttcaa

SEQ ID NO: 153527 - DNA, 22 bp, Artificial Sequence
  chemically synthesized
tacaccagcagtcttcaatgtt

SEQ ID NO: 153528 - DNA, 22 bp, Artificial Sequence
  chemically synthesized
caatgtttttggtaccagggac

SEQ ID NO: 153529 - DNA, 22 bp, Artificial Sequence
  chemically synthesized
aatgtttttggtaccagggact

SEQ ID NO: 153530 - DNA, 22 bp, Artificial Sequence
  chemically synthesized
ttggtaccagggactgcttttg

SEQ ID NO: 153531 - DNA, 22 bp, Artificial Sequence
  chemically synthesized
tggtaccagggactgcttttgt

SEQ ID NO: 153532 - DNA, 22 bp, Artificial Sequence
  chemically synthesized
ggtaccagggactgcttttgtg

SEQ ID NO: 153533 - DNA, 22 bp, Artificial Sequence
  chemically synthesized
gtaccagggactgcttttgtgg

SEQ ID NO: 153534 - DNA, 22 bp, Artificial Sequence
  chemically synthesized
cttttgtggaagacaaggtgca

SEQ ID NO: 153535 - DNA, 22 bp, Artificial Sequence
  chemically synthesized
ttgtggaagacaaggtgcagga

SEQ ID NO: 153536 - DNA, 22 bp, Artificial Sequence
  chemically synthesized
tgtggaagacaaggtgcaggag

SEQ ID NO: 153537 - DNA, 22 bp, Artificial Sequence
  chemically synthesized
gtggaagacaaggtgcaggagg

SEQ ID NO: 153538 - DNA, 22 bp, Artificial Sequence
  chemically synthesized
tggaagacaaggtgcaggaggg

SEQ ID NO: 153539 - DNA, 22 bp, Artificial Sequence
  chemically synthesized
caggatgaaactgttccacctc

SEQ ID NO: 153540 - DNA, 22 bp, Artificial Sequence
  chemically synthesized
aggatgaaactgttccacctca

SEQ ID NO: 153541 - DNA, 22 bp, Artificial Sequence
  chemically synthesized
ttccacctcagagcattaggca

SEQ ID NO: 153542 - DNA, 22 bp, Artificial Sequence
  chemically synthesized
cacctcagagcattaggcatta

SEQ ID NO: 153543 - DNA, 22 bp, Artificial Sequence
  chemically synthesized
agagcattaggcattagattct

SEQ ID NO: 153544 - DNA, 22 bp, Artificial Sequence
  chemically synthesized
ggcattagattctcataagaag

SEQ ID NO: 153545 - DNA, 22 bp, Artificial Sequence
  chemically synthesized
gattctcataagaagccgcaac

SEQ ID NO: 153546 - DNA, 22 bp, Artificial Sequence
  chemically synthesized
tcataagaagccgcaacctaga

SEQ ID NO: 153547 - DNA, 22 bp, Artificial Sequence
  chemically synthesized
ataagaagccgcaacctagatc

SEQ ID NO: 153548 - DNA, 22 bp, Artificial Sequence
  chemically synthesized
gatcccttgcatgcctctatga

SEQ ID NO: 153549 - DNA, 22 bp, Artificial Sequence
  chemically synthesized
gcatgcctctatgagaatctaa

SEQ ID NO: 153550 - DNA, 22 bp, Artificial Sequence
  chemically synthesized
catgcctctatgagaatctaat

SEQ ID NO: 153551 - DNA, 22 bp, Artificial Sequence
  chemically synthesized
tatgagaatctaatgccgccac

SEQ ID NO: 153552 - DNA, 22 bp, Artificial Sequence
  chemically synthesized
tgagaatctaatgccgccactg

SEQ ID NO: 153553 - DNA, 22 bp, Artificial Sequence
  chemically synthesized
atgccgccactgccgatgtgac

SEQ ID NO: 153554 - DNA, 22 bp, Artificial Sequence
  chemically synthesized
ccgatgtgacaggaggaggagc

SEQ ID NO: 153555 - DNA, 22 bp, Artificial Sequence
  chemically synthesized
aggcagtaatgcttgctcatcc

SEQ ID NO: 153556 - DNA, 22 bp, Artificial Sequence
  chemically synthesized
gctcatccccctgctgtgagac

SEQ ID NO: 153557 - DNA, 22 bp, Artificial Sequence
  chemically synthesized
ctcatccccctgctgtgagacc

SEQ ID NO: 153558 - DNA, 22 bp, Artificial Sequence
  chemically synthesized
atccccctgctgtgagaccagg

SEQ ID NO: 153559 - DNA, 22 bp, Artificial Sequence
  chemically synthesized
ctgtgagaccaggttcctagca

SEQ ID NO: 153560 - DNA, 22 bp, Artificial Sequence
  chemically synthesized
tgagaccaggttcctagcaggc

SEQ ID NO: 153561 - DNA, 22 bp, Artificial Sequence
  chemically synthesized
ctagcaggccacggaccagtac

SEQ ID NO: 153562 - DNA, 22 bp, Artificial Sequence
  chemically synthesized
gcaggccacggaccagtactgg

SEQ ID NO: 153563 - DNA, 22 bp, Artificial Sequence
  chemically synthesized
gtaagtggccaggactgctcta

SEQ ID NO: 153564 - DNA, 22 bp, Artificial Sequence
  chemically synthesized
ctctacactatacctccctatt

SEQ ID NO: 153565 - DNA, 22 bp, Artificial Sequence
  chemically synthesized
tacactatacctccctattttc

SEQ ID NO: 153566 - DNA, 22 bp, Artificial Sequence
  chemically synthesized
cactatacctccctattttcct

SEQ ID NO: 153567 - DNA, 22 bp, Artificial Sequence
  chemically synthesized
tacctccctattttcctaggct

SEQ ID NO: 153568 - DNA, 22 bp, Artificial Sequence
  chemically synthesized
cctattttcctaggcttatcaa

SEQ ID NO: 153569 - DNA, 22 bp, Artificial Sequence
  chemically synthesized
ttttcctaggcttatcaaaatc

SEQ ID NO: 153570 - DNA, 22 bp, Artificial Sequence
  chemically synthesized
tcctaggcttatcaaaatcgta

SEQ ID NO: 153571 - DNA, 22 bp, Artificial Sequence
  chemically synthesized
cctaggcttatcaaaatcgtat

SEQ ID NO: 153572 - DNA, 22 bp, Artificial Sequence
  chemically synthesized
ctaggcttatcaaaatcgtatt

SEQ ID NO: 153573 - DNA, 22 bp, Artificial Sequence
  chemically synthesized
ggcttatcaaaatcgtattgtt

SEQ ID NO: 153574 - DNA, 22 bp, Artificial Sequence
  chemically synthesized
atcaaaatcgtattgttaaaca

SEQ ID NO: 153575 - DNA, 22 bp, Artificial Sequence
  chemically synthesized
tcaaaatcgtattgttaaacag

SEQ ID NO: 153576 - DNA, 22 bp, Artificial Sequence
  chemically synthesized
ttaaacagacttaagagatgtt

SEQ ID NO: 153577 - DNA, 22 bp, Artificial Sequence
  chemically synthesized
aacagacttaagagatgttcta

SEQ ID NO: 153578 - DNA, 22 bp, Artificial Sequence
  chemically synthesized
aagagatgttctacttgaggtt

SEQ ID NO: 153579 - DNA, 22 bp, Artificial Sequence
  chemically synthesized
agagatgttctacttgaggttg

SEQ ID NO: 153580 - DNA, 22 bp, Artificial Sequence
  chemically synthesized
tacttgaggttgtgtctccatt

SEQ ID NO: 153581 - DNA, 22 bp, Artificial Sequence
  chemically synthesized
cttgaggttgtgtctccattcc

SEQ ID NO: 153582 - DNA, 22 bp, Artificial Sequence
  chemically synthesized
gaggttgtgtctccattcccta

SEQ ID NO: 153583 - DNA, 22 bp, Artificial Sequence
  chemically synthesized
aggttgtgtctccattccctag

SEQ ID NO: 153584 - DNA, 22 bp, Artificial Sequence
  chemically synthesized
tgtctccattccctaggatatt

SEQ ID NO: 153585 - DNA, 22 bp, Artificial Sequence
  chemically synthesized
cattccctaggatatttgttac

SEQ ID NO: 153586 - DNA, 22 bp, Artificial Sequence
  chemically synthesized
cctaggatatttgttaccatta

SEQ ID NO: 153587 - DNA, 22 bp, Artificial Sequence
  chemically synthesized
ggatatttgttaccattacttg

SEQ ID NO: 153588 - DNA, 22 bp, Artificial Sequence
  chemically synthesized
gttaccattacttgcagaagat

SEQ ID NO: 153589 - DNA, 22 bp, Artificial Sequence
  chemically synthesized
ttaccattacttgcagaagata

SEQ ID NO: 153590 - DNA, 22 bp, Artificial Sequence
  chemically synthesized
ccattacttgcagaagataatt

SEQ ID NO: 153591 - DNA, 22 bp, Artificial Sequence
  chemically synthesized
cttgcagaagataattgctaga

SEQ ID NO: 153592 - DNA, 22 bp, Artificial Sequence
  chemically synthesized
gcagaagataattgctagagta

SEQ ID NO: 153593 - DNA, 22 bp, Artificial Sequence
  chemically synthesized
cagaagataattgctagagtag

SEQ ID NO: 153594 - DNA, 22 bp, Artificial Sequence
  chemically synthesized
ctagagtagtgaatagaggcct

SEQ ID NO: 153595 - DNA, 22 bp, Artificial Sequence
  chemically synthesized
gagtagtgaatagaggcctcca

SEQ ID NO: 153596 - DNA, 22 bp, Artificial Sequence
  chemically synthesized
cagatgaaggaaataaaaatag

SEQ ID NO: 153597 - DNA, 22 bp, Artificial Sequence
  chemically synthesized
tcccagaagtctcttgcagaaa

SEQ ID NO: 153598 - DNA, 22 bp, Artificial Sequence
  chemically synthesized
cccagaagtctcttgcagaaac

SEQ ID NO: 153599 - DNA, 22 bp, Artificial Sequence
  chemically synthesized
ccagaagtctcttgcagaaact

SEQ ID NO: 153600 - DNA, 22 bp, Artificial Sequence
  chemically synthesized
ttgcagaaacttaaaaattaat

SEQ ID NO: 153601 - DNA, 22 bp, Artificial Sequence
  chemically synthesized
gcagaaacttaaaaattaatgc

SEQ ID NO: 153602 - DNA, 22 bp, Artificial Sequence
  chemically synthesized
cagaaacttaaaaattaatgcc

SEQ ID NO: 153603 - DNA, 22 bp, Artificial Sequence
  chemically synthesized
aaaaattaatgccaacctagcc

SEQ ID NO: 153604 - DNA, 22 bp, Artificial Sequence
  chemically synthesized
aaaattaatgccaacctagcca

SEQ ID NO: 153605 - DNA, 22 bp, Artificial Sequence
  chemically synthesized
atgccaacctagccaagaacac

SEQ ID NO: 153606 - DNA, 22 bp, Artificial Sequence
  chemically synthesized
gccaagaacacccctgcagtag

SEQ ID NO: 153607 - DNA, 22 bp, Artificial Sequence
  chemically synthesized
cagtaggagtcgatgtcctaaa

SEQ ID NO: 153608 - DNA, 22 bp, Artificial Sequence
  chemically synthesized
aagcttttccagtaaaagtgtg

SEQ ID NO: 153609 - DNA, 22 bp, Artificial Sequence
  chemically synthesized
ttccagtaaaagtgtggtttct

SEQ ID NO: 153610 - DNA, 22 bp, Artificial Sequence
  chemically synthesized
tccagtaaaagtgtggtttctg

SEQ ID NO: 153611 - DNA, 22 bp, Artificial Sequence
  chemically synthesized
ccagtaaaagtgtggtttctgc

SEQ ID NO: 153612 - DNA, 22 bp, Artificial Sequence
  chemically synthesized
cagtaaaagtgtggtttctgcc

SEQ ID NO: 153613 - DNA, 22 bp, Artificial Sequence
  chemically synthesized
ctgcccctgcagtcttggcacc

SEQ ID NO: 153614 - DNA, 22 bp, Artificial Sequence
  chemically synthesized
tgcccctgcagtcttggcacca

SEQ ID NO: 153615 - DNA, 22 bp, Artificial Sequence
  chemically synthesized
cccctgcagtcttggcaccatg

SEQ ID NO: 153616 - DNA, 22 bp, Artificial Sequence
  chemically synthesized
cagtcttggcaccatgtaatgg

SEQ ID NO: 153617 - DNA, 22 bp, Artificial Sequence
  chemically synthesized
ggcaccatgtaatggcacatag

SEQ ID NO: 153618 - DNA, 22 bp, Artificial Sequence
  chemically synthesized
gcaccatgtaatggcacataga

SEQ ID NO: 153619 - DNA, 22 bp, Artificial Sequence
  chemically synthesized
tcaggttgcagccagaactgag

SEQ ID NO: 153620 - DNA, 22 bp, Artificial Sequence
  chemically synthesized
caggttgcagccagaactgagg

SEQ ID NO: 153621 - DNA, 22 bp, Artificial Sequence
  chemically synthesized
aggttgcagccagaactgagga

SEQ ID NO: 153622 - DNA, 22 bp, Artificial Sequence
  chemically synthesized
cagccagaactgaggaatcaat

SEQ ID NO: 153623 - DNA, 22 bp, Artificial Sequence
  chemically synthesized
aggaatcaatcggtgtttagct

SEQ ID NO: 153624 - DNA, 22 bp, Artificial Sequence
  chemically synthesized
agcttttgagatgctggtaatg

SEQ ID NO: 153625 - DNA, 22 bp, Artificial Sequence
  chemically synthesized
gcttttgagatgctggtaatgt

SEQ ID NO: 153626 - DNA, 22 bp, Artificial Sequence
  chemically synthesized
ttgagatgctggtaatgttctc

SEQ ID NO: 153627 - DNA, 22 bp, Artificial Sequence
  chemically synthesized
tgagatgctggtaatgttctct

SEQ ID NO: 153628 - DNA, 22 bp, Artificial Sequence
  chemically synthesized
gagatgctggtaatgttctctt

SEQ ID NO: 153629 - DNA, 22 bp, Artificial Sequence
  chemically synthesized
agatgctggtaatgttctcttt

SEQ ID NO: 153630 - DNA, 22 bp, Artificial Sequence
  chemically synthesized
gtaatgttctctttcttggtct

SEQ ID NO: 153631 - DNA, 22 bp, Artificial Sequence
  chemically synthesized
tctttcttggtctgagtgtttg

SEQ ID NO: 153632 - DNA, 22 bp, Artificial Sequence
  chemically synthesized
tttcttggtctgagtgtttgtt

SEQ ID NO: 153633 - DNA, 22 bp, Artificial Sequence
  chemically synthesized
tcttggtctgagtgtttgttaa

SEQ ID NO: 153634 - DNA, 22 bp, Artificial Sequence
  chemically synthesized
cttggtctgagtgtttgttaaa

SEQ ID NO: 153635 - DNA, 22 bp, Artificial Sequence
  chemically synthesized
ttggtctgagtgtttgttaaaa

SEQ ID NO: 153636 - DNA, 22 bp, Artificial Sequence
  chemically synthesized
ggtctgagtgtttgttaaaagc

SEQ ID NO: 153637 - DNA, 22 bp, Artificial Sequence
  chemically synthesized
gtctgagtgtttgttaaaagct

SEQ ID NO: 153638 - DNA, 22 bp, Artificial Sequence
  chemically synthesized
agtgtttgttaaaagcttttgc

SEQ ID NO: 153639 - DNA, 22 bp, Artificial Sequence
  chemically synthesized
gttaaaagcttttgctaatttt

SEQ ID NO: 153640 - DNA, 22 bp, Artificial Sequence
  chemically synthesized
ttaaaagcttttgctaattttg

SEQ ID NO: 153641 - DNA, 22 bp, Artificial Sequence
  chemically synthesized
aaagcttttgctaattttgtgt

SEQ ID NO: 153642 - DNA, 22 bp, Artificial Sequence
  chemically synthesized
ttgctaattttgtgtcaattta

SEQ ID NO: 153643 - DNA, 22 bp, Artificial Sequence
  chemically synthesized
tgctaattttgtgtcaatttaa

SEQ ID NO: 153644 - DNA, 22 bp, Artificial Sequence
  chemically synthesized
gctaattttgtgtcaatttaac

SEQ ID NO: 153645 - DNA, 22 bp, Artificial Sequence
  chemically synthesized
ctaattttgtgtcaatttaaca

SEQ ID NO: 153646 - DNA, 22 bp, Artificial Sequence
  chemically synthesized
attttgtgtcaatttaacaaac

SEQ ID NO: 153647 - DNA, 22 bp, Artificial Sequence
  chemically synthesized
tgtgtcaatttaacaaactgta

SEQ ID NO: 153648 - DNA, 22 bp, Artificial Sequence
  chemically synthesized
gtgtcaatttaacaaactgtac

SEQ ID NO: 153649 - DNA, 22 bp, Artificial Sequence
  chemically synthesized
tgtcaatttaacaaactgtact

SEQ ID NO: 153650 - DNA, 22 bp, Artificial Sequence
  chemically synthesized
aacaaactgtacttttatttat

SEQ ID NO: 153651 - DNA, 22 bp, Artificial Sequence
  chemically synthesized
acaaactgtacttttatttatg

SEQ ID NO: 153652 - DNA, 22 bp, Artificial Sequence
  chemically synthesized
tacttttatttatgtatttttc

SEQ ID NO: 153653 - DNA, 22 bp, Artificial Sequence
  chemically synthesized
ttatttatgtatttttctgtac

SEQ ID NO: 153654 - DNA, 22 bp, Artificial Sequence
  chemically synthesized
tatttatgtatttttctgtact

SEQ ID NO: 153655 - DNA, 22 bp, Artificial Sequence
  chemically synthesized
atttatgtatttttctgtactg

SEQ ID NO: 153656 - DNA, 22 bp, Artificial Sequence
  chemically synthesized
tttatgtatttttctgtactga

SEQ ID NO: 153657 - DNA, 22 bp, Artificial Sequence
  chemically synthesized
atgtatttttctgtactgaata

SEQ ID NO: 153658 - DNA, 22 bp, Artificial Sequence
  chemically synthesized
tgtatttttctgtactgaataa

SEQ ID NO: 153659 - DNA, 22 bp, Artificial Sequence
  chemically synthesized
ttctgtactgaataataaaata

SEQ ID NO: 153660 - DNA, 22 bp, Artificial Sequence
  chemically synthesized
tctgtactgaataataaaatat

SEQ ID NO: 153661 - DNA, 22 bp, Artificial Sequence
  chemically synthesized
ctgtactgaataataaaatata

SEQ ID NO: 153662 - DNA, 22 bp, Artificial Sequence
  chemically synthesized
tgtactgaataataaaatataa

SEQ ID NO: 153663 - DNA, 22 bp, Artificial Sequence
  chemically synthesized
tactgaataataaaatataaat

SEQ ID NO: 153664 - DNA, 22 bp, Artificial Sequence
  chemically synthesized
aataataaaatataaatttaag

SEQ ID NO: 153665 - DNA, 22 bp, Artificial Sequence
  chemically synthesized
aagaaatatgagtgaaagtgtc

SEQ ID NO: 153666 - DNA, 22 bp, Artificial Sequence
  chemically synthesized
agaaatatgagtgaaagtgtca

SEQ ID NO: 153667 - DNA, 22 bp, Artificial Sequence
  chemically synthesized
acatataaacctggcagactga

SEQ ID NO: 153668 - DNA, 22 bp, Artificial Sequence
  chemically synthesized
catataaacctggcagactgaa

SEQ ID NO: 153669 - DNA, 22 bp, Artificial Sequence
  chemically synthesized
gcagactgaatatgtgttcatt

SEQ ID NO: 153670 - DNA, 22 bp, Artificial Sequence
  chemically synthesized
aatatgtgttcatttctgctac

SEQ ID NO: 153671 - DNA, 22 bp, Artificial Sequence
  chemically synthesized
atttctgctactttctctaatc

SEQ ID NO: 153672 - DNA, 22 bp, Artificial Sequence
  chemically synthesized
ctgctactttctctaatccact

SEQ ID NO: 153673 - DNA, 22 bp, Artificial Sequence
  chemically synthesized
tgctactttctctaatccacta

SEQ ID NO: 153674 - DNA, 22 bp, Artificial Sequence
  chemically synthesized
ctactttctctaatccactaaa

SEQ ID NO: 153675 - DNA, 22 bp, Artificial Sequence
  chemically synthesized
ctttctctaatccactaaagct

SEQ ID NO: 153676 - DNA, 22 bp, Artificial Sequence
  chemically synthesized
tctctaatccactaaagctata

SEQ ID NO: 153677 - DNA, 22 bp, Artificial Sequence
  chemically synthesized
ctctaatccactaaagctatag

SEQ ID NO: 153678 - DNA, 22 bp, Artificial Sequence
  chemically synthesized
tctaatccactaaagctataga

SEQ ID NO: 153679 - DNA, 22 bp, Artificial Sequence
  chemically synthesized
taatccactaaagctatagatg

SEQ ID NO: 153680 - DNA, 22 bp, Artificial Sequence
  chemically synthesized
atccactaaagctatagatgta

SEQ ID NO: 153681 - DNA, 22 bp, Artificial Sequence
  chemically synthesized
aagctatagatgtacacagaga

SEQ ID NO: 153682 - DNA, 22 bp, Artificial Sequence
  chemically synthesized
tagatgtacacagagacactgt

SEQ ID NO: 153683 - DNA, 22 bp, Artificial Sequence
  chemically synthesized
tgaagaaaatagcacaatatgt

SEQ ID NO: 153684 - DNA, 22 bp, Artificial Sequence
  chemically synthesized
ataagtatatacatttaaatat

SEQ ID NO: 153685 - DNA, 22 bp, Artificial Sequence
  chemically synthesized
aaatatgattttttaaaaaaca

SEQ ID NO: 153686 - DNA, 22 bp, Artificial Sequence
  chemically synthesized
aatatgattttttaaaaaacag

SEQ ID NO: 153687 - DNA, 22 bp, Artificial Sequence
  chemically synthesized
tttaaaaaacagaacaggataa

SEQ ID NO: 153688 - DNA, 22 bp, Artificial Sequence
  chemically synthesized
ttaaaaaacagaacaggataat

SEQ ID NO: 153689 - DNA, 22 bp, Artificial Sequence
  chemically synthesized
taaaaaacagaacaggataatc

SEQ ID NO: 153690 - DNA, 22 bp, Artificial Sequence
  chemically synthesized
aaaaaacagaacaggataatct

SEQ ID NO: 153691 - DNA, 22 bp, Artificial Sequence
  chemically synthesized
aaaaacagaacaggataatctg

SEQ ID NO: 153692 - DNA, 22 bp, Artificial Sequence
  chemically synthesized
aaatctatatgtctacagaaaa

SEQ ID NO: 153693 - DNA, 22 bp, Artificial Sequence
  chemically synthesized
tatgtctacagaaaaggatacc

SEQ ID NO: 153694 - DNA, 22 bp, Artificial Sequence
  chemically synthesized
cagaaaaggataccaatgagaa

SEQ ID NO: 153695 - DNA, 22 bp, Artificial Sequence
  chemically synthesized
tctgcaaagagcattttctgga

SEQ ID NO: 153696 - DNA, 22 bp, Artificial Sequence
  chemically synthesized
caaagagcattttctggaaaaa

SEQ ID NO: 153697 - DNA, 22 bp, Artificial Sequence
  chemically synthesized
tctggaaaaacacagaaattac

SEQ ID NO: 153698 - DNA, 22 bp, Artificial Sequence
  chemically synthesized
ctggaaaaacacagaaattact

SEQ ID NO: 153699 - DNA, 22 bp, Artificial Sequence
  chemically synthesized
tggaaaaacacagaaattactt

SEQ ID NO: 153700 - DNA, 22 bp, Artificial Sequence
  chemically synthesized
gaaaaacacagaaattacttat

SEQ ID NO: 153701 - DNA, 22 bp, Artificial Sequence
  chemically synthesized
cttataaagcattcgtgagggg

SEQ ID NO: 153702 - DNA, 22 bp, Artificial Sequence
  chemically synthesized
ataaagcattcgtgaggggtag

SEQ ID NO: 153703 - DNA, 22 bp, Artificial Sequence
  chemically synthesized
taaagcattcgtgaggggtagg

SEQ ID NO: 153704 - DNA, 22 bp, Artificial Sequence
  chemically synthesized
gtgaggggtagggctaaaaatg

SEQ ID NO: 153705 - DNA, 22 bp, Artificial Sequence
  chemically synthesized
aaaatggtagaaaaggtgaata

SEQ ID NO: 153706 - DNA, 22 bp, Artificial Sequence
  chemically synthesized
tttaaggttgcctaaaagatag

SEQ ID NO: 153707 - DNA, 22 bp, Artificial Sequence
  chemically synthesized
aaggttgcctaaaagatagcca

SEQ ID NO: 153708 - DNA, 22 bp, Artificial Sequence
  chemically synthesized
aggttgcctaaaagatagccag

SEQ ID NO: 153709 - DNA, 22 bp, Artificial Sequence
  chemically synthesized
cctaaaagatagccaggtactc

SEQ ID NO: 153710 - DNA, 22 bp, Artificial Sequence
  chemically synthesized
aaagatagccaggtactcattt

SEQ ID NO: 153711 - DNA, 22 bp, Artificial Sequence
  chemically synthesized
atttctctttagttctggcaaa

SEQ ID NO: 153712 - DNA, 22 bp, Artificial Sequence
  chemically synthesized
ctctttagttctggcaaaatga

SEQ ID NO: 153713 - DNA, 22 bp, Artificial Sequence
  chemically synthesized
tctttagttctggcaaaatgat

SEQ ID NO: 153714 - DNA, 22 bp, Artificial Sequence
  chemically synthesized
tttagttctggcaaaatgatta

SEQ ID NO: 153715 - DNA, 22 bp, Artificial Sequence
  chemically synthesized
tagttctggcaaaatgattagt

SEQ ID NO: 153716 - DNA, 22 bp, Artificial Sequence
  chemically synthesized
agttctggcaaaatgattagtg

SEQ ID NO: 153717 - DNA, 22 bp, Artificial Sequence
  chemically synthesized
gttctggcaaaatgattagtgt

SEQ ID NO: 153718 - DNA, 22 bp, Artificial Sequence
  chemically synthesized
tggcaaaatgattagtgtctgt

SEQ ID NO: 153719 - DNA, 22 bp, Artificial Sequence
  chemically synthesized
gcaaaatgattagtgtctgtag

SEQ ID NO: 153720 - DNA, 22 bp, Artificial Sequence
  chemically synthesized
gtgtctgtagtaaccaaatcaa

SEQ ID NO: 153721 - DNA, 22 bp, Artificial Sequence
  chemically synthesized
tagtaaccaaatcaatgatgat

SEQ ID NO: 153722 - DNA, 22 bp, Artificial Sequence
  chemically synthesized
ggaaattcagtgcaaaggatgc

SEQ ID NO: 153723 - DNA, 22 bp, Artificial Sequence
  chemically synthesized
agtgcaaaggatgccaggacta

SEQ ID NO: 153724 - DNA, 22 bp, Artificial Sequence
  chemically synthesized
aggtgtaatatatgaaacagag

SEQ ID NO: 153725 - DNA, 22 bp, Artificial Sequence
  chemically synthesized
tgcaaaagaatacatattgaat

SEQ ID NO: 153726 - DNA, 22 bp, Artificial Sequence
  chemically synthesized
aatgatgataaactgtctcaag

SEQ ID NO: 153727 - DNA, 22 bp, Artificial Sequence
  chemically synthesized
tctcaagagaaaggactaatag

SEQ ID NO: 153728 - DNA, 22 bp, Artificial Sequence
  chemically synthesized
aagagaaaggactaatagatat

SEQ ID NO: 153729 - DNA, 22 bp, Artificial Sequence
  chemically synthesized
atagatattggcatttgagtat

SEQ ID NO: 153730 - DNA, 22 bp, Artificial Sequence
  chemically synthesized
gcatttgagtattcgcttactg

SEQ ID NO: 153731 - DNA, 22 bp, Artificial Sequence
  chemically synthesized
gagtattcgcttactggattag

SEQ ID NO: 153732 - DNA, 22 bp, Artificial Sequence
  chemically synthesized
agtattcgcttactggattagc

SEQ ID NO: 153733 - DNA, 22 bp, Artificial Sequence
  chemically synthesized
gcttactggattagctaggctt

SEQ ID NO: 153734 - DNA, 22 bp, Artificial Sequence
  chemically synthesized
actggattagctaggcttcttt

SEQ ID NO: 153735 - DNA, 22 bp, Artificial Sequence
  chemically synthesized
ctggattagctaggcttctttc

SEQ ID NO: 153736 - DNA, 22 bp, Artificial Sequence
  chemically synthesized
gattagctaggcttctttctga

SEQ ID NO: 153737 - DNA, 22 bp, Artificial Sequence
  chemically synthesized
gctaggcttctttctgatcagc

SEQ ID NO: 153738 - DNA, 22 bp, Artificial Sequence
  chemically synthesized
ggcttctttctgatcagccttc

SEQ ID NO: 153739 - DNA, 22 bp, Artificial Sequence
  chemically synthesized
ctttctgatcagccttcaaagt

SEQ ID NO: 153740 - DNA, 22 bp, Artificial Sequence
  chemically synthesized
tttctgatcagccttcaaagta

SEQ ID NO: 153741 - DNA, 22 bp, Artificial Sequence
  chemically synthesized
tctgatcagccttcaaagtaac

SEQ ID NO: 153742 - DNA, 22 bp, Artificial Sequence
  chemically synthesized
ctgatcagccttcaaagtaact

SEQ ID NO: 153743 - DNA, 22 bp, Artificial Sequence
  chemically synthesized
tgatcagccttcaaagtaactg

SEQ ID NO: 153744 - DNA, 22 bp, Artificial Sequence
  chemically synthesized
atcagccttcaaagtaactggc

SEQ ID NO: 153745 - DNA, 22 bp, Artificial Sequence
  chemically synthesized
caaagtaactggccagataact

SEQ ID NO: 153746 - DNA, 22 bp, Artificial Sequence
  chemically synthesized
aaagtaactggccagataacta

SEQ ID NO: 153747 - DNA, 22 bp, Artificial Sequence
  chemically synthesized
gccagataactaattgtaccgt

SEQ ID NO: 153748 - DNA, 22 bp, Artificial Sequence
  chemically synthesized
attgtaccgtgttcatagaaat

SEQ ID NO: 153749 - DNA, 22 bp, Artificial Sequence
  chemically synthesized
taccgtgttcatagaaatcccc

SEQ ID NO: 153750 - DNA, 22 bp, Artificial Sequence
  chemically synthesized
atagaaatccccactatactct

SEQ ID NO: 153751 - DNA, 22 bp, Artificial Sequence
  chemically synthesized
tactctttttaaaattatttta

SEQ ID NO: 153752 - DNA, 22 bp, Artificial Sequence
  chemically synthesized
tttttaaaattattttatttta

SEQ ID NO: 153753 - DNA, 22 bp, Artificial Sequence
  chemically synthesized
tttaaaattattttattttatt

SEQ ID NO: 153754 - DNA, 22 bp, Artificial Sequence
  chemically synthesized
ttaaaattattttattttatta

SEQ ID NO: 153755 - DNA, 22 bp, Artificial Sequence
  chemically synthesized
taaaattattttattttattat

SEQ ID NO: 153756 - DNA, 22 bp, Artificial Sequence
  chemically synthesized
aaaattattttattttattatt

SEQ ID NO: 153757 - DNA, 22 bp, Artificial Sequence
  chemically synthesized
aaattattttattttattatta

SEQ ID NO: 153758 - DNA, 22 bp, Artificial Sequence
  chemically synthesized
ttttattttattattattatac

SEQ ID NO: 153759 - DNA, 22 bp, Artificial Sequence
  chemically synthesized
tattttattattattatacttt

SEQ ID NO: 153760 - DNA, 22 bp, Artificial Sequence
  chemically synthesized
attttattattattatacttta

SEQ ID NO: 153761 - DNA, 22 bp, Artificial Sequence
  chemically synthesized
ttttattattattatactttaa

SEQ ID NO: 153762 - DNA, 22 bp, Artificial Sequence
  chemically synthesized
tattattattatactttaagtt

SEQ ID NO: 153763 - DNA, 22 bp, Artificial Sequence
  chemically synthesized
attattattatactttaagttt

SEQ ID NO: 153764 - DNA, 22 bp, Artificial Sequence
  chemically synthesized
ttattattatactttaagtttt

SEQ ID NO: 153765 - DNA, 22 bp, Artificial Sequence
  chemically synthesized
ttattatactttaagttttagg

SEQ ID NO: 153766 - DNA, 22 bp, Artificial Sequence
  chemically synthesized
ttatactttaagttttagggta

SEQ ID NO: 153767 - DNA, 22 bp, Artificial Sequence
  chemically synthesized
tactttaagttttagggtacat

SEQ ID NO: 153768 - DNA, 22 bp, Artificial Sequence
  chemically synthesized
taagttttagggtacatgtgca

SEQ ID NO: 153769 - DNA, 22 bp, Artificial Sequence
  chemically synthesized
aagttttagggtacatgtgcac

SEQ ID NO: 153770 - DNA, 22 bp, Artificial Sequence
  chemically synthesized
agttttagggtacatgtgcaca

SEQ ID NO: 153771 - DNA, 22 bp, Artificial Sequence
  chemically synthesized
tagggtacatgtgcacaatgtg

SEQ ID NO: 153772 - DNA, 22 bp, Artificial Sequence
  chemically synthesized
agggtacatgtgcacaatgtgc

SEQ ID NO: 153773 - DNA, 22 bp, Artificial Sequence
  chemically synthesized
gggtacatgtgcacaatgtgca

SEQ ID NO: 153774 - DNA, 22 bp, Artificial Sequence
  chemically synthesized
gttacatatgtatacatgtgcc

SEQ ID NO: 153775 - DNA, 22 bp, Artificial Sequence
  chemically synthesized
catatgtatacatgtgccatgc

SEQ ID NO: 153776 - DNA, 22 bp, Artificial Sequence
  chemically synthesized
gtgtgcttcacccattaactca

SEQ ID NO: 153777 - DNA, 22 bp, Artificial Sequence
  chemically synthesized
cacccattaactcatcatttag

SEQ ID NO: 153778 - DNA, 22 bp, Artificial Sequence
  chemically synthesized
acccattaactcatcatttagc

SEQ ID NO: 153779 - DNA, 22 bp, Artificial Sequence
  chemically synthesized
actcatcatttagcattaggta

SEQ ID NO: 153780 - DNA, 22 bp, Artificial Sequence
  chemically synthesized
atcatttagcattaggtatatc

SEQ ID NO: 153781 - DNA, 22 bp, Artificial Sequence
  chemically synthesized
agcattaggtatatctcctaat

SEQ ID NO: 153782 - DNA, 22 bp, Artificial Sequence
  chemically synthesized
gcattaggtatatctcctaatg

SEQ ID NO: 153783 - DNA, 22 bp, Artificial Sequence
  chemically synthesized
ggtatatctcctaatgctatcc

SEQ ID NO: 153784 - DNA, 22 bp, Artificial Sequence
  chemically synthesized
ctaatgctatccctcctccctc

SEQ ID NO: 153785 - DNA, 22 bp, Artificial Sequence
  chemically synthesized
atgctatccctcctccctcccc

SEQ ID NO: 153786 - DNA, 22 bp, Artificial Sequence
  chemically synthesized
tccctcctccctccccccaccc

SEQ ID NO: 153787 - DNA, 22 bp, Artificial Sequence
  chemically synthesized
ctccctccccccaccccacaac

SEQ ID NO: 153788 - DNA, 22 bp, Artificial Sequence
  chemically synthesized
cctccccccaccccacaacagt

SEQ ID NO: 153789 - DNA, 22 bp, Artificial Sequence
  chemically synthesized
cccccaccccacaacagtcccc

SEQ ID NO: 153790 - DNA, 22 bp, Artificial Sequence
  chemically synthesized
cccttcctgtgtccatgtgttc

SEQ ID NO: 153791 - DNA, 22 bp, Artificial Sequence
  chemically synthesized
cctgtgtccatgtgttctcatt

SEQ ID NO: 153792 - DNA, 22 bp, Artificial Sequence
  chemically synthesized
ctgtgtccatgtgttctcattg

SEQ ID NO: 153793 - DNA, 22 bp, Artificial Sequence
  chemically synthesized
tgtccatgtgttctcattgttc

SEQ ID NO: 153794 - DNA, 22 bp, Artificial Sequence
  chemically synthesized
tcattgttcaattcccacctat

SEQ ID NO: 153795 - DNA, 22 bp, Artificial Sequence
  chemically synthesized
attgttcaattcccacctatga

SEQ ID NO: 153796 - DNA, 22 bp, Artificial Sequence
  chemically synthesized
ttcaattcccacctatgagtga

SEQ ID NO: 153797 - DNA, 22 bp, Artificial Sequence
  chemically synthesized
aattcccacctatgagtgagaa

SEQ ID NO: 153798 - DNA, 22 bp, Artificial Sequence
  chemically synthesized
ccacctatgagtgagaacatgc

SEQ ID NO: 153799 - DNA, 22 bp, Artificial Sequence
  chemically synthesized
tgagtgagaacatgcagtgttt

SEQ ID NO: 153800 - DNA, 22 bp, Artificial Sequence
  chemically synthesized
ggtttttcgtccttgcgatagt

SEQ ID NO: 153801 - DNA, 22 bp, Artificial Sequence
  chemically synthesized
gtttttcgtccttgcgatagtt

SEQ ID NO: 153802 - DNA, 22 bp, Artificial Sequence
  chemically synthesized
ttcgtccttgcgatagtttact

SEQ ID NO: 153803 - DNA, 22 bp, Artificial Sequence
  chemically synthesized
tcgtccttgcgatagtttactg

SEQ ID NO: 153804 - DNA, 22 bp, Artificial Sequence
  chemically synthesized
cgtccttgcgatagtttactga

SEQ ID NO: 153805 - DNA, 22 bp, Artificial Sequence
  chemically synthesized
gtccttgcgatagtttactgag

SEQ ID NO: 153806 - DNA, 22 bp, Artificial Sequence
  chemically synthesized
gcgatagtttactgagaatgat

SEQ ID NO: 153807 - DNA, 22 bp, Artificial Sequence
  chemically synthesized
cgatagtttactgagaatgatg

SEQ ID NO: 153808 - DNA, 22 bp, Artificial Sequence
  chemically synthesized
actgagaatgatgatttccaat

SEQ ID NO: 153809 - DNA, 22 bp, Artificial Sequence
  chemically synthesized
ctgagaatgatgatttccaatt

SEQ ID NO: 153810 - DNA, 22 bp, Artificial Sequence
  chemically synthesized
agaatgatgatttccaatttca

SEQ ID NO: 153811 - DNA, 22 bp, Artificial Sequence
  chemically synthesized
ccaatttcatccatgtccctac

SEQ ID NO: 153812 - DNA, 22 bp, Artificial Sequence
  chemically synthesized
caatttcatccatgtccctaca

SEQ ID NO: 153813 - DNA, 22 bp, Artificial Sequence
  chemically synthesized
catccatgtccctacaaaggac

SEQ ID NO: 153814 - DNA, 22 bp, Artificial Sequence
  chemically synthesized
atccatgtccctacaaaggaca

SEQ ID NO: 153815 - DNA, 22 bp, Artificial Sequence
  chemically synthesized
caaaggacatgaactcatcctt

SEQ ID NO: 153816 - DNA, 22 bp, Artificial Sequence
  chemically synthesized
atccttttttatggctgcatag

SEQ ID NO: 153817 - DNA, 22 bp, Artificial Sequence
  chemically synthesized
ttttatggctgcatagtattcc

SEQ ID NO: 153818 - DNA, 22 bp, Artificial Sequence
  chemically synthesized
tttatggctgcatagtattcca

SEQ ID NO: 153819 - DNA, 22 bp, Artificial Sequence
  chemically synthesized
ttatggctgcatagtattccat

SEQ ID NO: 153820 - DNA, 22 bp, Artificial Sequence
  chemically synthesized
tatggctgcatagtattccatg

SEQ ID NO: 153821 - DNA, 22 bp, Artificial Sequence
  chemically synthesized
atggctgcatagtattccatgg

SEQ ID NO: 153822 - DNA, 22 bp, Artificial Sequence
  chemically synthesized
tggctgcatagtattccatggt

SEQ ID NO: 153823 - DNA, 22 bp, Artificial Sequence
  chemically synthesized
catagtattccatggtgtgtat

SEQ ID NO: 153824 - DNA, 22 bp, Artificial Sequence
  chemically synthesized
catggtgtgtatgtgccacatt

SEQ ID NO: 153825 - DNA, 22 bp, Artificial Sequence
  chemically synthesized
tcttaatccagtctatcattgt

SEQ ID NO: 153826 - DNA, 22 bp, Artificial Sequence
  chemically synthesized
cttaatccagtctatcattgtt

SEQ ID NO: 153827 - DNA, 22 bp, Artificial Sequence
  chemically synthesized
ttaatccagtctatcattgttg

SEQ ID NO: 153828 - DNA, 22 bp, Artificial Sequence
  chemically synthesized
aatccagtctatcattgttgga

SEQ ID NO: 153829 - DNA, 22 bp, Artificial Sequence
  chemically synthesized
atccagtctatcattgttggac

SEQ ID NO: 153830 - DNA, 22 bp, Artificial Sequence
  chemically synthesized
tcattgttggacatttgggttg

SEQ ID NO: 153831 - DNA, 22 bp, Artificial Sequence
  chemically synthesized
ttggacatttgggttggttcca

SEQ ID NO: 153832 - DNA, 22 bp, Artificial Sequence
  chemically synthesized
gacatttgggttggttccaagt

SEQ ID NO: 153833 - DNA, 22 bp, Artificial Sequence
  chemically synthesized
gggttggttccaagtctttgct

SEQ ID NO: 153834 - DNA, 22 bp, Artificial Sequence
  chemically synthesized
ggttggttccaagtctttgcta

SEQ ID NO: 153835 - DNA, 22 bp, Artificial Sequence
  chemically synthesized
gttccaagtctttgctattgtg

SEQ ID NO: 153836 - DNA, 22 bp, Artificial Sequence
  chemically synthesized
caagtctttgctattgtgaata

SEQ ID NO: 153837 - DNA, 22 bp, Artificial Sequence
  chemically synthesized
tgctattgtgaatagtgccgca

SEQ ID NO: 153838 - DNA, 22 bp, Artificial Sequence
  chemically synthesized
gctattgtgaatagtgccgcaa

SEQ ID NO: 153839 - DNA, 22 bp, Artificial Sequence
  chemically synthesized
ctattgtgaatagtgccgcaat

SEQ ID NO: 153840 - DNA, 22 bp, Artificial Sequence
  chemically synthesized
ttgtgaatagtgccgcaataaa

SEQ ID NO: 153841 - DNA, 22 bp, Artificial Sequence
  chemically synthesized
tgaatagtgccgcaataaattg

SEQ ID NO: 153842 - DNA, 22 bp, Artificial Sequence
  chemically synthesized
catttacaaacctttagctaga

SEQ ID NO: 153843 - DNA, 22 bp, Artificial Sequence
  chemically synthesized
acaaacctttagctagacatga

SEQ ID NO: 153844 - DNA, 22 bp, Artificial Sequence
  chemically synthesized
caaacctttagctagacatgaa

SEQ ID NO: 153845 - DNA, 22 bp, Artificial Sequence
  chemically synthesized
tagctagacatgaaagttctcc

SEQ ID NO: 153846 - DNA, 22 bp, Artificial Sequence
  chemically synthesized
agctagacatgaaagttctcca

SEQ ID NO: 153847 - DNA, 22 bp, Artificial Sequence
  chemically synthesized
gctagacatgaaagttctccag

SEQ ID NO: 153848 - DNA, 22 bp, Artificial Sequence
  chemically synthesized
gacatgaaagttctccagttcc

SEQ ID NO: 153849 - DNA, 22 bp, Artificial Sequence
  chemically synthesized
tccagttccatatttcatggtg

SEQ ID NO: 153850 - DNA, 22 bp, Artificial Sequence
  chemically synthesized
cagttccatatttcatggtgag

SEQ ID NO: 153851 - DNA, 22 bp, Artificial Sequence
  chemically synthesized
catatttcatggtgaggaacaa

SEQ ID NO: 153852 - DNA, 22 bp, Artificial Sequence
  chemically synthesized
catggtgaggaacaaagaatat

SEQ ID NO: 153853 - DNA, 22 bp, Artificial Sequence
  chemically synthesized
atggtgaggaacaaagaatatg

SEQ ID NO: 153854 - DNA, 22 bp, Artificial Sequence
  chemically synthesized
tattctttgttcctcaccatga

SEQ ID NO: 153855 - DNA, 22 bp, Artificial Sequence
  chemically synthesized
tttgttcctcaccatgaaatat

SEQ ID NO: 153856 - DNA, 22 bp, Artificial Sequence
  chemically synthesized
tgttcctcaccatgaaatatgg

SEQ ID NO: 153857 - DNA, 22 bp, Artificial Sequence
  chemically synthesized
gttcctcaccatgaaatatgga

SEQ ID NO: 153858 - DNA, 22 bp, Artificial Sequence
  chemically synthesized
ttcctcaccatgaaatatggaa

SEQ ID NO: 153859 - DNA, 22 bp, Artificial Sequence
  chemically synthesized
ctcaccatgaaatatggaactg

SEQ ID NO: 153860 - DNA, 22 bp, Artificial Sequence
  chemically synthesized
accatgaaatatggaactggag

SEQ ID NO: 153861 - DNA, 22 bp, Artificial Sequence
  chemically synthesized
gagaactttcatgtctagctaa

SEQ ID NO: 153862 - DNA, 22 bp, Artificial Sequence
  chemically synthesized
tcatgtctagctaaaggtttgt

SEQ ID NO: 153863 - DNA, 22 bp, Artificial Sequence
  chemically synthesized
catgtctagctaaaggtttgta

SEQ ID NO: 153864 - DNA, 22 bp, Artificial Sequence
  chemically synthesized
atgtctagctaaaggtttgtaa

SEQ ID NO: 153865 - DNA, 22 bp, Artificial Sequence
  chemically synthesized
gctaaaggtttgtaaatgcacc

SEQ ID NO: 153866 - DNA, 22 bp, Artificial Sequence
  chemically synthesized
aaggtttgtaaatgcaccaatc

SEQ ID NO: 153867 - DNA, 22 bp, Artificial Sequence
  chemically synthesized
gtaaatgcaccaatcagcaatc

SEQ ID NO: 153868 - DNA, 22 bp, Artificial Sequence
  chemically synthesized
taaatgcaccaatcagcaatct

SEQ ID NO: 153869 - DNA, 22 bp, Artificial Sequence
  chemically synthesized
tgtctaactcaaggtttgtaaa

SEQ ID NO: 153870 - DNA, 22 bp, Artificial Sequence
  chemically synthesized
actcaaggtttgtaaatgcacc

SEQ ID NO: 153871 - DNA, 22 bp, Artificial Sequence
  chemically synthesized
aaggtttgtaaatgcaccaatc

SEQ ID NO: 153872 - DNA, 22 bp, Artificial Sequence
  chemically synthesized
gtaaatgcaccaatcagtgctc

SEQ ID NO: 153873 - DNA, 22 bp, Artificial Sequence
  chemically synthesized
taaatgcaccaatcagtgctct

SEQ ID NO: 153874 - DNA, 22 bp, Artificial Sequence
  chemically synthesized
tgtgtctagctaatctagtggg

SEQ ID NO: 153875 - DNA, 22 bp, Artificial Sequence
  chemically synthesized
tgtctagctaatctagtgggga

SEQ ID NO: 153876 - DNA, 22 bp, Artificial Sequence
  chemically synthesized
gctaatctagtggggacttgga

SEQ ID NO: 153877 - DNA, 22 bp, Artificial Sequence
  chemically synthesized
atctagtggggacttggagaac

SEQ ID NO: 153878 - DNA, 22 bp, Artificial Sequence
  chemically synthesized
gtggggacttggagaacttttg

SEQ ID NO: 153879 - DNA, 22 bp, Artificial Sequence
  chemically synthesized
ggagaacttttgtgtctagcta

SEQ ID NO: 153880 - DNA, 22 bp, Artificial Sequence
  chemically synthesized
gagaacttttgtgtctagctaa

SEQ ID NO: 153881 - DNA, 22 bp, Artificial Sequence
  chemically synthesized
ttgtgtctagctaaaggattgt

SEQ ID NO: 153882 - DNA, 22 bp, Artificial Sequence
  chemically synthesized
tgtgtctagctaaaggattgta

SEQ ID NO: 153883 - DNA, 22 bp, Artificial Sequence
  chemically synthesized
gtgtctagctaaaggattgtaa

SEQ ID NO: 153884 - DNA, 22 bp, Artificial Sequence
  chemically synthesized
tgtctagctaaaggattgtaaa

SEQ ID NO: 153885 - DNA, 22 bp, Artificial Sequence
  chemically synthesized
gctaaaggattgtaaatgcact

SEQ ID NO: 153886 - DNA, 22 bp, Artificial Sequence
  chemically synthesized
aaggattgtaaatgcactaatc

SEQ ID NO: 153887 - DNA, 22 bp, Artificial Sequence
  chemically synthesized
taaatgcactaatcagcactct

SEQ ID NO: 153888 - DNA, 22 bp, Artificial Sequence
  chemically synthesized
atcagcactctgtgtctagctc

SEQ ID NO: 153889 - DNA, 22 bp, Artificial Sequence
  chemically synthesized
tgtgtctagctcaaggtttgta

SEQ ID NO: 153890 - DNA, 22 bp, Artificial Sequence
  chemically synthesized
tgtctagctcaaggtttgtaaa

SEQ ID NO: 153891 - DNA, 22 bp, Artificial Sequence
  chemically synthesized
gctcaaggtttgtaaatgcacc

SEQ ID NO: 153892 - DNA, 22 bp, Artificial Sequence
  chemically synthesized
aaggtttgtaaatgcaccaatc

SEQ ID NO: 153893 - DNA, 22 bp, Artificial Sequence
  chemically synthesized
gtaaatgcaccaatcagcactc

SEQ ID NO: 153894 - DNA, 22 bp, Artificial Sequence
  chemically synthesized
taaatgcaccaatcagcactct

SEQ ID NO: 153895 - DNA, 22 bp, Artificial Sequence
  chemically synthesized
tgccaaaacggaccaaccagct

SEQ ID NO: 153896 - DNA, 22 bp, Artificial Sequence
  chemically synthesized
ccaaaacggaccaaccagctct

SEQ ID NO: 153897 - DNA, 22 bp, Artificial Sequence
  chemically synthesized
tctgtaaaatgggccaatcagc

SEQ ID NO: 153898 - DNA, 22 bp, Artificial Sequence
  chemically synthesized
tgtaaaatgggccaatcagctc

SEQ ID NO: 153899 - DNA, 22 bp, Artificial Sequence
  chemically synthesized
taaaatgggccaatcagctctc

SEQ ID NO: 153900 - DNA, 22 bp, Artificial Sequence
  chemically synthesized
tctgtaaaatggaccaatcagc

SEQ ID NO: 153901 - DNA, 22 bp, Artificial Sequence
  chemically synthesized
tgtaaaatggaccaatcagcag

SEQ ID NO: 153902 - DNA, 22 bp, Artificial Sequence
  chemically synthesized
taaaatggaccaatcagcagga

SEQ ID NO: 153903 - DNA, 22 bp, Artificial Sequence
  chemically synthesized
ccggagccagctgtgacaactg

SEQ ID NO: 153904 - DNA, 22 bp, Artificial Sequence
  chemically synthesized
tgacaactgacttgggttccct

SEQ ID NO: 153905 - DNA, 22 bp, Artificial Sequence
  chemically synthesized
acttgggttccctaccatgctg

SEQ ID NO: 153906 - DNA, 22 bp, Artificial Sequence
  chemically synthesized
gggttccctaccatgctgtgga

SEQ ID NO: 153907 - DNA, 22 bp, Artificial Sequence
  chemically synthesized
ggttccctaccatgctgtggaa

SEQ ID NO: 153908 - DNA, 22 bp, Artificial Sequence
  chemically synthesized
cctaccatgctgtggaagcttt

SEQ ID NO: 153909 - DNA, 22 bp, Artificial Sequence
  chemically synthesized
ccatgctgtggaagctttgttc

SEQ ID NO: 153910 - DNA, 22 bp, Artificial Sequence
  chemically synthesized
tggaagctttgttcttttattc

SEQ ID NO: 153911 - DNA, 22 bp, Artificial Sequence
  chemically synthesized
tgttcttttattcttcacaata

SEQ ID NO: 153912 - DNA, 22 bp, Artificial Sequence
  chemically synthesized
gttcttttattcttcacaataa

SEQ ID NO: 153913 - DNA, 22 bp, Artificial Sequence
  chemically synthesized
ttcttttattcttcacaataaa

SEQ ID NO: 153914 - DNA, 22 bp, Artificial Sequence
  chemically synthesized
ttttattcttcacaataaatct

SEQ ID NO: 153915 - DNA, 22 bp, Artificial Sequence
  chemically synthesized
ttattcttcacaataaatctta

SEQ ID NO: 153916 - DNA, 22 bp, Artificial Sequence
  chemically synthesized
tattcttcacaataaatcttac

SEQ ID NO: 153917 - DNA, 22 bp, Artificial Sequence
  chemically synthesized
attcttcacaataaatcttact

SEQ ID NO: 153918 - DNA, 22 bp, Artificial Sequence
  chemically synthesized
ttcttcacaataaatcttactg

SEQ ID NO: 153919 - DNA, 22 bp, Artificial Sequence
  chemically synthesized
ttcacaataaatcttactgctg

SEQ ID NO: 153920 - DNA, 22 bp, Artificial Sequence
  chemically synthesized
cacaataaatcttactgctgct

SEQ ID NO: 153921 - DNA, 22 bp, Artificial Sequence
  chemically synthesized
acaataaatcttactgctgctc

SEQ ID NO: 153922 - DNA, 22 bp, Artificial Sequence
  chemically synthesized
actgctgctcactctttggatc

SEQ ID NO: 153923 - DNA, 22 bp, Artificial Sequence
  chemically synthesized
ctgctgctcactctttggatcc

SEQ ID NO: 153924 - DNA, 22 bp, Artificial Sequence
  chemically synthesized
ctgctcactctttggatccgcg

SEQ ID NO: 153925 - DNA, 22 bp, Artificial Sequence
  chemically synthesized
ctcactctttggatccgcgctg

SEQ ID NO: 153926 - DNA, 22 bp, Artificial Sequence
  chemically synthesized
actctttggatccgcgctgcct

SEQ ID NO: 153927 - DNA, 22 bp, Artificial Sequence
  chemically synthesized
tttggatccgcgctgcctttat

SEQ ID NO: 153928 - DNA, 22 bp, Artificial Sequence
  chemically synthesized
tggatccgcgctgcctttatga

SEQ ID NO: 153929 - DNA, 22 bp, Artificial Sequence
  chemically synthesized
ggatccgcgctgcctttatgag

SEQ ID NO: 153930 - DNA, 22 bp, Artificial Sequence
  chemically synthesized
gatccgcgctgcctttatgagc

SEQ ID NO: 153931 - DNA, 22 bp, Artificial Sequence
  chemically synthesized
cctttatgagctgtaacactca

SEQ ID NO: 153932 - DNA, 22 bp, Artificial Sequence
  chemically synthesized
tatgagctgtaacactcactgc

SEQ ID NO: 153933 - DNA, 22 bp, Artificial Sequence
  chemically synthesized
atgagctgtaacactcactgcg

SEQ ID NO: 153934 - DNA, 22 bp, Artificial Sequence
  chemically synthesized
tgagctgtaacactcactgcga

SEQ ID NO: 153935 - DNA, 22 bp, Artificial Sequence
  chemically synthesized
taacactcactgcgaaggtctg

SEQ ID NO: 153936 - DNA, 22 bp, Artificial Sequence
  chemically synthesized
actgcgaaggtctgcggcttca

SEQ ID NO: 153937 - DNA, 22 bp, Artificial Sequence
  chemically synthesized
cgaaggtctgcggcttcacttc

SEQ ID NO: 153938 - DNA, 22 bp, Artificial Sequence
  chemically synthesized
cggcttcacttctgaagccagc

SEQ ID NO: 153939 - DNA, 22 bp, Artificial Sequence
  chemically synthesized
cacttctgaagccagcaagacc

SEQ ID NO: 153940 - DNA, 22 bp, Artificial Sequence
  chemically synthesized
acttctgaagccagcaagacca

SEQ ID NO: 153941 - DNA, 22 bp, Artificial Sequence
  chemically synthesized
ctgaagccagcaagaccacgaa

SEQ ID NO: 153942 - DNA, 22 bp, Artificial Sequence
  chemically synthesized
tgaagccagcaagaccacgaac

SEQ ID NO: 153943 - DNA, 22 bp, Artificial Sequence
  chemically synthesized
aagccagcaagaccacgaaccc

SEQ ID NO: 153944 - DNA, 22 bp, Artificial Sequence
  chemically synthesized
catacgctccgcctttaagagc

SEQ ID NO: 153945 - DNA, 22 bp, Artificial Sequence
  chemically synthesized
cgcctttaagagctgtaacact

SEQ ID NO: 153946 - DNA, 22 bp, Artificial Sequence
  chemically synthesized
taagagctgtaacactccccgt

SEQ ID NO: 153947 - DNA, 22 bp, Artificial Sequence
  chemically synthesized
aagagctgtaacactccccgtg

SEQ ID NO: 153948 - DNA, 22 bp, Artificial Sequence
  chemically synthesized
agagctgtaacactccccgtgg

SEQ ID NO: 153949 - DNA, 22 bp, Artificial Sequence
  chemically synthesized
taacactccccgtgggggtctg

SEQ ID NO: 153950 - DNA, 22 bp, Artificial Sequence
  chemically synthesized
cccgtgggggtctgcagcttca

SEQ ID NO: 153951 - DNA, 22 bp, Artificial Sequence
  chemically synthesized
cagcttcactcctggagccagc

SEQ ID NO: 153952 - DNA, 22 bp, Artificial Sequence
  chemically synthesized
cactcctggagccagcaagacc

SEQ ID NO: 153953 - DNA, 22 bp, Artificial Sequence
  chemically synthesized
actcctggagccagcaagaccg

SEQ ID NO: 153954 - DNA, 22 bp, Artificial Sequence
  chemically synthesized
ctggagccagcaagaccgtgaa

SEQ ID NO: 153955 - DNA, 22 bp, Artificial Sequence
  chemically synthesized
gagccagcaagaccgtgaacac

SEQ ID NO: 153956 - DNA, 22 bp, Artificial Sequence
  chemically synthesized
tggacacatctgaagtaacaaa

SEQ ID NO: 153957 - DNA, 22 bp, Artificial Sequence
  chemically synthesized
gacacatctgaagtaacaaact

SEQ ID NO: 153958 - DNA, 22 bp, Artificial Sequence
  chemically synthesized
aagtaacaaactttggacacac

SEQ ID NO: 153959 - DNA, 22 bp, Artificial Sequence
  chemically synthesized
tggacacaccatcctttgaaca

SEQ ID NO: 153960 - DNA, 22 bp, Artificial Sequence
  chemically synthesized
ggacacaccatcctttgaacac

SEQ ID NO: 153961 - DNA, 22 bp, Artificial Sequence
  chemically synthesized
gacacaccatcctttgaacaca

SEQ ID NO: 153962 - DNA, 22 bp, Artificial Sequence
  chemically synthesized
tgaacacaccatctttaagaat

SEQ ID NO: 153963 - DNA, 22 bp, Artificial Sequence
  chemically synthesized
gaacacaccatctttaagaatt

SEQ ID NO: 153964 - DNA, 22 bp, Artificial Sequence
  chemically synthesized
aacacaccatctttaagaattg

SEQ ID NO: 153965 - DNA, 22 bp, Artificial Sequence
  chemically synthesized
taagaattgtaacactcaccac

SEQ ID NO: 153966 - DNA, 22 bp, Artificial Sequence
  chemically synthesized
aagaattgtaacactcaccacg

SEQ ID NO: 153967 - DNA, 22 bp, Artificial Sequence
  chemically synthesized
agaattgtaacactcaccacga

SEQ ID NO: 153968 - DNA, 22 bp, Artificial Sequence
  chemically synthesized
taacactcaccacgagggttcg

SEQ ID NO: 153969 - DNA, 22 bp, Artificial Sequence
  chemically synthesized
accacgagggttcgcggcttca

SEQ ID NO: 153970 - DNA, 22 bp, Artificial Sequence
  chemically synthesized
gcggcttcattctttaagtcag

SEQ ID NO: 153971 - DNA, 22 bp, Artificial Sequence
  chemically synthesized
cattctttaagtcagcgagacc

SEQ ID NO: 153972 - DNA, 22 bp, Artificial Sequence
  chemically synthesized
attctttaagtcagcgagacca

SEQ ID NO: 153973 - DNA, 22 bp, Artificial Sequence
  chemically synthesized
tttaagtcagcgagaccaagaa

SEQ ID NO: 153974 - DNA, 22 bp, Artificial Sequence
  chemically synthesized
taagtcagcgagaccaagaacc

SEQ ID NO: 153975 - DNA, 22 bp, Artificial Sequence
  chemically synthesized
aagtcagcgagaccaagaaccc

SEQ ID NO: 153976 - DNA, 22 bp, Artificial Sequence
  chemically synthesized
agtcagcgagaccaagaaccca

SEQ ID NO: 153977 - DNA, 22 bp, Artificial Sequence
  chemically synthesized
cggacacagaaggatggacaaa

SEQ ID NO: 153978 - DNA, 22 bp, Artificial Sequence
  chemically synthesized
tcaggaatgcaattaagtccac

SEQ ID NO: 153979 - DNA, 22 bp, Artificial Sequence
  chemically synthesized
agtccaccaacacaaaaattac

SEQ ID NO: 153980 - DNA, 22 bp, Artificial Sequence
  chemically synthesized
catacctagaatcaattttaat

SEQ ID NO: 153981 - DNA, 22 bp, Artificial Sequence
  chemically synthesized
gaatcaattttaataaagaaaa

SEQ ID NO: 153982 - DNA, 22 bp, Artificial Sequence
  chemically synthesized
taataaagaaaacttatttgga

SEQ ID NO: 153983 - DNA, 22 bp, Artificial Sequence
  chemically synthesized
aataaagaaaacttatttggag

SEQ ID NO: 153984 - DNA, 22 bp, Artificial Sequence
  chemically synthesized
ataaagaaaacttatttggagc

SEQ ID NO: 153985 - DNA, 22 bp, Artificial Sequence
  chemically synthesized
atttggagcacagcttattcag

SEQ ID NO: 153986 - DNA, 22 bp, Artificial Sequence
  chemically synthesized
tttggagcacagcttattcagg

SEQ ID NO: 153987 - DNA, 22 bp, Artificial Sequence
  chemically synthesized
ggagcacagcttattcagggca

SEQ ID NO: 153988 - DNA, 22 bp, Artificial Sequence
  chemically synthesized
gagcacagcttattcagggcag

SEQ ID NO: 153989 - DNA, 22 bp, Artificial Sequence
  chemically synthesized
attcagggcagaaaataaaagc

SEQ ID NO: 153990 - DNA, 22 bp, Artificial Sequence
  chemically synthesized
ttcagggcagaaaataaaagct

SEQ ID NO: 153991 - DNA, 22 bp, Artificial Sequence
  chemically synthesized
agggcagaaaataaaagctaat

SEQ ID NO: 153992 - DNA, 22 bp, Artificial Sequence
  chemically synthesized
ataataaaagaggtgcataata

SEQ ID NO: 153993 - DNA, 22 bp, Artificial Sequence
  chemically synthesized
ttaattaaataaccactcattt

SEQ ID NO: 153994 - DNA, 22 bp, Artificial Sequence
  chemically synthesized
aattaaataaccactcatttta

SEQ ID NO: 153995 - DNA, 22 bp, Artificial Sequence
  chemically synthesized
attaaataaccactcattttag

SEQ ID NO: 153996 - DNA, 22 bp, Artificial Sequence
  chemically synthesized
aataaccactcattttagatcc

SEQ ID NO: 153997 - DNA, 22 bp, Artificial Sequence
  chemically synthesized
attttagatccttgatatttga

SEQ ID NO: 153998 - DNA, 22 bp, Artificial Sequence
  chemically synthesized
tagatccttgatatttgaacag

SEQ ID NO: 153999 - DNA, 22 bp, Artificial Sequence
  chemically synthesized
agatccttgatatttgaacaga

SEQ ID NO: 154000 - DNA, 22 bp, Artificial Sequence
  chemically synthesized
gatccttgatatttgaacagaa

SEQ ID NO: 154001 - DNA, 22 bp, Artificial Sequence
  chemically synthesized
gatatttgaacagaatagtata

SEQ ID NO: 154002 - DNA, 22 bp, Artificial Sequence
  chemically synthesized
atatttgaacagaatagtataa

SEQ ID NO: 154003 - DNA, 22 bp, Artificial Sequence
  chemically synthesized
gaacagaatagtataaaaaata

SEQ ID NO: 154004 - DNA, 22 bp, Artificial Sequence
  chemically synthesized
aacagaatagtataaaaaatag

SEQ ID NO: 154005 - DNA, 22 bp, Artificial Sequence
  chemically synthesized
aagagtgcagaaaaaaaggaca

SEQ ID NO: 154006 - DNA, 22 bp, Artificial Sequence
  chemically synthesized
agagtgcagaaaaaaaggacaa

SEQ ID NO: 154007 - DNA, 22 bp, Artificial Sequence
  chemically synthesized
caaaatcttaactggagttcag

SEQ ID NO: 154008 - DNA, 22 bp, Artificial Sequence
  chemically synthesized
aactggagttcaggagagagtg

SEQ ID NO: 154009 - DNA, 22 bp, Artificial Sequence
  chemically synthesized
actggagttcaggagagagtga

SEQ ID NO: 154010 - DNA, 22 bp, Artificial Sequence
  chemically synthesized
gagttcaggagagagtgaaaat

SEQ ID NO: 154011 - DNA, 22 bp, Artificial Sequence
  chemically synthesized
aggagagagtgaaaatagaaca

SEQ ID NO: 154012 - DNA, 22 bp, Artificial Sequence
  chemically synthesized
actagagatcaatacaagacaa

SEQ ID NO: 154013 - DNA, 22 bp, Artificial Sequence
  chemically synthesized
ctagagatcaatacaagacaat

SEQ ID NO: 154014 - DNA, 22 bp, Artificial Sequence
  chemically synthesized
gagatcaatacaagacaatttt

SEQ ID NO: 154015 - DNA, 22 bp, Artificial Sequence
  chemically synthesized
tctgaacaaaagaacacagcag

SEQ ID NO: 154016 - DNA, 22 bp, Artificial Sequence
  chemically synthesized
ctgaacaaaagaacacagcagt

SEQ ID NO: 154017 - DNA, 22 bp, Artificial Sequence
  chemically synthesized
tgaacaaaagaacacagcagtt

SEQ ID NO: 154018 - DNA, 22 bp, Artificial Sequence
  chemically synthesized
aacaaaagaacacagcagttga

SEQ ID NO: 154019 - DNA, 22 bp, Artificial Sequence
  chemically synthesized
aaattgagagtatccacaaaat

SEQ ID NO: 154020 - DNA, 22 bp, Artificial Sequence
  chemically synthesized
agagtatccacaaaatacccag

SEQ ID NO: 154021 - DNA, 22 bp, Artificial Sequence
  chemically synthesized
atggtaagttaagagaatgaaa

SEQ ID NO: 154022 - DNA, 22 bp, Artificial Sequence
  chemically synthesized
agagaatgaaaaaaacaagcca

SEQ ID NO: 154023 - DNA, 22 bp, Artificial Sequence
  chemically synthesized
gcaaaacatattatctgataaa

SEQ ID NO: 154024 - DNA, 22 bp, Artificial Sequence
  chemically synthesized
caaaacatattatctgataaag

SEQ ID NO: 154025 - DNA, 22 bp, Artificial Sequence
  chemically synthesized
tctgataaaggacttgtataca

SEQ ID NO: 154026 - DNA, 22 bp, Artificial Sequence
  chemically synthesized
ataaaggacttgtatacatatt

SEQ ID NO: 154027 - DNA, 22 bp, Artificial Sequence
  chemically synthesized
gtatacatattatacaaagaac

SEQ ID NO: 154028 - DNA, 22 bp, Artificial Sequence
  chemically synthesized
tatacatattatacaaagaact

SEQ ID NO: 154029 - DNA, 22 bp, Artificial Sequence
  chemically synthesized
tacaaagaacttttaaaattct

SEQ ID NO: 154030 - DNA, 22 bp, Artificial Sequence
  chemically synthesized
ttaaaattctacaataaaaaac

SEQ ID NO: 154031 - DNA, 22 bp, Artificial Sequence
  chemically synthesized
taaaattctacaataaaaaaca

SEQ ID NO: 154032 - DNA, 22 bp, Artificial Sequence
  chemically synthesized
aaaattctacaataaaaaacaa

SEQ ID NO: 154033 - DNA, 22 bp, Artificial Sequence
  chemically synthesized
aaattctacaataaaaaacaaa

SEQ ID NO: 154034 - DNA, 22 bp, Artificial Sequence
  chemically synthesized
tacaataaaaaacaaacaatcc

SEQ ID NO: 154035 - DNA, 22 bp, Artificial Sequence
  chemically synthesized
caataaaaaacaaacaatccaa

SEQ ID NO: 154036 - DNA, 22 bp, Artificial Sequence
  chemically synthesized
caaagtgggcaaaagatctgaa

SEQ ID NO: 154037 - DNA, 22 bp, Artificial Sequence
  chemically synthesized
aacagacactttaccaaagaag

SEQ ID NO: 154038 - DNA, 22 bp, Artificial Sequence
  chemically synthesized
taccaaagaagatatatagatt

SEQ ID NO: 154039 - DNA, 22 bp, Artificial Sequence
  chemically synthesized
accaaagaagatatatagattg

SEQ ID NO: 154040 - DNA, 22 bp, Artificial Sequence
  chemically synthesized
ccaaagaagatatatagattgc

SEQ ID NO: 154041 - DNA, 22 bp, Artificial Sequence
  chemically synthesized
caataagcacatgaaaatatac

SEQ ID NO: 154042 - DNA, 22 bp, Artificial Sequence
  chemically synthesized
agtaacacatgtcattaagaaa

SEQ ID NO: 154043 - DNA, 22 bp, Artificial Sequence
  chemically synthesized
agaaactgcacattaaaacaag

SEQ ID NO: 154044 - DNA, 22 bp, Artificial Sequence
  chemically synthesized
cacattaaaacaagaagatacc

SEQ ID NO: 154045 - DNA, 22 bp, Artificial Sequence
  chemically synthesized
aaacaagaagataccaaccact

SEQ ID NO: 154046 - DNA, 22 bp, Artificial Sequence
  chemically synthesized
cacacatattagaaggccaaat

SEQ ID NO: 154047 - DNA, 22 bp, Artificial Sequence
  chemically synthesized
gaaggccaaattccaaaatact

SEQ ID NO: 154048 - DNA, 22 bp, Artificial Sequence
  chemically synthesized
caaaatactgacatccaccaaa

SEQ ID NO: 154049 - DNA, 22 bp, Artificial Sequence
  chemically synthesized
acatccaccaaacactggcaac

SEQ ID NO: 154050 - DNA, 22 bp, Artificial Sequence
  chemically synthesized
gcaacgaagtggagcaacagta

SEQ ID NO: 154051 - DNA, 22 bp, Artificial Sequence
  chemically synthesized
tcacttattgcttgtagggatg

SEQ ID NO: 154052 - DNA, 22 bp, Artificial Sequence
  chemically synthesized
acttattgcttgtagggatgag

SEQ ID NO: 154053 - DNA, 22 bp, Artificial Sequence
  chemically synthesized
attgcttgtagggatgagaaat

SEQ ID NO: 154054 - DNA, 22 bp, Artificial Sequence
  chemically synthesized
ttgcttgtagggatgagaaata

SEQ ID NO: 154055 - DNA, 22 bp, Artificial Sequence
  chemically synthesized
cttgtagggatgagaaatagtg

SEQ ID NO: 154056 - DNA, 22 bp, Artificial Sequence
  chemically synthesized
gtagggatgagaaatagtgcag

SEQ ID NO: 154057 - DNA, 22 bp, Artificial Sequence
  chemically synthesized
tagggatgagaaatagtgcagc

SEQ ID NO: 154058 - DNA, 22 bp, Artificial Sequence
  chemically synthesized
gaagacagtttacagtttctta

SEQ ID NO: 154059 - DNA, 22 bp, Artificial Sequence
  chemically synthesized
acagtttcttacaaaactagtc

SEQ ID NO: 154060 - DNA, 22 bp, Artificial Sequence
  chemically synthesized
cagtttcttacaaaactagtct

SEQ ID NO: 154061 - DNA, 22 bp, Artificial Sequence
  chemically synthesized
cttacaaaactagtcttttcat

SEQ ID NO: 154062 - DNA, 22 bp, Artificial Sequence
  chemically synthesized
ttacaaaactagtcttttcatg

SEQ ID NO: 154063 - DNA, 22 bp, Artificial Sequence
  chemically synthesized
acaaaactagtcttttcatgtg

SEQ ID NO: 154064 - DNA, 22 bp, Artificial Sequence
  chemically synthesized
caaaactagtcttttcatgtga

SEQ ID NO: 154065 - DNA, 22 bp, Artificial Sequence
  chemically synthesized
gtcttttcatgtgacccaacaa

SEQ ID NO: 154066 - DNA, 22 bp, Artificial Sequence
  chemically synthesized
ttcatgtgacccaacaatcaca

SEQ ID NO: 154067 - DNA, 22 bp, Artificial Sequence
  chemically synthesized
tcatgtgacccaacaatcacac

SEQ ID NO: 154068 - DNA, 22 bp, Artificial Sequence
  chemically synthesized
catgtgacccaacaatcacact

SEQ ID NO: 154069 - DNA, 22 bp, Artificial Sequence
  chemically synthesized
atgtgacccaacaatcacactc

SEQ ID NO: 154070 - DNA, 22 bp, Artificial Sequence
  chemically synthesized
ctatgtatttacccaaatgagt

SEQ ID NO: 154071 - DNA, 22 bp, Artificial Sequence
  chemically synthesized
tgtatttacccaaatgagtcaa

SEQ ID NO: 154072 - DNA, 22 bp, Artificial Sequence
  chemically synthesized
acccaaatgagtcaaaaattta

SEQ ID NO: 154073 - DNA, 22 bp, Artificial Sequence
  chemically synthesized
cccaaatgagtcaaaaatttat

SEQ ID NO: 154074 - DNA, 22 bp, Artificial Sequence
  chemically synthesized
atgtccacacacagacatgaac

SEQ ID NO: 154075 - DNA, 22 bp, Artificial Sequence
  chemically synthesized
tgtccacacacagacatgaact

SEQ ID NO: 154076 - DNA, 22 bp, Artificial Sequence
  chemically synthesized
accaaggtttataggaacttta

SEQ ID NO: 154077 - DNA, 22 bp, Artificial Sequence
  chemically synthesized
ataggaactttactcataattg

SEQ ID NO: 154078 - DNA, 22 bp, Artificial Sequence
  chemically synthesized
taggaactttactcataattgc

SEQ ID NO: 154079 - DNA, 22 bp, Artificial Sequence
  chemically synthesized
tactcataattgccaaaagttg

SEQ ID NO: 154080 - DNA, 22 bp, Artificial Sequence
  chemically synthesized
actcataattgccaaaagttga

SEQ ID NO: 154081 - DNA, 22 bp, Artificial Sequence
  chemically synthesized
ctcataattgccaaaagttgaa

SEQ ID NO: 154082 - DNA, 22 bp, Artificial Sequence
  chemically synthesized
ataattgccaaaagttgaaagt

SEQ ID NO: 154083 - DNA, 22 bp, Artificial Sequence
  chemically synthesized
ccaaaagttgaaagtaaccaag

SEQ ID NO: 154084 - DNA, 22 bp, Artificial Sequence
  chemically synthesized
aaagtaaccaagatgaatggat

SEQ ID NO: 154085 - DNA, 22 bp, Artificial Sequence
  chemically synthesized
tggaacatccataggatagaat

SEQ ID NO: 154086 - DNA, 22 bp, Artificial Sequence
  chemically synthesized
ttcagtgatataaataaaggtc

SEQ ID NO: 154087 - DNA, 22 bp, Artificial Sequence
  chemically synthesized
agtgatataaataaaggtctat

SEQ ID NO: 154088 - DNA, 22 bp, Artificial Sequence
  chemically synthesized
tcaagctgtgaaaagacataaa

SEQ ID NO: 154089 - DNA, 22 bp, Artificial Sequence
  chemically synthesized
tgaaaagacataaagagcttta

SEQ ID NO: 154090 - DNA, 22 bp, Artificial Sequence
  chemically synthesized
taattgtatattgcttaattca

SEQ ID NO: 154091 - DNA, 22 bp, Artificial Sequence
  chemically synthesized
aattgtatattgcttaattcat

SEQ ID NO: 154092 - DNA, 22 bp, Artificial Sequence
  chemically synthesized
attgtatattgcttaattcatt

SEQ ID NO: 154093 - DNA, 22 bp, Artificial Sequence
  chemically synthesized
tatattgcttaattcattttct

SEQ ID NO: 154094 - DNA, 22 bp, Artificial Sequence
  chemically synthesized
cttaattcattttctttaatta

SEQ ID NO: 154095 - DNA, 22 bp, Artificial Sequence
  chemically synthesized
aattcattttctttaattatag

SEQ ID NO: 154096 - DNA, 22 bp, Artificial Sequence
  chemically synthesized
attcattttctttaattatagt

SEQ ID NO: 154097 - DNA, 22 bp, Artificial Sequence
  chemically synthesized
attttctttaattatagtcatc

SEQ ID NO: 154098 - DNA, 22 bp, Artificial Sequence
  chemically synthesized
tctttaattatagtcatcattc

SEQ ID NO: 154099 - DNA, 22 bp, Artificial Sequence
  chemically synthesized
ctttaattatagtcatcattct

SEQ ID NO: 154100 - DNA, 22 bp, Artificial Sequence
  chemically synthesized
tttaattatagtcatcattctc

SEQ ID NO: 154101 - DNA, 22 bp, Artificial Sequence
  chemically synthesized
taattatagtcatcattctcta

SEQ ID NO: 154102 - DNA, 22 bp, Artificial Sequence
  chemically synthesized
aattatagtcatcattctctac

SEQ ID NO: 154103 - DNA, 22 bp, Artificial Sequence
  chemically synthesized
attatagtcatcattctctaca

SEQ ID NO: 154104 - DNA, 22 bp, Artificial Sequence
  chemically synthesized
tagtcatcattctctacatatt

SEQ ID NO: 154105 - DNA, 22 bp, Artificial Sequence
  chemically synthesized
tctacatattactccattaacc

SEQ ID NO: 154106 - DNA, 22 bp, Artificial Sequence
  chemically synthesized
tacatattactccattaaccta

SEQ ID NO: 154107 - DNA, 22 bp, Artificial Sequence
  chemically synthesized
catattactccattaacctatt

SEQ ID NO: 154108 - DNA, 22 bp, Artificial Sequence
  chemically synthesized
ctccattaacctattttatctt

SEQ ID NO: 154109 - DNA, 22 bp, Artificial Sequence
  chemically synthesized
cattaacctattttatcttgct

SEQ ID NO: 154110 - DNA, 22 bp, Artificial Sequence
  chemically synthesized
acctattttatcttgctgttga

SEQ ID NO: 154111 - DNA, 22 bp, Artificial Sequence
  chemically synthesized
ttttatcttgctgttgagaaac

SEQ ID NO: 154112 - DNA, 22 bp, Artificial Sequence
  chemically synthesized
tatcttgctgttgagaaacttc

SEQ ID NO: 154113 - DNA, 22 bp, Artificial Sequence
  chemically synthesized
atcttgctgttgagaaacttcc

SEQ ID NO: 154114 - DNA, 22 bp, Artificial Sequence
  chemically synthesized
tcttgctgttgagaaacttcca

SEQ ID NO: 154115 - DNA, 22 bp, Artificial Sequence
  chemically synthesized
gctgttgagaaacttccattcc

SEQ ID NO: 154116 - DNA, 22 bp, Artificial Sequence
  chemically synthesized
ctgttgagaaacttccattcct

SEQ ID NO: 154117 - DNA, 22 bp, Artificial Sequence
  chemically synthesized
ttgagaaacttccattcctata

SEQ ID NO: 154118 - DNA, 22 bp, Artificial Sequence
  chemically synthesized
agaaacttccattcctatagtc

SEQ ID NO: 154119 - DNA, 22 bp, Artificial Sequence
  chemically synthesized
ccattcctatagtctttcatat

SEQ ID NO: 154120 - DNA, 22 bp, Artificial Sequence
  chemically synthesized
cattcctatagtctttcatatc

SEQ ID NO: 154121 - DNA, 22 bp, Artificial Sequence
  chemically synthesized
ctatagtctttcatatccttct

SEQ ID NO: 154122 - DNA, 22 bp, Artificial Sequence
  chemically synthesized
tagtctttcatatccttctgtt

SEQ ID NO: 154123 - DNA, 22 bp, Artificial Sequence
  chemically synthesized
tcatatccttctgttctgatta

SEQ ID NO: 154124 - DNA, 22 bp, Artificial Sequence
  chemically synthesized
catatccttctgttctgattat

SEQ ID NO: 154125 - DNA, 22 bp, Artificial Sequence
  chemically synthesized
atatccttctgttctgattatt

SEQ ID NO: 154126 - DNA, 22 bp, Artificial Sequence
  chemically synthesized
ctgttctgattattattcctca

SEQ ID NO: 154127 - DNA, 22 bp, Artificial Sequence
  chemically synthesized
tgttctgattattattcctcaa

SEQ ID NO: 154128 - DNA, 22 bp, Artificial Sequence
  chemically synthesized
ttctgattattattcctcaaac

SEQ ID NO: 154129 - DNA, 22 bp, Artificial Sequence
  chemically synthesized
tgattattattcctcaaacaaa

SEQ ID NO: 154130 - DNA, 22 bp, Artificial Sequence
  chemically synthesized
attattattcctcaaacaaata

SEQ ID NO: 154131 - DNA, 22 bp, Artificial Sequence
  chemically synthesized
ttattcctcaaacaaatataga

SEQ ID NO: 154132 - DNA, 22 bp, Artificial Sequence
  chemically synthesized
ttcctcaaacaaatatagatat

SEQ ID NO: 154133 - DNA, 22 bp, Artificial Sequence
  chemically synthesized
ctcaaacaaatatagatattca

SEQ ID NO: 154134 - DNA, 22 bp, Artificial Sequence
  chemically synthesized
aaacaaatatagatattcaata

SEQ ID NO: 154135 - DNA, 22 bp, Artificial Sequence
  chemically synthesized
aataatagacaaatagtgaata

SEQ ID NO: 154136 - DNA, 22 bp, Artificial Sequence
  chemically synthesized
tttgacttagtttcagacagct

SEQ ID NO: 154137 - DNA, 22 bp, Artificial Sequence
  chemically synthesized
tgacttagtttcagacagctat

SEQ ID NO: 154138 - DNA, 22 bp, Artificial Sequence
  chemically synthesized
gacttagtttcagacagctatt

SEQ ID NO: 154139 - DNA, 22 bp, Artificial Sequence
  chemically synthesized
acttagtttcagacagctattg

SEQ ID NO: 154140 - DNA, 22 bp, Artificial Sequence
  chemically synthesized
agtttcagacagctattgcata

SEQ ID NO: 154141 - DNA, 22 bp, Artificial Sequence
  chemically synthesized
gtttcagacagctattgcatag

SEQ ID NO: 154142 - DNA, 22 bp, Artificial Sequence
  chemically synthesized
cagacagctattgcatagaatg

SEQ ID NO: 154143 - DNA, 22 bp, Artificial Sequence
  chemically synthesized
agacagctattgcatagaatga

SEQ ID NO: 154144 - DNA, 22 bp, Artificial Sequence
  chemically synthesized
ttgcatagaatgaaatagatta

SEQ ID NO: 154145 - DNA, 22 bp, Artificial Sequence
  chemically synthesized
catagaatgaaatagattaata

SEQ ID NO: 154146 - DNA, 22 bp, Artificial Sequence
  chemically synthesized
atatttaataacaggtaatgtt

SEQ ID NO: 154147 - DNA, 22 bp, Artificial Sequence
  chemically synthesized
aataacaggtaatgttatgatt

SEQ ID NO: 154148 - DNA, 22 bp, Artificial Sequence
  chemically synthesized
ataacaggtaatgttatgattt

SEQ ID NO: 154149 - DNA, 22 bp, Artificial Sequence
  chemically synthesized
tgatttattaaaaataagatga

SEQ ID NO: 154150 - DNA, 22 bp, Artificial Sequence
  chemically synthesized
attaaaaataagatgataaata

SEQ ID NO: 154151 - DNA, 22 bp, Artificial Sequence
  chemically synthesized
ttaaaaataagatgataaataa

SEQ ID NO: 154152 - DNA, 22 bp, Artificial Sequence
  chemically synthesized
aaaataagatgataaataaaag

SEQ ID NO: 154153 - DNA, 22 bp, Artificial Sequence
  chemically synthesized
agtatcttcccatggagataac

SEQ ID NO: 154154 - DNA, 22 bp, Artificial Sequence
  chemically synthesized
gtatcttcccatggagataaca

SEQ ID NO: 154155 - DNA, 22 bp, Artificial Sequence
  chemically synthesized
cccatggagataacacacttag

SEQ ID NO: 154156 - DNA, 22 bp, Artificial Sequence
  chemically synthesized
ccatggagataacacacttaga

SEQ ID NO: 154157 - DNA, 22 bp, Artificial Sequence
  chemically synthesized
agatacaggtttcatgtcactt

SEQ ID NO: 154158 - DNA, 22 bp, Artificial Sequence
  chemically synthesized
gatacaggtttcatgtcacttt

SEQ ID NO: 154159 - DNA, 22 bp, Artificial Sequence
  chemically synthesized
catgtcactttggacatgagta

SEQ ID NO: 154160 - DNA, 22 bp, Artificial Sequence
  chemically synthesized
atgtcactttggacatgagtaa

SEQ ID NO: 154161 - DNA, 22 bp, Artificial Sequence
  chemically synthesized
tggacatgagtaaagaggagta

SEQ ID NO: 154162 - DNA, 22 bp, Artificial Sequence
  chemically synthesized
ggacatgagtaaagaggagtaa

SEQ ID NO: 154163 - DNA, 22 bp, Artificial Sequence
  chemically synthesized
gacatgagtaaagaggagtaaa

SEQ ID NO: 154164 - DNA, 22 bp, Artificial Sequence
  chemically synthesized
actcccaaatcttgatcacatt

SEQ ID NO: 154165 - DNA, 22 bp, Artificial Sequence
  chemically synthesized
ccaaatcttgatcacattgagt

SEQ ID NO: 154166 - DNA, 22 bp, Artificial Sequence
  chemically synthesized
gatcacattgagtatcaaagga

SEQ ID NO: 154167 - DNA, 22 bp, Artificial Sequence
  chemically synthesized
atcacattgagtatcaaaggaa

SEQ ID NO: 154168 - DNA, 22 bp, Artificial Sequence
  chemically synthesized
agtatcaaaggaaggaagaaga

SEQ ID NO: 154169 - DNA, 22 bp, Artificial Sequence
  chemically synthesized
ttaatggtggcattaaatatca

SEQ ID NO: 154170 - DNA, 22 bp, Artificial Sequence
  chemically synthesized
atggtggcattaaatatcattt

SEQ ID NO: 154171 - DNA, 22 bp, Artificial Sequence
  chemically synthesized
aatatcatttattattggatgt

SEQ ID NO: 154172 - DNA, 22 bp, Artificial Sequence
  chemically synthesized
attattggatgtgttattggca

SEQ ID NO: 154173 - DNA, 22 bp, Artificial Sequence
  chemically synthesized
ttattggatgtgttattggcat

SEQ ID NO: 154174 - DNA, 22 bp, Artificial Sequence
  chemically synthesized
ttggatgtgttattggcattgt

SEQ ID NO: 154175 - DNA, 22 bp, Artificial Sequence
  chemically synthesized
gatgtgttattggcattgtatt

SEQ ID NO: 154176 - DNA, 22 bp, Artificial Sequence
  chemically synthesized
ttggcattgtattggcatgttt

SEQ ID NO: 154177 - DNA, 22 bp, Artificial Sequence
  chemically synthesized
gcattgtattggcatgttttca

SEQ ID NO: 154178 - DNA, 22 bp, Artificial Sequence
  chemically synthesized
tattggcatgttttcacactgc

SEQ ID NO: 154179 - DNA, 22 bp, Artificial Sequence
  chemically synthesized
gcatgttttcacactgctgtaa

SEQ ID NO: 154180 - DNA, 22 bp, Artificial Sequence
  chemically synthesized
tcacactgctgtaaaaaaatac

SEQ ID NO: 154181 - DNA, 22 bp, Artificial Sequence
  chemically synthesized
cacactgctgtaaaaaaatacc

SEQ ID NO: 154182 - DNA, 22 bp, Artificial Sequence
  chemically synthesized
acactgctgtaaaaaaatacct

SEQ ID NO: 154183 - DNA, 22 bp, Artificial Sequence
  chemically synthesized
ctgtaaaaaaatacctgagact

SEQ ID NO: 154184 - DNA, 22 bp, Artificial Sequence
  chemically synthesized
taaaaaaatacctgagactggg

SEQ ID NO: 154185 - DNA, 22 bp, Artificial Sequence
  chemically synthesized
agactgggtaatttataaagaa

SEQ ID NO: 154186 - DNA, 22 bp, Artificial Sequence
  chemically synthesized
ggtaatttataaagaacagagg

SEQ ID NO: 154187 - DNA, 22 bp, Artificial Sequence
  chemically synthesized
ataaagaacagaggtttaattg

SEQ ID NO: 154188 - DNA, 22 bp, Artificial Sequence
  chemically synthesized
taaagaacagaggtttaattgg

SEQ ID NO: 154189 - DNA, 22 bp, Artificial Sequence
  chemically synthesized
aattggctcaaagttcttcagg

SEQ ID NO: 154190 - DNA, 22 bp, Artificial Sequence
  chemically synthesized
attggctcaaagttcttcaggc

SEQ ID NO: 154191 - DNA, 22 bp, Artificial Sequence
  chemically synthesized
gctcaaagttcttcaggctgta

SEQ ID NO: 154192 - DNA, 22 bp, Artificial Sequence
  chemically synthesized
aaagttcttcaggctgtacaag

SEQ ID NO: 154193 - DNA, 22 bp, Artificial Sequence
  chemically synthesized
ttcaggctgtacaagaagcatg

SEQ ID NO: 154194 - DNA, 22 bp, Artificial Sequence
  chemically synthesized
caggctgtacaagaagcatggc

SEQ ID NO: 154195 - DNA, 22 bp, Artificial Sequence
  chemically synthesized
aggctgtacaagaagcatggca

SEQ ID NO: 154196 - DNA, 22 bp, Artificial Sequence
  chemically synthesized
tacaagaagcatggcagcatct

SEQ ID NO: 154197 - DNA, 22 bp, Artificial Sequence
  chemically synthesized
ctcagcttctagggagacctca

SEQ ID NO: 154198 - DNA, 22 bp, Artificial Sequence
  chemically synthesized
agcttctagggagacctcaaga

SEQ ID NO: 154199 - DNA, 22 bp, Artificial Sequence
  chemically synthesized
ctagggagacctcaagaaactt

SEQ ID NO: 154200 - DNA, 22 bp, Artificial Sequence
  chemically synthesized
tagggagacctcaagaaactta

SEQ ID NO: 154201 - DNA, 22 bp, Artificial Sequence
  chemically synthesized
gggagacctcaagaaacttaca

SEQ ID NO: 154202 - DNA, 22 bp, Artificial Sequence
  chemically synthesized
aagaaacttacaatcatggcag

SEQ ID NO: 154203 - DNA, 22 bp, Artificial Sequence
  chemically synthesized
acaatcatggcagaagacaaag

SEQ ID NO: 154204 - DNA, 22 bp, Artificial Sequence
  chemically synthesized
caatcatggcagaagacaaagc

SEQ ID NO: 154205 - DNA, 22 bp, Artificial Sequence
  chemically synthesized
cacatggccaggacagggagaa

SEQ ID NO: 154206 - DNA, 22 bp, Artificial Sequence
  chemically synthesized
acatggccaggacagggagaag

SEQ ID NO: 154207 - DNA, 22 bp, Artificial Sequence
  chemically synthesized
cacactttcaaacaaccagcct

SEQ ID NO: 154208 - DNA, 22 bp, Artificial Sequence
  chemically synthesized
tcaaacaaccagcctcttgaga

SEQ ID NO: 154209 - DNA, 22 bp, Artificial Sequence
  chemically synthesized
caaacaaccagcctcttgagaa

SEQ ID NO: 154210 - DNA, 22 bp, Artificial Sequence
  chemically synthesized
aaacaaccagcctcttgagaac

SEQ ID NO: 154211 - DNA, 22 bp, Artificial Sequence
  chemically synthesized
ttgagaactcactatacagtac

SEQ ID NO: 154212 - DNA, 22 bp, Artificial Sequence
  chemically synthesized
gagaactcactatacagtacca

SEQ ID NO: 154213 - DNA, 22 bp, Artificial Sequence
  chemically synthesized
agaactcactatacagtaccaa

SEQ ID NO: 154214 - DNA, 22 bp, Artificial Sequence
  chemically synthesized
actatacagtaccaagggggat

SEQ ID NO: 154215 - DNA, 22 bp, Artificial Sequence
  chemically synthesized
tacagtaccaagggggatggta

SEQ ID NO: 154216 - DNA, 22 bp, Artificial Sequence
  chemically synthesized
aatcgctgatgagaactctgcc

SEQ ID NO: 154217 - DNA, 22 bp, Artificial Sequence
  chemically synthesized
atgagaactctgccaccatgat

SEQ ID NO: 154218 - DNA, 22 bp, Artificial Sequence
  chemically synthesized
tgccaccatgattgaattacct

SEQ ID NO: 154219 - DNA, 22 bp, Artificial Sequence
  chemically synthesized
ccaccatgattgaattacctcc

SEQ ID NO: 154220 - DNA, 22 bp, Artificial Sequence
  chemically synthesized
aattacctcccacaaggcccca

SEQ ID NO: 154221 - DNA, 22 bp, Artificial Sequence
  chemically synthesized
cctcccacaaggccccacctcc

SEQ ID NO: 154222 - DNA, 22 bp, Artificial Sequence
  chemically synthesized
ccacaaggccccacctccaacg

SEQ ID NO: 154223 - DNA, 22 bp, Artificial Sequence
  chemically synthesized
caacgctggtgattataattta

SEQ ID NO: 154224 - DNA, 22 bp, Artificial Sequence
  chemically synthesized
gtgattataatttaacatgata

SEQ ID NO: 154225 - DNA, 22 bp, Artificial Sequence
  chemically synthesized
taatttaacatgatatttgggt

SEQ ID NO: 154226 - DNA, 22 bp, Artificial Sequence
  chemically synthesized
aacatgatatttgggtggtgac

SEQ ID NO: 154227 - DNA, 22 bp, Artificial Sequence
  chemically synthesized
acatgatatttgggtggtgaca

SEQ ID NO: 154228 - DNA, 22 bp, Artificial Sequence
  chemically synthesized
gggtggtgacacagatccaaac

SEQ ID NO: 154229 - DNA, 22 bp, Artificial Sequence
  chemically synthesized
ggtggtgacacagatccaaacc

SEQ ID NO: 154230 - DNA, 22 bp, Artificial Sequence
  chemically synthesized
ccacctctggccccttccaaat

SEQ ID NO: 154231 - DNA, 22 bp, Artificial Sequence
  chemically synthesized
cacctctggccccttccaaatc

SEQ ID NO: 154232 - DNA, 22 bp, Artificial Sequence
  chemically synthesized
tggccccttccaaatctcatgt

SEQ ID NO: 154233 - DNA, 22 bp, Artificial Sequence
  chemically synthesized
gccccttccaaatctcatgttc

SEQ ID NO: 154234 - DNA, 22 bp, Artificial Sequence
  chemically synthesized
ccaaatctcatgttcttctcac

SEQ ID NO: 154235 - DNA, 22 bp, Artificial Sequence
  chemically synthesized
caaatctcatgttcttctcaca

SEQ ID NO: 154236 - DNA, 22 bp, Artificial Sequence
  chemically synthesized
atgttcttctcacatcacaaaa

SEQ ID NO: 154237 - DNA, 22 bp, Artificial Sequence
  chemically synthesized
ttctcacatcacaaaatacaat

SEQ ID NO: 154238 - DNA, 22 bp, Artificial Sequence
  chemically synthesized
ctcacatcacaaaatacaatca

SEQ ID NO: 154239 - DNA, 22 bp, Artificial Sequence
  chemically synthesized
tcacatcacaaaatacaatcat

SEQ ID NO: 154240 - DNA, 22 bp, Artificial Sequence
  chemically synthesized
acatcacaaaatacaatcatta

SEQ ID NO: 154241 - DNA, 22 bp, Artificial Sequence
  chemically synthesized
cttcccaacagtcctacaaagt

SEQ ID NO: 154242 - DNA, 22 bp, Artificial Sequence
  chemically synthesized
cccaacagtcctacaaagtctt

SEQ ID NO: 154243 - DNA, 22 bp, Artificial Sequence
  chemically synthesized
ccaacagtcctacaaagtctta

SEQ ID NO: 154244 - DNA, 22 bp, Artificial Sequence
  chemically synthesized
caaagtcttaactcattccagc

SEQ ID NO: 154245 - DNA, 22 bp, Artificial Sequence
  chemically synthesized
aactcattccagcattaactca

SEQ ID NO: 154246 - DNA, 22 bp, Artificial Sequence
  chemically synthesized
actcattccagcattaactcaa

SEQ ID NO: 154247 - DNA, 22 bp, Artificial Sequence
  chemically synthesized
attccagcattaactcaaaagt

SEQ ID NO: 154248 - DNA, 22 bp, Artificial Sequence
  chemically synthesized
cagcattaactcaaaagtccaa

SEQ ID NO: 154249 - DNA, 22 bp, Artificial Sequence
  chemically synthesized
actcaaaagtccaaagtccaaa

SEQ ID NO: 154250 - DNA, 22 bp, Artificial Sequence
  chemically synthesized
aaaagtccaaagtccaaagtct

SEQ ID NO: 154251 - DNA, 22 bp, Artificial Sequence
  chemically synthesized
atccaagacaaggcaagtccct

SEQ ID NO: 154252 - DNA, 22 bp, Artificial Sequence
  chemically synthesized
tccaagacaaggcaagtccctt

SEQ ID NO: 154253 - DNA, 22 bp, Artificial Sequence
  chemically synthesized
caacctatgagcctgtaaaatc

SEQ ID NO: 154254 - DNA, 22 bp, Artificial Sequence
  chemically synthesized
aacctatgagcctgtaaaatca

SEQ ID NO: 154255 - DNA, 22 bp, Artificial Sequence
  chemically synthesized
tgagcctgtaaaatcaaaaaca

SEQ ID NO: 154256 - DNA, 22 bp, Artificial Sequence
  chemically synthesized
taaaatcaaaaacaagttagtt

SEQ ID NO: 154257 - DNA, 22 bp, Artificial Sequence
  chemically synthesized
gttacttccaagacataatgga

SEQ ID NO: 154258 - DNA, 22 bp, Artificial Sequence
  chemically synthesized
cttccaagacataatggaggta

SEQ ID NO: 154259 - DNA, 22 bp, Artificial Sequence
  chemically synthesized
ccaagacataatggaggtactg

SEQ ID NO: 154260 - DNA, 22 bp, Artificial Sequence
  chemically synthesized
caagacataatggaggtactgg

SEQ ID NO: 154261 - DNA, 22 bp, Artificial Sequence
  chemically synthesized
gcattgggtacaaattcccatt

SEQ ID NO: 154262 - DNA, 22 bp, Artificial Sequence
  chemically synthesized
ggtacaaattcccattccaaaa

SEQ ID NO: 154263 - DNA, 22 bp, Artificial Sequence
  chemically synthesized
ccattccaaaagagagaaatgc

SEQ ID NO: 154264 - DNA, 22 bp, Artificial Sequence
  chemically synthesized
caaaagagagaaatgcaccaaa

SEQ ID NO: 154265 - DNA, 22 bp, Artificial Sequence
  chemically synthesized
aagatcccacacgagtagaaaa

SEQ ID NO: 154266 - DNA, 22 bp, Artificial Sequence
  chemically synthesized
caccttgatatggtttggcagt

SEQ ID NO: 154267 - DNA, 22 bp, Artificial Sequence
  chemically synthesized
gatatggtttggcagttttccc

SEQ ID NO: 154268 - DNA, 22 bp, Artificial Sequence
  chemically synthesized
atatggtttggcagttttccca

SEQ ID NO: 154269 - DNA, 22 bp, Artificial Sequence
  chemically synthesized
ggcagttttcccacccaaattt

SEQ ID NO: 154270 - DNA, 22 bp, Artificial Sequence
  chemically synthesized
gcagttttcccacccaaatttc

SEQ ID NO: 154271 - DNA, 22 bp, Artificial Sequence
  chemically synthesized
tcccacccaaatttcttcttga

SEQ ID NO: 154272 - DNA, 22 bp, Artificial Sequence
  chemically synthesized
cccacccaaatttcttcttgaa

SEQ ID NO: 154273 - DNA, 22 bp, Artificial Sequence
  chemically synthesized
ccacccaaatttcttcttgaat

SEQ ID NO: 154274 - DNA, 22 bp, Artificial Sequence
  chemically synthesized
cttcttgaatagtaggtcccat

SEQ ID NO: 154275 - DNA, 22 bp, Artificial Sequence
  chemically synthesized
ttcttgaatagtaggtcccata

SEQ ID NO: 154276 - DNA, 22 bp, Artificial Sequence
  chemically synthesized
cttgaatagtaggtcccataat

SEQ ID NO: 154277 - DNA, 22 bp, Artificial Sequence
  chemically synthesized
ttgaatagtaggtcccataatc

SEQ ID NO: 154278 - DNA, 22 bp, Artificial Sequence
  chemically synthesized
gaatagtaggtcccataatccc

SEQ ID NO: 154279 - DNA, 22 bp, Artificial Sequence
  chemically synthesized
aatagtaggtcccataatccct

SEQ ID NO: 154280 - DNA, 22 bp, Artificial Sequence
  chemically synthesized
cctgtcatggaaggaacacact

SEQ ID NO: 154281 - DNA, 22 bp, Artificial Sequence
  chemically synthesized
tcatggaaggaacacactggga

SEQ ID NO: 154282 - DNA, 22 bp, Artificial Sequence
  chemically synthesized
ggatgtaattgaatcatggggg

SEQ ID NO: 154283 - DNA, 22 bp, Artificial Sequence
  chemically synthesized
aatcatgggggtaggtttttca

SEQ ID NO: 154284 - DNA, 22 bp, Artificial Sequence
  chemically synthesized
ttcacatgctgttctcatgata

SEQ ID NO: 154285 - DNA, 22 bp, Artificial Sequence
  chemically synthesized
tcacatgctgttctcatgatag

SEQ ID NO: 154286 - DNA, 22 bp, Artificial Sequence
  chemically synthesized
cacatgctgttctcatgatagt

SEQ ID NO: 154287 - DNA, 22 bp, Artificial Sequence
  chemically synthesized
acatgctgttctcatgatagtg

SEQ ID NO: 154288 - DNA, 22 bp, Artificial Sequence
  chemically synthesized
ttctcatgatagtgagtaagtc

SEQ ID NO: 154289 - DNA, 22 bp, Artificial Sequence
  chemically synthesized
tcatgatagtgagtaagtctca

SEQ ID NO: 154290 - DNA, 22 bp, Artificial Sequence
  chemically synthesized
atgatagtgagtaagtctcaca

SEQ ID NO: 154291 - DNA, 22 bp, Artificial Sequence
  chemically synthesized
acaagatctgatggttttataa

SEQ ID NO: 154292 - DNA, 22 bp, Artificial Sequence
  chemically synthesized
atggttttataaagggcatttc

SEQ ID NO: 154293 - DNA, 22 bp, Artificial Sequence
  chemically synthesized
tataaagggcatttcccttgca

SEQ ID NO: 154294 - DNA, 22 bp, Artificial Sequence
  chemically synthesized
ataaagggcatttcccttgcac

SEQ ID NO: 154295 - DNA, 22 bp, Artificial Sequence
  chemically synthesized
taaagggcatttcccttgcaca

SEQ ID NO: 154296 - DNA, 22 bp, Artificial Sequence
  chemically synthesized
cccttgcacatgctctcttgcc

SEQ ID NO: 154297 - DNA, 22 bp, Artificial Sequence
  chemically synthesized
ccttgcacatgctctcttgcct

SEQ ID NO: 154298 - DNA, 22 bp, Artificial Sequence
  chemically synthesized
gcacatgctctcttgcctgcca

SEQ ID NO: 154299 - DNA, 22 bp, Artificial Sequence
  chemically synthesized
cacatgctctcttgcctgccac

SEQ ID NO: 154300 - DNA, 22 bp, Artificial Sequence
  chemically synthesized
tcttgcctgccaccatgtcaga

SEQ ID NO: 154301 - DNA, 22 bp, Artificial Sequence
  chemically synthesized
ttgcctgccaccatgtcagatg

SEQ ID NO: 154302 - DNA, 22 bp, Artificial Sequence
  chemically synthesized
gcctgccaccatgtcagatgtg

SEQ ID NO: 154303 - DNA, 22 bp, Artificial Sequence
  chemically synthesized
cctgccaccatgtcagatgtga

SEQ ID NO: 154304 - DNA, 22 bp, Artificial Sequence
  chemically synthesized
ccaccatgtcagatgtgacttt

SEQ ID NO: 154305 - DNA, 22 bp, Artificial Sequence
  chemically synthesized
tgctcctccttcaccttccacc

SEQ ID NO: 154306 - DNA, 22 bp, Artificial Sequence
  chemically synthesized
gctcctccttcaccttccacca

SEQ ID NO: 154307 - DNA, 22 bp, Artificial Sequence
  chemically synthesized
ctcctccttcaccttccaccat

SEQ ID NO: 154308 - DNA, 22 bp, Artificial Sequence
  chemically synthesized
ctccttcaccttccaccatgat

SEQ ID NO: 154309 - DNA, 22 bp, Artificial Sequence
  chemically synthesized
cttcaccttccaccatgattgt

SEQ ID NO: 154310 - DNA, 22 bp, Artificial Sequence
  chemically synthesized
caccttccaccatgattgtaag

SEQ ID NO: 154311 - DNA, 22 bp, Artificial Sequence
  chemically synthesized
accttccaccatgattgtaagg

SEQ ID NO: 154312 - DNA, 22 bp, Artificial Sequence
  chemically synthesized
ccaccatgattgtaaggcctcc

SEQ ID NO: 154313 - DNA, 22 bp, Artificial Sequence
  chemically synthesized
caccatgattgtaaggcctccc

SEQ ID NO: 154314 - DNA, 22 bp, Artificial Sequence
  chemically synthesized
taaggcctccccagcaatgtgg

SEQ ID NO: 154315 - DNA, 22 bp, Artificial Sequence
  chemically synthesized
cccagcaatgtggatctatgag

SEQ ID NO: 154316 - DNA, 22 bp, Artificial Sequence
  chemically synthesized
tgagtccattaaatctcttttt

SEQ ID NO: 154317 - DNA, 22 bp, Artificial Sequence
  chemically synthesized
aatctctttttctttataaatt

SEQ ID NO: 154318 - DNA, 22 bp, Artificial Sequence
  chemically synthesized
tttttctttataaattacccag

SEQ ID NO: 154319 - DNA, 22 bp, Artificial Sequence
  chemically synthesized
tttctttataaattacccagtc

SEQ ID NO: 154320 - DNA, 22 bp, Artificial Sequence
  chemically synthesized
ttctttataaattacccagtct

SEQ ID NO: 154321 - DNA, 22 bp, Artificial Sequence
  chemically synthesized
tctttataaattacccagtctc

SEQ ID NO: 154322 - DNA, 22 bp, Artificial Sequence
  chemically synthesized
ctttataaattacccagtctcg

SEQ ID NO: 154323 - DNA, 22 bp, Artificial Sequence
  chemically synthesized
tttataaattacccagtctcgg

SEQ ID NO: 154324 - DNA, 22 bp, Artificial Sequence
  chemically synthesized
tataaattacccagtctcgggt

SEQ ID NO: 154325 - DNA, 22 bp, Artificial Sequence
  chemically synthesized
ataaattacccagtctcgggta

SEQ ID NO: 154326 - DNA, 22 bp, Artificial Sequence
  chemically synthesized
taaattacccagtctcgggtat

SEQ ID NO: 154327 - DNA, 22 bp, Artificial Sequence
  chemically synthesized
cccagtctcgggtatttcttca

SEQ ID NO: 154328 - DNA, 22 bp, Artificial Sequence
  chemically synthesized
gggtatttcttcatagcagttt

SEQ ID NO: 154329 - DNA, 22 bp, Artificial Sequence
  chemically synthesized
cttcatagcagtttaaaacgga

SEQ ID NO: 154330 - DNA, 22 bp, Artificial Sequence
  chemically synthesized
ttcatagcagtttaaaacggac

SEQ ID NO: 154331 - DNA, 22 bp, Artificial Sequence
  chemically synthesized
catagcagtttaaaacggacaa

SEQ ID NO: 154332 - DNA, 22 bp, Artificial Sequence
  chemically synthesized
atagcagtttaaaacggacaaa

SEQ ID NO: 154333 - DNA, 22 bp, Artificial Sequence
  chemically synthesized
aaaacggacaaatacacacctt

SEQ ID NO: 154334 - DNA, 22 bp, Artificial Sequence
  chemically synthesized
aaacggacaaatacacacctta

SEQ ID NO: 154335 - DNA, 22 bp, Artificial Sequence
  chemically synthesized
aacactccaaaataatctcctt

SEQ ID NO: 154336 - DNA, 22 bp, Artificial Sequence
  chemically synthesized
acactccaaaataatctccttt

SEQ ID NO: 154337 - DNA, 22 bp, Artificial Sequence
  chemically synthesized
caaaataatctcctttgacccc

SEQ ID NO: 154338 - DNA, 22 bp, Artificial Sequence
  chemically synthesized
ctttgaccccatgtctcatatc

SEQ ID NO: 154339 - DNA, 22 bp, Artificial Sequence
  chemically synthesized
tgaccccatgtctcatatcagg

SEQ ID NO: 154340 - DNA, 22 bp, Artificial Sequence
  chemically synthesized
gaccccatgtctcatatcaggg

SEQ ID NO: 154341 - DNA, 22 bp, Artificial Sequence
  chemically synthesized
accccatgtctcatatcaggga

SEQ ID NO: 154342 - DNA, 22 bp, Artificial Sequence
  chemically synthesized
atatcagggacacactgatgca

SEQ ID NO: 154343 - DNA, 22 bp, Artificial Sequence
  chemically synthesized
atgcaagaggtgggctcccaag

SEQ ID NO: 154344 - DNA, 22 bp, Artificial Sequence
  chemically synthesized
ccaaggccttgggcagttccac

SEQ ID NO: 154345 - DNA, 22 bp, Artificial Sequence
  chemically synthesized
gggcagttccacccctattgct

SEQ ID NO: 154346 - DNA, 22 bp, Artificial Sequence
  chemically synthesized
ggcagttccacccctattgctt

SEQ ID NO: 154347 - DNA, 22 bp, Artificial Sequence
  chemically synthesized
cacccctattgctttgcacagt

SEQ ID NO: 154348 - DNA, 22 bp, Artificial Sequence
  chemically synthesized
ttgctttgcacagtttagcccc

SEQ ID NO: 154349 - DNA, 22 bp, Artificial Sequence
  chemically synthesized
ctttgcacagtttagcccctgc

SEQ ID NO: 154350 - DNA, 22 bp, Artificial Sequence
  chemically synthesized
tgcacagtttagcccctgctgc

SEQ ID NO: 154351 - DNA, 22 bp, Artificial Sequence
  chemically synthesized
gcacagtttagcccctgctgct

SEQ ID NO: 154352 - DNA, 22 bp, Artificial Sequence
  chemically synthesized
cacagtttagcccctgctgctg

SEQ ID NO: 154353 - DNA, 22 bp, Artificial Sequence
  chemically synthesized
agcccctgctgctgctcttaag

SEQ ID NO: 154354 - DNA, 22 bp, Artificial Sequence
  chemically synthesized
gcccctgctgctgctcttaaga

SEQ ID NO: 154355 - DNA, 22 bp, Artificial Sequence
  chemically synthesized
ctgctgctcttaagagattgta

SEQ ID NO: 154356 - DNA, 22 bp, Artificial Sequence
  chemically synthesized
ctgctcttaagagattgtattg

SEQ ID NO: 154357 - DNA, 22 bp, Artificial Sequence
  chemically synthesized
ctcttaagagattgtattgagt

SEQ ID NO: 154358 - DNA, 22 bp, Artificial Sequence
  chemically synthesized
ttaagagattgtattgagtgtt

SEQ ID NO: 154359 - DNA, 22 bp, Artificial Sequence
  chemically synthesized
aagagattgtattgagtgtttg

SEQ ID NO: 154360 - DNA, 22 bp, Artificial Sequence
  chemically synthesized
agagattgtattgagtgtttgc

SEQ ID NO: 154361 - DNA, 22 bp, Artificial Sequence
  chemically synthesized
tattgagtgtttgcagcttttc

SEQ ID NO: 154362 - DNA, 22 bp, Artificial Sequence
  chemically synthesized
agtgtttgcagcttttctaggt

SEQ ID NO: 154363 - DNA, 22 bp, Artificial Sequence
  chemically synthesized
gcagcttttctaggtgcacggt

SEQ ID NO: 154364 - DNA, 22 bp, Artificial Sequence
  chemically synthesized
cagcttttctaggtgcacggtg

SEQ ID NO: 154365 - DNA, 22 bp, Artificial Sequence
  chemically synthesized
ttctaggtgcacggtgcaaact

SEQ ID NO: 154366 - DNA, 22 bp, Artificial Sequence
  chemically synthesized
tctaggtgcacggtgcaaactg

SEQ ID NO: 154367 - DNA, 22 bp, Artificial Sequence
  chemically synthesized
ctaggtgcacggtgcaaactgt

SEQ ID NO: 154368 - DNA, 22 bp, Artificial Sequence
  chemically synthesized
taggtgcacggtgcaaactgtc

SEQ ID NO: 154369 - DNA, 22 bp, Artificial Sequence
  chemically synthesized
ggtgcacggtgcaaactgtcag

SEQ ID NO: 154370 - DNA, 22 bp, Artificial Sequence
  chemically synthesized
tcagtggatctaccattctggg

SEQ ID NO: 154371 - DNA, 22 bp, Artificial Sequence
  chemically synthesized
ccattctggggtctggaggacg

SEQ ID NO: 154372 - DNA, 22 bp, Artificial Sequence
  chemically synthesized
tggggtctggaggacggtggcc

SEQ ID NO: 154373 - DNA, 22 bp, Artificial Sequence
  chemically synthesized
gggtctggaggacggtggccct

SEQ ID NO: 154374 - DNA, 22 bp, Artificial Sequence
  chemically synthesized
gaggacggtggcccttttctca

SEQ ID NO: 154375 - DNA, 22 bp, Artificial Sequence
  chemically synthesized
ttctcatagctctgctaggcag

SEQ ID NO: 154376 - DNA, 22 bp, Artificial Sequence
  chemically synthesized
tctcatagctctgctaggcagt

SEQ ID NO: 154377 - DNA, 22 bp, Artificial Sequence
  chemically synthesized
ctcatagctctgctaggcagtg

SEQ ID NO: 154378 - DNA, 22 bp, Artificial Sequence
  chemically synthesized
tcatagctctgctaggcagtgc

SEQ ID NO: 154379 - DNA, 22 bp, Artificial Sequence
  chemically synthesized
atagctctgctaggcagtgccc

SEQ ID NO: 154380 - DNA, 22 bp, Artificial Sequence
  chemically synthesized
tgctaggcagtgccccagtgga

SEQ ID NO: 154381 - DNA, 22 bp, Artificial Sequence
  chemically synthesized
ctaggcagtgccccagtggaga

SEQ ID NO: 154382 - DNA, 22 bp, Artificial Sequence
  chemically synthesized
ggcagtgccccagtggagactc

SEQ ID NO: 154383 - DNA, 22 bp, Artificial Sequence
  chemically synthesized
tgtgagggggttccaacctcat

SEQ ID NO: 154384 - DNA, 22 bp, Artificial Sequence
  chemically synthesized
tgagggggttccaacctcatat

SEQ ID NO: 154385 - DNA, 22 bp, Artificial Sequence
  chemically synthesized
caacctcatatttttcctccac

SEQ ID NO: 154386 - DNA, 22 bp, Artificial Sequence
  chemically synthesized
atatttttcctccacattgccc

SEQ ID NO: 154387 - DNA, 22 bp, Artificial Sequence
  chemically synthesized
ttcctccacattgccctattag

SEQ ID NO: 154388 - DNA, 22 bp, Artificial Sequence
  chemically synthesized
tcctccacattgccctattaga

SEQ ID NO: 154389 - DNA, 22 bp, Artificial Sequence
  chemically synthesized
cctccacattgccctattagag

SEQ ID NO: 154390 - DNA, 22 bp, Artificial Sequence
  chemically synthesized
ctccacattgccctattagagg

SEQ ID NO: 154391 - DNA, 22 bp, Artificial Sequence
  chemically synthesized
cacattgccctattagaggttc

SEQ ID NO: 154392 - DNA, 22 bp, Artificial Sequence
  chemically synthesized
ccctattagaggttcttcatga

SEQ ID NO: 154393 - DNA, 22 bp, Artificial Sequence
  chemically synthesized
ttagaggttcttcatgagggtt

SEQ ID NO: 154394 - DNA, 22 bp, Artificial Sequence
  chemically synthesized
gaggttcttcatgagggttctg

SEQ ID NO: 154395 - DNA, 22 bp, Artificial Sequence
  chemically synthesized
ttcatgagggttctgcccctgc

SEQ ID NO: 154396 - DNA, 22 bp, Artificial Sequence
  chemically synthesized
catgagggttctgcccctgcag

SEQ ID NO: 154397 - DNA, 22 bp, Artificial Sequence
  chemically synthesized
atgagggttctgcccctgcagg

SEQ ID NO: 154398 - DNA, 22 bp, Artificial Sequence
  chemically synthesized
tgcccctgcaggaggcttctgc

SEQ ID NO: 154399 - DNA, 22 bp, Artificial Sequence
  chemically synthesized
cccctgcaggaggcttctgcct

SEQ ID NO: 154400 - DNA, 22 bp, Artificial Sequence
  chemically synthesized
caggaggcttctgcctgaacac

SEQ ID NO: 154401 - DNA, 22 bp, Artificial Sequence
  chemically synthesized
ctgcctgaacactcaggctttt

SEQ ID NO: 154402 - DNA, 22 bp, Artificial Sequence
  chemically synthesized
tgcctgaacactcaggcttttc

SEQ ID NO: 154403 - DNA, 22 bp, Artificial Sequence
  chemically synthesized
cctgaacactcaggcttttcta

SEQ ID NO: 154404 - DNA, 22 bp, Artificial Sequence
  chemically synthesized
aacactcaggcttttctacaca

SEQ ID NO: 154405 - DNA, 22 bp, Artificial Sequence
  chemically synthesized
aggcttttctacacatcctctg

SEQ ID NO: 154406 - DNA, 22 bp, Artificial Sequence
  chemically synthesized
ttctacacatcctctgaaatct

SEQ ID NO: 154407 - DNA, 22 bp, Artificial Sequence
  chemically synthesized
tctacacatcctctgaaatcta

SEQ ID NO: 154408 - DNA, 22 bp, Artificial Sequence
  chemically synthesized
ctacacatcctctgaaatctag

SEQ ID NO: 154409 - DNA, 22 bp, Artificial Sequence
  chemically synthesized
tacacatcctctgaaatctagg

SEQ ID NO: 154410 - DNA, 22 bp, Artificial Sequence
  chemically synthesized
cacatcctctgaaatctaggtg

SEQ ID NO: 154411 - DNA, 22 bp, Artificial Sequence
  chemically synthesized
tgaaatctaggtggaggcttac

SEQ ID NO: 154412 - DNA, 22 bp, Artificial Sequence
  chemically synthesized
aaatctaggtggaggcttacaa

SEQ ID NO: 154413 - DNA, 22 bp, Artificial Sequence
  chemically synthesized
ggtggaggcttacaagcctcaa

SEQ ID NO: 154414 - DNA, 22 bp, Artificial Sequence
  chemically synthesized
acaagcctcaactttttgacct

SEQ ID NO: 154415 - DNA, 22 bp, Artificial Sequence
  chemically synthesized
caagcctcaactttttgacctt

SEQ ID NO: 154416 - DNA, 22 bp, Artificial Sequence
  chemically synthesized
aactttttgacctttgcacact

SEQ ID NO: 154417 - DNA, 22 bp, Artificial Sequence
  chemically synthesized
tttgacctttgcacactcccag

SEQ ID NO: 154418 - DNA, 22 bp, Artificial Sequence
  chemically synthesized
ttgacctttgcacactcccaga

SEQ ID NO: 154419 - DNA, 22 bp, Artificial Sequence
  chemically synthesized
tgacctttgcacactcccagat

SEQ ID NO: 154420 - DNA, 22 bp, Artificial Sequence
  chemically synthesized
gacctttgcacactcccagatt

SEQ ID NO: 154421 - DNA, 22 bp, Artificial Sequence
  chemically synthesized
acctttgcacactcccagattt

SEQ ID NO: 154422 - DNA, 22 bp, Artificial Sequence
  chemically synthesized
tgcacactcccagatttatcac

SEQ ID NO: 154423 - DNA, 22 bp, Artificial Sequence
  chemically synthesized
gcacactcccagatttatcacc

SEQ ID NO: 154424 - DNA, 22 bp, Artificial Sequence
  chemically synthesized
cacactcccagatttatcacca

SEQ ID NO: 154425 - DNA, 22 bp, Artificial Sequence
  chemically synthesized
ccagatttatcaccatgtggaa

SEQ ID NO: 154426 - DNA, 22 bp, Artificial Sequence
  chemically synthesized
atcaccatgtggaagcctccaa

SEQ ID NO: 154427 - DNA, 22 bp, Artificial Sequence
  chemically synthesized
tcaccatgtggaagcctccaag

SEQ ID NO: 154428 - DNA, 22 bp, Artificial Sequence
  chemically synthesized
caaggcttatgtcttgcaccct

SEQ ID NO: 154429 - DNA, 22 bp, Artificial Sequence
  chemically synthesized
atgtcttgcaccctctgaagca

SEQ ID NO: 154430 - DNA, 22 bp, Artificial Sequence
  chemically synthesized
tgtcttgcaccctctgaagcag

SEQ ID NO: 154431 - DNA, 22 bp, Artificial Sequence
  chemically synthesized
gcaccctctgaagcagtggcct

SEQ ID NO: 154432 - DNA, 22 bp, Artificial Sequence
  chemically synthesized
caccctctgaagcagtggcctt

SEQ ID NO: 154433 - DNA, 22 bp, Artificial Sequence
  chemically synthesized
tgaagcagtggccttagctgtt

SEQ ID NO: 154434 - DNA, 22 bp, Artificial Sequence
  chemically synthesized
aagcagtggccttagctgttct

SEQ ID NO: 154435 - DNA, 22 bp, Artificial Sequence
  chemically synthesized
agctgttcttgggcccctttga

SEQ ID NO: 154436 - DNA, 22 bp, Artificial Sequence
  chemically synthesized
gctgttcttgggcccctttgag

SEQ ID NO: 154437 - DNA, 22 bp, Artificial Sequence
  chemically synthesized
ttcttgggcccctttgagccac

SEQ ID NO: 154438 - DNA, 22 bp, Artificial Sequence
  chemically synthesized
ttgggcccctttgagccacagc

SEQ ID NO: 154439 - DNA, 22 bp, Artificial Sequence
  chemically synthesized
gggcccctttgagccacagctg

SEQ ID NO: 154440 - DNA, 22 bp, Artificial Sequence
  chemically synthesized
ggcccctttgagccacagctgg

SEQ ID NO: 154441 - DNA, 22 bp, Artificial Sequence
  chemically synthesized
tgagccacagctggtgctggag

SEQ ID NO: 154442 - DNA, 22 bp, Artificial Sequence
  chemically synthesized
gagccacagctggtgctggagc

SEQ ID NO: 154443 - DNA, 22 bp, Artificial Sequence
  chemically synthesized
agccacagctggtgctggagca

SEQ ID NO: 154444 - DNA, 22 bp, Artificial Sequence
  chemically synthesized
gtgctggagcagccaggatgca

SEQ ID NO: 154445 - DNA, 22 bp, Artificial Sequence
  chemically synthesized
gagcagccaggatgcaaggaac

SEQ ID NO: 154446 - DNA, 22 bp, Artificial Sequence
  chemically synthesized
aagctgctcaaggcagcagggt

SEQ ID NO: 154447 - DNA, 22 bp, Artificial Sequence
  chemically synthesized
ctcaaggcagcagggtcctgaa

SEQ ID NO: 154448 - DNA, 22 bp, Artificial Sequence
  chemically synthesized
aaggcagcagggtcctgaatct

SEQ ID NO: 154449 - DNA, 22 bp, Artificial Sequence
  chemically synthesized
aatctcacccacaaaatcattc

SEQ ID NO: 154450 - DNA, 22 bp, Artificial Sequence
  chemically synthesized
acccacaaaatcattcagtact

SEQ ID NO: 154451 - DNA, 22 bp, Artificial Sequence
  chemically synthesized
agtactcctaggccaccaggcc

SEQ ID NO: 154452 - DNA, 22 bp, Artificial Sequence
  chemically synthesized
ctaggccaccaggcctgtgatg

SEQ ID NO: 154453 - DNA, 22 bp, Artificial Sequence
  chemically synthesized
ggccaccaggcctgtgatgtga

SEQ ID NO: 154454 - DNA, 22 bp, Artificial Sequence
  chemically synthesized
tgatgtgaggggctgctacaag

SEQ ID NO: 154455 - DNA, 22 bp, Artificial Sequence
  chemically synthesized
ctacaagggtctctgaaatgtc

SEQ ID NO: 154456 - DNA, 22 bp, Artificial Sequence
  chemically synthesized
caagggtctctgaaatgtcttt

SEQ ID NO: 154457 - DNA, 22 bp, Artificial Sequence
  chemically synthesized
tgaaatgtctttgaggcattct

SEQ ID NO: 154458 - DNA, 22 bp, Artificial Sequence
  chemically synthesized
aaatgtctttgaggcattctcc

SEQ ID NO: 154459 - DNA, 22 bp, Artificial Sequence
  chemically synthesized
tgaggcattctcccctttattt

SEQ ID NO: 154460 - DNA, 22 bp, Artificial Sequence
  chemically synthesized
gaggcattctcccctttatttt

SEQ ID NO: 154461 - DNA, 22 bp, Artificial Sequence
  chemically synthesized
aggcattctcccctttattttg

SEQ ID NO: 154462 - DNA, 22 bp, Artificial Sequence
  chemically synthesized
tcccctttattttggctattag

SEQ ID NO: 154463 - DNA, 22 bp, Artificial Sequence
  chemically synthesized
ccctttattttggctattagaa

SEQ ID NO: 154464 - DNA, 22 bp, Artificial Sequence
  chemically synthesized
tattttggctattagaactcgg

SEQ ID NO: 154465 - DNA, 22 bp, Artificial Sequence
  chemically synthesized
attttggctattagaactcggc

SEQ ID NO: 154466 - DNA, 22 bp, Artificial Sequence
  chemically synthesized
ttttggctattagaactcggct

SEQ ID NO: 154467 - DNA, 22 bp, Artificial Sequence
  chemically synthesized
tggctattagaactcggctcct

SEQ ID NO: 154468 - DNA, 22 bp, Artificial Sequence
  chemically synthesized
ggctattagaactcggctcctc

SEQ ID NO: 154469 - DNA, 22 bp, Artificial Sequence
  chemically synthesized
gctattagaactcggctcctct

SEQ ID NO: 154470 - DNA, 22 bp, Artificial Sequence
  chemically synthesized
ttagaactcggctcctcttcat

SEQ ID NO: 154471 - DNA, 22 bp, Artificial Sequence
  chemically synthesized
gaactcggctcctcttcattta

SEQ ID NO: 154472 - DNA, 22 bp, Artificial Sequence
  chemically synthesized
ggctcctcttcatttatgcaaa

SEQ ID NO: 154473 - DNA, 22 bp, Artificial Sequence
  chemically synthesized
ctcttcatttatgcaaatttct

SEQ ID NO: 154474 - DNA, 22 bp, Artificial Sequence
  chemically synthesized
ttcatttatgcaaatttctaca

SEQ ID NO: 154475 - DNA, 22 bp, Artificial Sequence
  chemically synthesized
catttatgcaaatttctacagc

SEQ ID NO: 154476 - DNA, 22 bp, Artificial Sequence
  chemically synthesized
atttatgcaaatttctacagcc

SEQ ID NO: 154477 - DNA, 22 bp, Artificial Sequence
  chemically synthesized
atgcaaatttctacagcctgct

SEQ ID NO: 154478 - DNA, 22 bp, Artificial Sequence
  chemically synthesized
tgcaaatttctacagcctgctt

SEQ ID NO: 154479 - DNA, 22 bp, Artificial Sequence
  chemically synthesized
ctacagcctgcttgaattgctc

SEQ ID NO: 154480 - DNA, 22 bp, Artificial Sequence
  chemically synthesized
tacagcctgcttgaattgctcc

SEQ ID NO: 154481 - DNA, 22 bp, Artificial Sequence
  chemically synthesized
cagcctgcttgaattgctcctt

SEQ ID NO: 154482 - DNA, 22 bp, Artificial Sequence
  chemically synthesized
cttgaattgctcctttgaaaat

SEQ ID NO: 154483 - DNA, 22 bp, Artificial Sequence
  chemically synthesized
gaattgctcctttgaaaatgag

SEQ ID NO: 154484 - DNA, 22 bp, Artificial Sequence
  chemically synthesized
aattgctcctttgaaaatgagc

SEQ ID NO: 154485 - DNA, 22 bp, Artificial Sequence
  chemically synthesized
ctcctttgaaaatgagcttctg

SEQ ID NO: 154486 - DNA, 22 bp, Artificial Sequence
  chemically synthesized
ctttgaaaatgagcttctgttt

SEQ ID NO: 154487 - DNA, 22 bp, Artificial Sequence
  chemically synthesized
tgaaaatgagcttctgttttct

SEQ ID NO: 154488 - DNA, 22 bp, Artificial Sequence
  chemically synthesized
gaaaatgagcttctgttttcta

SEQ ID NO: 154489 - DNA, 22 bp, Artificial Sequence
  chemically synthesized
aaaatgagcttctgttttctac

SEQ ID NO: 154490 - DNA, 22 bp, Artificial Sequence
  chemically synthesized
ctgttttctaccacatggccga

SEQ ID NO: 154491 - DNA, 22 bp, Artificial Sequence
  chemically synthesized
tgttttctaccacatggccgag

SEQ ID NO: 154492 - DNA, 22 bp, Artificial Sequence
  chemically synthesized
ttttctaccacatggccgagca

SEQ ID NO: 154493 - DNA, 22 bp, Artificial Sequence
  chemically synthesized
tctaccacatggccgagcagat

SEQ ID NO: 154494 - DNA, 22 bp, Artificial Sequence
  chemically synthesized
ctaccacatggccgagcagata

SEQ ID NO: 154495 - DNA, 22 bp, Artificial Sequence
  chemically synthesized
taccacatggccgagcagataa

SEQ ID NO: 154496 - DNA, 22 bp, Artificial Sequence
  chemically synthesized
ccacatggccgagcagataatt

SEQ ID NO: 154497 - DNA, 22 bp, Artificial Sequence
  chemically synthesized
tccaaacttttatgctctgctt

SEQ ID NO: 154498 - DNA, 22 bp, Artificial Sequence
  chemically synthesized
ccaaacttttatgctctgcttc

SEQ ID NO: 154499 - DNA, 22 bp, Artificial Sequence
  chemically synthesized
caaacttttatgctctgcttcc

SEQ ID NO: 154500 - DNA, 22 bp, Artificial Sequence
  chemically synthesized
ttatgctctgcttcccttttaa

SEQ ID NO: 154501 - DNA, 22 bp, Artificial Sequence
  chemically synthesized
tatgctctgcttcccttttaaa

SEQ ID NO: 154502 - DNA, 22 bp, Artificial Sequence
  chemically synthesized
atgctctgcttcccttttaaat

SEQ ID NO: 154503 - DNA, 22 bp, Artificial Sequence
  chemically synthesized
tgctctgcttcccttttaaata

SEQ ID NO: 154504 - DNA, 22 bp, Artificial Sequence
  chemically synthesized
tgcttcccttttaaatataagt

SEQ ID NO: 154505 - DNA, 22 bp, Artificial Sequence
  chemically synthesized
cttcccttttaaatataagttc

SEQ ID NO: 154506 - DNA, 22 bp, Artificial Sequence
  chemically synthesized
cccttttaaatataagttctga

SEQ ID NO: 154507 - DNA, 22 bp, Artificial Sequence
  chemically synthesized
ccttttaaatataagttctgat

SEQ ID NO: 154508 - DNA, 22 bp, Artificial Sequence
  chemically synthesized
ttaaatataagttctgatttta

SEQ ID NO: 154509 - DNA, 22 bp, Artificial Sequence
  chemically synthesized
taaatataagttctgattttat

SEQ ID NO: 154510 - DNA, 22 bp, Artificial Sequence
  chemically synthesized
aaatataagttctgattttatg

SEQ ID NO: 154511 - DNA, 22 bp, Artificial Sequence
  chemically synthesized
aatataagttctgattttatgt

SEQ ID NO: 154512 - DNA, 22 bp, Artificial Sequence
  chemically synthesized
tgattttatgttatttctttgc

SEQ ID NO: 154513 - DNA, 22 bp, Artificial Sequence
  chemically synthesized
attttatgttatttctttgctc

SEQ ID NO: 154514 - DNA, 22 bp, Artificial Sequence
  chemically synthesized
tatgttatttctttgctcacac

SEQ ID NO: 154515 - DNA, 22 bp, Artificial Sequence
  chemically synthesized
atgttatttctttgctcacaca

SEQ ID NO: 154516 - DNA, 22 bp, Artificial Sequence
  chemically synthesized
tgttatttctttgctcacacat

SEQ ID NO: 154517 - DNA, 22 bp, Artificial Sequence
  chemically synthesized
tttctttgctcacacatatgag

SEQ ID NO: 154518 - DNA, 22 bp, Artificial Sequence
  chemically synthesized
ctttgctcacacatatgagcat

SEQ ID NO: 154519 - DNA, 22 bp, Artificial Sequence
  chemically synthesized
tttgctcacacatatgagcata

SEQ ID NO: 154520 - DNA, 22 bp, Artificial Sequence
  chemically synthesized
tgctcacacatatgagcatagg

SEQ ID NO: 154521 - DNA, 22 bp, Artificial Sequence
  chemically synthesized
gctcacacatatgagcataggt

SEQ ID NO: 154522 - DNA, 22 bp, Artificial Sequence
  chemically synthesized
ctcacacatatgagcataggtt

SEQ ID NO: 154523 - DNA, 22 bp, Artificial Sequence
  chemically synthesized
acacatatgagcataggttgtt

SEQ ID NO: 154524 - DNA, 22 bp, Artificial Sequence
  chemically synthesized
ttagaagcagccaggacacatc

SEQ ID NO: 154525 - DNA, 22 bp, Artificial Sequence
  chemically synthesized
gaagcagccaggacacatcttg

SEQ ID NO: 154526 - DNA, 22 bp, Artificial Sequence
  chemically synthesized
gaacaccttgctgcttagaaac

SEQ ID NO: 154527 - DNA, 22 bp, Artificial Sequence
  chemically synthesized
aacaccttgctgcttagaaact

SEQ ID NO: 154528 - DNA, 22 bp, Artificial Sequence
  chemically synthesized
gctgcttagaaacttctgtcac

SEQ ID NO: 154529 - DNA, 22 bp, Artificial Sequence
  chemically synthesized
ctgcttagaaacttctgtcaca

SEQ ID NO: 154530 - DNA, 22 bp, Artificial Sequence
  chemically synthesized
cttagaaacttctgtcacataa

SEQ ID NO: 154531 - DNA, 22 bp, Artificial Sequence
  chemically synthesized
agaaacttctgtcacataactt

SEQ ID NO: 154532 - DNA, 22 bp, Artificial Sequence
  chemically synthesized
gaaacttctgtcacataactta

SEQ ID NO: 154533 - DNA, 22 bp, Artificial Sequence
  chemically synthesized
ctgtcacataacttaaataata

SEQ ID NO: 154534 - DNA, 22 bp, Artificial Sequence
  chemically synthesized
tgtcacataacttaaataatat

SEQ ID NO: 154535 - DNA, 22 bp, Artificial Sequence
  chemically synthesized
tcacataacttaaataatatta

SEQ ID NO: 154536 - DNA, 22 bp, Artificial Sequence
  chemically synthesized
aaataatattatcaacttcgaa

SEQ ID NO: 154537 - DNA, 22 bp, Artificial Sequence
  chemically synthesized
aataatattatcaacttcgaat

SEQ ID NO: 154538 - DNA, 22 bp, Artificial Sequence
  chemically synthesized
tcaacttcgaatttccacagat

SEQ ID NO: 154539 - DNA, 22 bp, Artificial Sequence
  chemically synthesized
cgaatttccacagattctctaa

SEQ ID NO: 154540 - DNA, 22 bp, Artificial Sequence
  chemically synthesized
gaatttccacagattctctaag

SEQ ID NO: 154541 - DNA, 22 bp, Artificial Sequence
  chemically synthesized
ccacagattctctaaggtagag

SEQ ID NO: 154542 - DNA, 22 bp, Artificial Sequence
  chemically synthesized
cacagattctctaaggtagagg

SEQ ID NO: 154543 - DNA, 22 bp, Artificial Sequence
  chemically synthesized
tctaaggtagaggcacagtgca

SEQ ID NO: 154544 - DNA, 22 bp, Artificial Sequence
  chemically synthesized
taaggtagaggcacagtgcagt

SEQ ID NO: 154545 - DNA, 22 bp, Artificial Sequence
  chemically synthesized
aggtagaggcacagtgcagtca

SEQ ID NO: 154546 - DNA, 22 bp, Artificial Sequence
  chemically synthesized
tttgctaatgtataacaaaagt

SEQ ID NO: 154547 - DNA, 22 bp, Artificial Sequence
  chemically synthesized
tgctaatgtataacaaaagtga

SEQ ID NO: 154548 - DNA, 22 bp, Artificial Sequence
  chemically synthesized
gctaatgtataacaaaagtgac

SEQ ID NO: 154549 - DNA, 22 bp, Artificial Sequence
  chemically synthesized
ctaatgtataacaaaagtgacc

SEQ ID NO: 154550 - DNA, 22 bp, Artificial Sequence
  chemically synthesized
atgtataacaaaagtgaccttt

SEQ ID NO: 154551 - DNA, 22 bp, Artificial Sequence
  chemically synthesized
tgctccagtttccaataaattc

SEQ ID NO: 154552 - DNA, 22 bp, Artificial Sequence
  chemically synthesized
gctccagtttccaataaattca

SEQ ID NO: 154553 - DNA, 22 bp, Artificial Sequence
  chemically synthesized
ctccagtttccaataaattcat

SEQ ID NO: 154554 - DNA, 22 bp, Artificial Sequence
  chemically synthesized
cagtttccaataaattcatttc

SEQ ID NO: 154555 - DNA, 22 bp, Artificial Sequence
  chemically synthesized
ccaataaattcatttccatctg

SEQ ID NO: 154556 - DNA, 22 bp, Artificial Sequence
  chemically synthesized
caataaattcatttccatctga

SEQ ID NO: 154557 - DNA, 22 bp, Artificial Sequence
  chemically synthesized
atttccatctgagaccacctca

SEQ ID NO: 154558 - DNA, 22 bp, Artificial Sequence
  chemically synthesized
ccatctgagaccacctcagcct

SEQ ID NO: 154559 - DNA, 22 bp, Artificial Sequence
  chemically synthesized
catctgagaccacctcagcctg

SEQ ID NO: 154560 - DNA, 22 bp, Artificial Sequence
  chemically synthesized
agaccacctcagcctggacttc

SEQ ID NO: 154561 - DNA, 22 bp, Artificial Sequence
  chemically synthesized
agcctggacttcattgtccata

SEQ ID NO: 154562 - DNA, 22 bp, Artificial Sequence
  chemically synthesized
gacttcattgtccatatcacta

SEQ ID NO: 154563 - DNA, 22 bp, Artificial Sequence
  chemically synthesized
cattgtccatatcactatcaga

SEQ ID NO: 154564 - DNA, 22 bp, Artificial Sequence
  chemically synthesized
attgtccatatcactatcagaa

SEQ ID NO: 154565 - DNA, 22 bp, Artificial Sequence
  chemically synthesized
tccatatcactatcagaatttt

SEQ ID NO: 154566 - DNA, 22 bp, Artificial Sequence
  chemically synthesized
tcagaattttggtcacaaccat

SEQ ID NO: 154567 - DNA, 22 bp, Artificial Sequence
  chemically synthesized
tggtcacaaccattccacaagt

SEQ ID NO: 154568 - DNA, 22 bp, Artificial Sequence
  chemically synthesized
ggtcacaaccattccacaagtc

SEQ ID NO: 154569 - DNA, 22 bp, Artificial Sequence
  chemically synthesized
gtcacaaccattccacaagtct

SEQ ID NO: 154570 - DNA, 22 bp, Artificial Sequence
  chemically synthesized
cacaagtctctagaaagttcca

SEQ ID NO: 154571 - DNA, 22 bp, Artificial Sequence
  chemically synthesized
tagaaagttccaaattctccct

SEQ ID NO: 154572 - DNA, 22 bp, Artificial Sequence
  chemically synthesized
gaaagttccaaattctccctca

SEQ ID NO: 154573 - DNA, 22 bp, Artificial Sequence
  chemically synthesized
caaattctccctcatctccctg

SEQ ID NO: 154574 - DNA, 22 bp, Artificial Sequence
  chemically synthesized
tccctcatctccctgtcttctt

SEQ ID NO: 154575 - DNA, 22 bp, Artificial Sequence
  chemically synthesized
cctcatctccctgtcttcttct

SEQ ID NO: 154576 - DNA, 22 bp, Artificial Sequence
  chemically synthesized
atctccctgtcttcttctgagc

SEQ ID NO: 154577 - DNA, 22 bp, Artificial Sequence
  chemically synthesized
cctgtcttcttctgagccgtcc

SEQ ID NO: 154578 - DNA, 22 bp, Artificial Sequence
  chemically synthesized
tcttcttctgagccgtccacac

SEQ ID NO: 154579 - DNA, 22 bp, Artificial Sequence
  chemically synthesized
cttctgagccgtccacactctt

SEQ ID NO: 154580 - DNA, 22 bp, Artificial Sequence
  chemically synthesized
ttctgagccgtccacactcttc

SEQ ID NO: 154581 - DNA, 22 bp, Artificial Sequence
  chemically synthesized
ctgagccgtccacactcttcca

SEQ ID NO: 154582 - DNA, 22 bp, Artificial Sequence
  chemically synthesized
tgagccgtccacactcttccaa

SEQ ID NO: 154583 - DNA, 22 bp, Artificial Sequence
  chemically synthesized
agccgtccacactcttccaact

SEQ ID NO: 154584 - DNA, 22 bp, Artificial Sequence
  chemically synthesized
ttccaacttctgcctgttatcc

SEQ ID NO: 154585 - DNA, 22 bp, Artificial Sequence
  chemically synthesized
ccaacttctgcctgttatccaa

SEQ ID NO: 154586 - DNA, 22 bp, Artificial Sequence
  chemically synthesized
caacttctgcctgttatccaat

SEQ ID NO: 154587 - DNA, 22 bp, Artificial Sequence
  chemically synthesized
ctgcctgttatccaatgccaaa

SEQ ID NO: 154588 - DNA, 22 bp, Artificial Sequence
  chemically synthesized
tgcctgttatccaatgccaaag

SEQ ID NO: 154589 - DNA, 22 bp, Artificial Sequence
  chemically synthesized
cctgttatccaatgccaaagtt

SEQ ID NO: 154590 - DNA, 22 bp, Artificial Sequence
  chemically synthesized
ttatccaatgccaaagttgctt

SEQ ID NO: 154591 - DNA, 22 bp, Artificial Sequence
  chemically synthesized
tccaatgccaaagttgcttcca

SEQ ID NO: 154592 - DNA, 22 bp, Artificial Sequence
  chemically synthesized
cttccacattttcatgtatctt

SEQ ID NO: 154593 - DNA, 22 bp, Artificial Sequence
  chemically synthesized
ccacattttcatgtatctttat

SEQ ID NO: 154594 - DNA, 22 bp, Artificial Sequence
  chemically synthesized
cacattttcatgtatctttata

SEQ ID NO: 154595 - DNA, 22 bp, Artificial Sequence
  chemically synthesized
tcatgtatctttatagcagtac

SEQ ID NO: 154596 - DNA, 22 bp, Artificial Sequence
  chemically synthesized
catgtatctttatagcagtacc

SEQ ID NO: 154597 - DNA, 22 bp, Artificial Sequence
  chemically synthesized
atgtatctttatagcagtaccc

SEQ ID NO: 154598 - DNA, 22 bp, Artificial Sequence
  chemically synthesized
tatagcagtaccccacttttgg

SEQ ID NO: 154599 - DNA, 22 bp, Artificial Sequence
  chemically synthesized
atagcagtaccccacttttggt

SEQ ID NO: 154600 - DNA, 22 bp, Artificial Sequence
  chemically synthesized
tagcagtaccccacttttggta

SEQ ID NO: 154601 - DNA, 22 bp, Artificial Sequence
  chemically synthesized
ttggtaccaattttctgtactg

SEQ ID NO: 154602 - DNA, 22 bp, Artificial Sequence
  chemically synthesized
tggtaccaattttctgtactgg

SEQ ID NO: 154603 - DNA, 22 bp, Artificial Sequence
  chemically synthesized
ggtaccaattttctgtactggt

SEQ ID NO: 154604 - DNA, 22 bp, Artificial Sequence
  chemically synthesized
gtaccaattttctgtactggtc

SEQ ID NO: 154605 - DNA, 22 bp, Artificial Sequence
  chemically synthesized
tctgtactggtccattctcatc

SEQ ID NO: 154606 - DNA, 22 bp, Artificial Sequence
  chemically synthesized
ctgtactggtccattctcatct

SEQ ID NO: 154607 - DNA, 22 bp, Artificial Sequence
  chemically synthesized
tgtactggtccattctcatctt

SEQ ID NO: 154608 - DNA, 22 bp, Artificial Sequence
  chemically synthesized
tactggtccattctcatcttgc

SEQ ID NO: 154609 - DNA, 22 bp, Artificial Sequence
  chemically synthesized
gtccattctcatcttgctataa

SEQ ID NO: 154610 - DNA, 22 bp, Artificial Sequence
  chemically synthesized
tcatcttgctataaggaaatac

SEQ ID NO: 154611 - DNA, 22 bp, Artificial Sequence
  chemically synthesized
atcttgctataaggaaatacct

SEQ ID NO: 154612 - DNA, 22 bp, Artificial Sequence
  chemically synthesized
gctataaggaaatacctgagac

SEQ ID NO: 154613 - DNA, 22 bp, Artificial Sequence
  chemically synthesized
ctataaggaaatacctgagact

SEQ ID NO: 154614 - DNA, 22 bp, Artificial Sequence
  chemically synthesized
taaggaaatacctgagactggg

SEQ ID NO: 154615 - DNA, 22 bp, Artificial Sequence
  chemically synthesized
agactgggtaaatggtgaagaa

SEQ ID NO: 154616 - DNA, 22 bp, Artificial Sequence
  chemically synthesized
ggtaaatggtgaagaacagaga

SEQ ID NO: 154617 - DNA, 22 bp, Artificial Sequence
  chemically synthesized
aattggctcacagttctaaagg

SEQ ID NO: 154618 - DNA, 22 bp, Artificial Sequence
  chemically synthesized
attggctcacagttctaaaggc

SEQ ID NO: 154619 - DNA, 22 bp, Artificial Sequence
  chemically synthesized
gctcacagttctaaaggctgta

SEQ ID NO: 154620 - DNA, 22 bp, Artificial Sequence
  chemically synthesized
acagttctaaaggctgtacagg

SEQ ID NO: 154621 - DNA, 22 bp, Artificial Sequence
  chemically synthesized
taaaggctgtacaggaagcatg

SEQ ID NO: 154622 - DNA, 22 bp, Artificial Sequence
  chemically synthesized
aaggctgtacaggaagcatggc

SEQ ID NO: 154623 - DNA, 22 bp, Artificial Sequence
  chemically synthesized
tacaggaagcatggcaacgtct

SEQ ID NO: 154624 - DNA, 22 bp, Artificial Sequence
  chemically synthesized
ctcagcttctagggaggtttca

SEQ ID NO: 154625 - DNA, 22 bp, Artificial Sequence
  chemically synthesized
agcttctagggaggtttcagga

SEQ ID NO: 154626 - DNA, 22 bp, Artificial Sequence
  chemically synthesized
ctagggaggtttcaggaaactt

SEQ ID NO: 154627 - DNA, 22 bp, Artificial Sequence
  chemically synthesized
tagggaggtttcaggaaactta

SEQ ID NO: 154628 - DNA, 22 bp, Artificial Sequence
  chemically synthesized
gggaggtttcaggaaacttata

SEQ ID NO: 154629 - DNA, 22 bp, Artificial Sequence
  chemically synthesized
caggaaacttataatcatggca

SEQ ID NO: 154630 - DNA, 22 bp, Artificial Sequence
  chemically synthesized
aggaaacttataatcatggcag

SEQ ID NO: 154631 - DNA, 22 bp, Artificial Sequence
  chemically synthesized
ataatcatggcagagagaaaaa

SEQ ID NO: 154632 - DNA, 22 bp, Artificial Sequence
  chemically synthesized
taatcatggcagagagaaaaac

SEQ ID NO: 154633 - DNA, 22 bp, Artificial Sequence
  chemically synthesized
cacatggctggagcaggaagaa

SEQ ID NO: 154634 - DNA, 22 bp, Artificial Sequence
  chemically synthesized
acatggctggagcaggaagaag

SEQ ID NO: 154635 - DNA, 22 bp, Artificial Sequence
  chemically synthesized
gagcaggaagaagaggcaggga

SEQ ID NO: 154636 - DNA, 22 bp, Artificial Sequence
  chemically synthesized
atgagaactcacccactatacg

SEQ ID NO: 154637 - DNA, 22 bp, Artificial Sequence
  chemically synthesized
acccactatacgtaccaaaagg

SEQ ID NO: 154638 - DNA, 22 bp, Artificial Sequence
  chemically synthesized
tacgtaccaaaagggactgata

SEQ ID NO: 154639 - DNA, 22 bp, Artificial Sequence
  chemically synthesized
atattaagctatttatgataac

SEQ ID NO: 154640 - DNA, 22 bp, Artificial Sequence
  chemically synthesized
agctatttatgataactctgct

SEQ ID NO: 154641 - DNA, 22 bp, Artificial Sequence
  chemically synthesized
tttatgataactctgctcctat

SEQ ID NO: 154642 - DNA, 22 bp, Artificial Sequence
  chemically synthesized
atgataactctgctcctatgat

SEQ ID NO: 154643 - DNA, 22 bp, Artificial Sequence
  chemically synthesized
tgataactctgctcctatgatc

SEQ ID NO: 154644 - DNA, 22 bp, Artificial Sequence
  chemically synthesized
tgctcctatgatccaatcactt

SEQ ID NO: 154645 - DNA, 22 bp, Artificial Sequence
  chemically synthesized
ctcctatgatccaatcacttcc

SEQ ID NO: 154646 - DNA, 22 bp, Artificial Sequence
  chemically synthesized
ctatgatccaatcacttcccac

SEQ ID NO: 154647 - DNA, 22 bp, Artificial Sequence
  chemically synthesized
tgatccaatcacttcccaccag

SEQ ID NO: 154648 - DNA, 22 bp, Artificial Sequence
  chemically synthesized
cccaccaggccccatcttcaac

SEQ ID NO: 154649 - DNA, 22 bp, Artificial Sequence
  chemically synthesized
ccaccaggccccatcttcaaca

SEQ ID NO: 154650 - DNA, 22 bp, Artificial Sequence
  chemically synthesized
caacactggggattacagctga

SEQ ID NO: 154651 - DNA, 22 bp, Artificial Sequence
  chemically synthesized
aacactggggattacagctgaa

SEQ ID NO: 154652 - DNA, 22 bp, Artificial Sequence
  chemically synthesized
gggattacagctgaacatgaga

SEQ ID NO: 154653 - DNA, 22 bp, Artificial Sequence
  chemically synthesized
cagctgaacatgagattagggt

SEQ ID NO: 154654 - DNA, 22 bp, Artificial Sequence
  chemically synthesized
aacatgagattagggtggagac

SEQ ID NO: 154655 - DNA, 22 bp, Artificial Sequence
  chemically synthesized
gggtggagacacagatccaaac

SEQ ID NO: 154656 - DNA, 22 bp, Artificial Sequence
  chemically synthesized
ctcttgtgattaaacacaattc

SEQ ID NO: 154657 - DNA, 22 bp, Artificial Sequence
  chemically synthesized
ttgtgattaaacacaattcaac

SEQ ID NO: 154658 - DNA, 22 bp, Artificial Sequence
  chemically synthesized
gtgattaaacacaattcaacaa

SEQ ID NO: 154659 - DNA, 22 bp, Artificial Sequence
  chemically synthesized
tgattaaacacaattcaacaaa

SEQ ID NO: 154660 - DNA, 22 bp, Artificial Sequence
  chemically synthesized
aacacaattcaacaaaatacat

SEQ ID NO: 154661 - DNA, 22 bp, Artificial Sequence
  chemically synthesized
aacaaaatacataaaatgtaag

SEQ ID NO: 154662 - DNA, 22 bp, Artificial Sequence
  chemically synthesized
aactttgtttctttaatacaag

SEQ ID NO: 154663 - DNA, 22 bp, Artificial Sequence
  chemically synthesized
tgtttctttaatacaagcagtc

SEQ ID NO: 154664 - DNA, 22 bp, Artificial Sequence
  chemically synthesized
gtttctttaatacaagcagtcg

SEQ ID NO: 154665 - DNA, 22 bp, Artificial Sequence
  chemically synthesized
tttctttaatacaagcagtcgt

SEQ ID NO: 154666 - DNA, 22 bp, Artificial Sequence
  chemically synthesized
ctttaatacaagcagtcgtatt

SEQ ID NO: 154667 - DNA, 22 bp, Artificial Sequence
  chemically synthesized
tttaatacaagcagtcgtattg

SEQ ID NO: 154668 - DNA, 22 bp, Artificial Sequence
  chemically synthesized
taatacaagcagtcgtattggc

SEQ ID NO: 154669 - DNA, 22 bp, Artificial Sequence
  chemically synthesized
aatacaagcagtcgtattggct

SEQ ID NO: 154670 - DNA, 22 bp, Artificial Sequence
  chemically synthesized
atacaagcagtcgtattggctt

SEQ ID NO: 154671 - DNA, 22 bp, Artificial Sequence
  chemically synthesized
gcttctatacaagtttatctct

SEQ ID NO: 154672 - DNA, 22 bp, Artificial Sequence
  chemically synthesized
ctatacaagtttatctctgcac

SEQ ID NO: 154673 - DNA, 22 bp, Artificial Sequence
  chemically synthesized
tatacaagtttatctctgcacg

SEQ ID NO: 154674 - DNA, 22 bp, Artificial Sequence
  chemically synthesized
tacaagtttatctctgcacgac

SEQ ID NO: 154675 - DNA, 22 bp, Artificial Sequence
  chemically synthesized
atctctgcacgacacacatatt

SEQ ID NO: 154676 - DNA, 22 bp, Artificial Sequence
  chemically synthesized
tctctgcacgacacacatatta

SEQ ID NO: 154677 - DNA, 22 bp, Artificial Sequence
  chemically synthesized
tgcacgacacacatattatgat

SEQ ID NO: 154678 - DNA, 22 bp, Artificial Sequence
  chemically synthesized
cacgacacacatattatgatgt

SEQ ID NO: 154679 - DNA, 22 bp, Artificial Sequence
  chemically synthesized
tgatgtattagaaggaagataa

SEQ ID NO: 154680 - DNA, 22 bp, Artificial Sequence
  chemically synthesized
gaaggaagataaatgtcatcaa

SEQ ID NO: 154681 - DNA, 22 bp, Artificial Sequence
  chemically synthesized
attaaggcaggtcctggtgtat

SEQ ID NO: 154682 - DNA, 22 bp, Artificial Sequence
  chemically synthesized
ttaaggcaggtcctggtgtatc

SEQ ID NO: 154683 - DNA, 22 bp, Artificial Sequence
  chemically synthesized
aggcaggtcctggtgtatcctt

SEQ ID NO: 154684 - DNA, 22 bp, Artificial Sequence
  chemically synthesized
gtgtatccttccttaaagaaaa

SEQ ID NO: 154685 - DNA, 22 bp, Artificial Sequence
  chemically synthesized
ccttaaagaaaagtatctaata

SEQ ID NO: 154686 - DNA, 22 bp, Artificial Sequence
  chemically synthesized
cttaaagaaaagtatctaataa

SEQ ID NO: 154687 - DNA, 22 bp, Artificial Sequence
  chemically synthesized
aaagaaaagtatctaataacct

SEQ ID NO: 154688 - DNA, 22 bp, Artificial Sequence
  chemically synthesized
aagaaaagtatctaataacctt

SEQ ID NO: 154689 - DNA, 22 bp, Artificial Sequence
  chemically synthesized
ataaccttacgttagctaaacg

SEQ ID NO: 154690 - DNA, 22 bp, Artificial Sequence
  chemically synthesized
acgttagctaaacgaagagata

SEQ ID NO: 154691 - DNA, 22 bp, Artificial Sequence
  chemically synthesized
cgttagctaaacgaagagataa

SEQ ID NO: 154692 - DNA, 22 bp, Artificial Sequence
  chemically synthesized
gctaaacgaagagataatatat

SEQ ID NO: 154693 - DNA, 22 bp, Artificial Sequence
  chemically synthesized
aacgaagagataatatattagt

SEQ ID NO: 154694 - DNA, 22 bp, Artificial Sequence
  chemically synthesized
gtaattcttcccagataaagat

SEQ ID NO: 154695 - DNA, 22 bp, Artificial Sequence
  chemically synthesized
ttcccagataaagatcatctct

SEQ ID NO: 154696 - DNA, 22 bp, Artificial Sequence
  chemically synthesized
cccagataaagatcatctctaa

SEQ ID NO: 154697 - DNA, 22 bp, Artificial Sequence
  chemically synthesized
ccagataaagatcatctctaaa

SEQ ID NO: 154698 - DNA, 22 bp, Artificial Sequence
  chemically synthesized
taaagtaattcacaaactccac

SEQ ID NO: 154699 - DNA, 22 bp, Artificial Sequence
  chemically synthesized
aagtaattcacaaactccacct

SEQ ID NO: 154700 - DNA, 22 bp, Artificial Sequence
  chemically synthesized
acaaactccacctggaaagaag

SEQ ID NO: 154701 - DNA, 22 bp, Artificial Sequence
  chemically synthesized
cacctggaaagaagagtggcta

SEQ ID NO: 154702 - DNA, 22 bp, Artificial Sequence
  chemically synthesized
gaaagaagagtggctattgctc

SEQ ID NO: 154703 - DNA, 22 bp, Artificial Sequence
  chemically synthesized
ttgctcaagctattcttcaatg

SEQ ID NO: 154704 - DNA, 22 bp, Artificial Sequence
  chemically synthesized
ctcaagctattcttcaatgtgg

SEQ ID NO: 154705 - DNA, 22 bp, Artificial Sequence
  chemically synthesized
aagctattcttcaatgtggcag

SEQ ID NO: 154706 - DNA, 22 bp, Artificial Sequence
  chemically synthesized
ttcttcaatgtggcaggggaaa

SEQ ID NO: 154707 - DNA, 22 bp, Artificial Sequence
  chemically synthesized
ttcaatgtggcaggggaaaaat

SEQ ID NO: 154708 - DNA, 22 bp, Artificial Sequence
  chemically synthesized
caatgtggcaggggaaaaatct

SEQ ID NO: 154709 - DNA, 22 bp, Artificial Sequence
  chemically synthesized
aatgtggcaggggaaaaatctt

SEQ ID NO: 154710 - DNA, 22 bp, Artificial Sequence
  chemically synthesized
tgaaaaagctacaagactctgc

SEQ ID NO: 154711 - DNA, 22 bp, Artificial Sequence
  chemically synthesized
gaaaaagctacaagactctgca

SEQ ID NO: 154712 - DNA, 22 bp, Artificial Sequence
  chemically synthesized
aaaaagctacaagactctgcaa

SEQ ID NO: 154713 - DNA, 22 bp, Artificial Sequence
  chemically synthesized
caagactctgcaaatattgatt

SEQ ID NO: 154714 - DNA, 22 bp, Artificial Sequence
  chemically synthesized
tgcaaatattgattccaaccac

SEQ ID NO: 154715 - DNA, 22 bp, Artificial Sequence
  chemically synthesized
caaatattgattccaaccactg

SEQ ID NO: 154716 - DNA, 22 bp, Artificial Sequence
  chemically synthesized
attccaaccactgagaaactct

SEQ ID NO: 154717 - DNA, 22 bp, Artificial Sequence
  chemically synthesized
caaccactgagaaactctacag

SEQ ID NO: 154718 - DNA, 22 bp, Artificial Sequence
  chemically synthesized
agaaactctacagcagggatgt

SEQ ID NO: 154719 - DNA, 22 bp, Artificial Sequence
  chemically synthesized
tacagcagggatgtccaatctt

SEQ ID NO: 154720 - DNA, 22 bp, Artificial Sequence
  chemically synthesized
cagcagggatgtccaatctttt

SEQ ID NO: 154721 - DNA, 22 bp, Artificial Sequence
  chemically synthesized
ttggcttccctgggccacacat

SEQ ID NO: 154722 - DNA, 22 bp, Artificial Sequence
  chemically synthesized
tggcttccctgggccacacata

SEQ ID NO: 154723 - DNA, 22 bp, Artificial Sequence
  chemically synthesized
ggcttccctgggccacacataa

SEQ ID NO: 154724 - DNA, 22 bp, Artificial Sequence
  chemically synthesized
gcttccctgggccacacataaa

SEQ ID NO: 154725 - DNA, 22 bp, Artificial Sequence
  chemically synthesized
ccctgggccacacataaaatat

SEQ ID NO: 154726 - DNA, 22 bp, Artificial Sequence
  chemically synthesized
cctgggccacacataaaatata

SEQ ID NO: 154727 - DNA, 22 bp, Artificial Sequence
  chemically synthesized
ggccacacataaaatatactaa

SEQ ID NO: 154728 - DNA, 22 bp, Artificial Sequence
  chemically synthesized
acactaatgacagctcatgagc

SEQ ID NO: 154729 - DNA, 22 bp, Artificial Sequence
  chemically synthesized
atgacagctcatgagccaaaaa

SEQ ID NO: 154730 - DNA, 22 bp, Artificial Sequence
  chemically synthesized
atgagccaaaaaaaaaaaaaaa

SEQ ID NO: 154731 - DNA, 22 bp, Artificial Sequence
  chemically synthesized
ataatgttttaagaaagttgtg

SEQ ID NO: 154732 - DNA, 22 bp, Artificial Sequence
  chemically synthesized
taagaaagttgtgttggatagc

SEQ ID NO: 154733 - DNA, 22 bp, Artificial Sequence
  chemically synthesized
aagaaagttgtgttggatagca

SEQ ID NO: 154734 - DNA, 22 bp, Artificial Sequence
  chemically synthesized
agaaagttgtgttggatagcat

SEQ ID NO: 154735 - DNA, 22 bp, Artificial Sequence
  chemically synthesized
tgttggatagcattcaaagcca

SEQ ID NO: 154736 - DNA, 22 bp, Artificial Sequence
  chemically synthesized
gatagcattcaaagccatcttg

SEQ ID NO: 154737 - DNA, 22 bp, Artificial Sequence
  chemically synthesized
aaagccatcttgggatgcatgc

SEQ ID NO: 154738 - DNA, 22 bp, Artificial Sequence
  chemically synthesized
gggatgcatgcagcccacgggc

SEQ ID NO: 154739 - DNA, 22 bp, Artificial Sequence
  chemically synthesized
ggatgcatgcagcccacgggcc

SEQ ID NO: 154740 - DNA, 22 bp, Artificial Sequence
  chemically synthesized
gacaagcttgctctacagccta

SEQ ID NO: 154741 - DNA, 22 bp, Artificial Sequence
  chemically synthesized
gctctacagcctacaaacaagg

SEQ ID NO: 154742 - DNA, 22 bp, Artificial Sequence
  chemically synthesized
ctctacagcctacaaacaagga

SEQ ID NO: 154743 - DNA, 22 bp, Artificial Sequence
  chemically synthesized
tacagcctacaaacaaggaaga

SEQ ID NO: 154744 - DNA, 22 bp, Artificial Sequence
  chemically synthesized
cagcctacaaacaaggaagaaa

SEQ ID NO: 154745 - DNA, 22 bp, Artificial Sequence
  chemically synthesized
caaacaaggaagaaataaatta

SEQ ID NO: 154746 - DNA, 22 bp, Artificial Sequence
  chemically synthesized
atatttctgttctcttttctgg

SEQ ID NO: 154747 - DNA, 22 bp, Artificial Sequence
  chemically synthesized
ctgttctcttttctggcaccaa

SEQ ID NO: 154748 - DNA, 22 bp, Artificial Sequence
  chemically synthesized
tgttctcttttctggcaccaac

SEQ ID NO: 154749 - DNA, 22 bp, Artificial Sequence
  chemically synthesized
ttctcttttctggcaccaactc

SEQ ID NO: 154750 - DNA, 22 bp, Artificial Sequence
  chemically synthesized
tcttttctggcaccaactccca

SEQ ID NO: 154751 - DNA, 22 bp, Artificial Sequence
  chemically synthesized
ttttctggcaccaactcccagc

SEQ ID NO: 154752 - DNA, 22 bp, Artificial Sequence
  chemically synthesized
ttctggcaccaactcccagctt

SEQ ID NO: 154753 - DNA, 22 bp, Artificial Sequence
  chemically synthesized
tctggcaccaactcccagcttt

SEQ ID NO: 154754 - DNA, 22 bp, Artificial Sequence
  chemically synthesized
ctggcaccaactcccagcttta

SEQ ID NO: 154755 - DNA, 22 bp, Artificial Sequence
  chemically synthesized
tggcaccaactcccagctttac

SEQ ID NO: 154756 - DNA, 22 bp, Artificial Sequence
  chemically synthesized
gcaccaactcccagctttacta

SEQ ID NO: 154757 - DNA, 22 bp, Artificial Sequence
  chemically synthesized
ccagctttactagcaccaactc

SEQ ID NO: 154758 - DNA, 22 bp, Artificial Sequence
  chemically synthesized
tactagcaccaactcccagctt

SEQ ID NO: 154759 - DNA, 22 bp, Artificial Sequence
  chemically synthesized
actagcaccaactcccagcttt

SEQ ID NO: 154760 - DNA, 22 bp, Artificial Sequence
  chemically synthesized
ctagcaccaactcccagcttta

SEQ ID NO: 154761 - DNA, 22 bp, Artificial Sequence
  chemically synthesized
gcaccaactcccagctttacta

SEQ ID NO: 154762 - DNA, 22 bp, Artificial Sequence
  chemically synthesized
ccagctttactaacttacaaat

SEQ ID NO: 154763 - DNA, 22 bp, Artificial Sequence
  chemically synthesized
tactaacttacaaatgagaaga

SEQ ID NO: 154764 - DNA, 22 bp, Artificial Sequence
  chemically synthesized
actaacttacaaatgagaagaa

SEQ ID NO: 154765 - DNA, 22 bp, Artificial Sequence
  chemically synthesized
ctaacttacaaatgagaagaaa

SEQ ID NO: 154766 - DNA, 22 bp, Artificial Sequence
  chemically synthesized
acttacaaatgagaagaaacca

SEQ ID NO: 154767 - DNA, 22 bp, Artificial Sequence
  chemically synthesized
acaaatgagaagaaaccaggtg

SEQ ID NO: 154768 - DNA, 22 bp, Artificial Sequence
  chemically synthesized
caaatgagaagaaaccaggtgt

SEQ ID NO: 154769 - DNA, 22 bp, Artificial Sequence
  chemically synthesized
tgccaaattacttgttcgaaga

SEQ ID NO: 154770 - DNA, 22 bp, Artificial Sequence
  chemically synthesized
cttgttcgaagaaaggatcatc

SEQ ID NO: 154771 - DNA, 22 bp, Artificial Sequence
  chemically synthesized
gttcgaagaaaggatcatctgg

SEQ ID NO: 154772 - DNA, 22 bp, Artificial Sequence
  chemically synthesized
ttcgaagaaaggatcatctgga

SEQ ID NO: 154773 - DNA, 22 bp, Artificial Sequence
  chemically synthesized
gaagaaaggatcatctggaatt

SEQ ID NO: 154774 - DNA, 22 bp, Artificial Sequence
  chemically synthesized
gaattcttttcttggatttcct

SEQ ID NO: 154775 - DNA, 22 bp, Artificial Sequence
  chemically synthesized
ttttcttggatttcctccactc

SEQ ID NO: 154776 - DNA, 22 bp, Artificial Sequence
  chemically synthesized
ttcttggatttcctccactcaa

SEQ ID NO: 154777 - DNA, 22 bp, Artificial Sequence
  chemically synthesized
tcttggatttcctccactcaag

SEQ ID NO: 154778 - DNA, 22 bp, Artificial Sequence
  chemically synthesized
cttggatttcctccactcaagt

SEQ ID NO: 154779 - DNA, 22 bp, Artificial Sequence
  chemically synthesized
ttggatttcctccactcaagtc

SEQ ID NO: 154780 - DNA, 22 bp, Artificial Sequence
  chemically synthesized
ggatttcctccactcaagtccc

SEQ ID NO: 154781 - DNA, 22 bp, Artificial Sequence
  chemically synthesized
gatttcctccactcaagtccca

SEQ ID NO: 154782 - DNA, 22 bp, Artificial Sequence
  chemically synthesized
cctccactcaagtcccatagta

SEQ ID NO: 154783 - DNA, 22 bp, Artificial Sequence
  chemically synthesized
ctccactcaagtcccatagtaa

SEQ ID NO: 154784 - DNA, 22 bp, Artificial Sequence
  chemically synthesized
cactcaagtcccatagtaagat

SEQ ID NO: 154785 - DNA, 22 bp, Artificial Sequence
  chemically synthesized
aagtcccatagtaagataaagg

SEQ ID NO: 154786 - DNA, 22 bp, Artificial Sequence
  chemically synthesized
tcatttaattgtatctttttca

SEQ ID NO: 154787 - DNA, 22 bp, Artificial Sequence
  chemically synthesized
catttaattgtatctttttcat

SEQ ID NO: 154788 - DNA, 22 bp, Artificial Sequence
  chemically synthesized
atttaattgtatctttttcatt

SEQ ID NO: 154789 - DNA, 22 bp, Artificial Sequence
  chemically synthesized
aattgtatctttttcatttttt

SEQ ID NO: 154790 - DNA, 22 bp, Artificial Sequence
  chemically synthesized
attgtatctttttcattttttg

SEQ ID NO: 154791 - DNA, 22 bp, Artificial Sequence
  chemically synthesized
tatctttttcattttttggctg

SEQ ID NO: 154792 - DNA, 22 bp, Artificial Sequence
  chemically synthesized
tttcattttttggctgaagcac

SEQ ID NO: 154793 - DNA, 22 bp, Artificial Sequence
  chemically synthesized
ttcattttttggctgaagcact

SEQ ID NO: 154794 - DNA, 22 bp, Artificial Sequence
  chemically synthesized
tcattttttggctgaagcacta

SEQ ID NO: 154795 - DNA, 22 bp, Artificial Sequence
  chemically synthesized
cattttttggctgaagcactag

SEQ ID NO: 154796 - DNA, 22 bp, Artificial Sequence
  chemically synthesized
attttttggctgaagcactagc

SEQ ID NO: 154797 - DNA, 22 bp, Artificial Sequence
  chemically synthesized
tttggctgaagcactagcatcc

SEQ ID NO: 154798 - DNA, 22 bp, Artificial Sequence
  chemically synthesized
ttggctgaagcactagcatcca

SEQ ID NO: 154799 - DNA, 22 bp, Artificial Sequence
  chemically synthesized
tggctgaagcactagcatccag

SEQ ID NO: 154800 - DNA, 22 bp, Artificial Sequence
  chemically synthesized
ggctgaagcactagcatccagg

SEQ ID NO: 154801 - DNA, 22 bp, Artificial Sequence
  chemically synthesized
gctgaagcactagcatccagga

SEQ ID NO: 154802 - DNA, 22 bp, Artificial Sequence
  chemically synthesized
aagcactagcatccaggacact

SEQ ID NO: 154803 - DNA, 22 bp, Artificial Sequence
  chemically synthesized
gcatccaggacactaatttacc

SEQ ID NO: 154804 - DNA, 22 bp, Artificial Sequence
  chemically synthesized
atttacctatagaacaattatc

SEQ ID NO: 154805 - DNA, 22 bp, Artificial Sequence
  chemically synthesized
acctatagaacaattatctaga

SEQ ID NO: 154806 - DNA, 22 bp, Artificial Sequence
  chemically synthesized
cctatagaacaattatctagac

SEQ ID NO: 154807 - DNA, 22 bp, Artificial Sequence
  chemically synthesized
tagaacaattatctagactcaa

SEQ ID NO: 154808 - DNA, 22 bp, Artificial Sequence
  chemically synthesized
tctagactcaattagaagtatc

SEQ ID NO: 154809 - DNA, 22 bp, Artificial Sequence
  chemically synthesized
gactcaattagaagtatcttac

SEQ ID NO: 154810 - DNA, 22 bp, Artificial Sequence
  chemically synthesized
aattagaagtatcttacatatt

SEQ ID NO: 154811 - DNA, 22 bp, Artificial Sequence
  chemically synthesized
gaagtatcttacatattgaagc

SEQ ID NO: 154812 - DNA, 22 bp, Artificial Sequence
  chemically synthesized
acatattgaagcagagttagag

SEQ ID NO: 154813 - DNA, 22 bp, Artificial Sequence
  chemically synthesized
catattgaagcagagttagagc

SEQ ID NO: 154814 - DNA, 22 bp, Artificial Sequence
  chemically synthesized
aagcagagttagagctaaaatc

SEQ ID NO: 154815 - DNA, 22 bp, Artificial Sequence
  chemically synthesized
gagctaaaatctcaagcaatcc

SEQ ID NO: 154816 - DNA, 22 bp, Artificial Sequence
  chemically synthesized
aaatctcaagcaatccaacatc

SEQ ID NO: 154817 - DNA, 22 bp, Artificial Sequence
  chemically synthesized
aagcaatccaacatccttaatt

SEQ ID NO: 154818 - DNA, 22 bp, Artificial Sequence
  chemically synthesized
aatttacagatactaaatcagt

SEQ ID NO: 154819 - DNA, 22 bp, Artificial Sequence
  chemically synthesized
atttacagatactaaatcagta

SEQ ID NO: 154820 - DNA, 22 bp, Artificial Sequence
  chemically synthesized
acagatactaaatcagtagcca

SEQ ID NO: 154821 - DNA, 22 bp, Artificial Sequence
  chemically synthesized
cagatactaaatcagtagccaa

SEQ ID NO: 154822 - DNA, 22 bp, Artificial Sequence
  chemically synthesized
aatcagtagccaaagccatttt

SEQ ID NO: 154823 - DNA, 22 bp, Artificial Sequence
  chemically synthesized
ttactgctattttggttaacag

SEQ ID NO: 154824 - DNA, 22 bp, Artificial Sequence
  chemically synthesized
tactgctattttggttaacagg

SEQ ID NO: 154825 - DNA, 22 bp, Artificial Sequence
  chemically synthesized
actgctattttggttaacaggg

SEQ ID NO: 154826 - DNA, 22 bp, Artificial Sequence
  chemically synthesized
ctgctattttggttaacagggc

SEQ ID NO: 154827 - DNA, 22 bp, Artificial Sequence
  chemically synthesized
ctattttggttaacagggccac

SEQ ID NO: 154828 - DNA, 22 bp, Artificial Sequence
  chemically synthesized
ttttggttaacagggccacaat

SEQ ID NO: 154829 - DNA, 22 bp, Artificial Sequence
  chemically synthesized
tggttaacagggccacaatcat

SEQ ID NO: 154830 - DNA, 22 bp, Artificial Sequence
  chemically synthesized
ggttaacagggccacaatcatt

SEQ ID NO: 154831 - DNA, 22 bp, Artificial Sequence
  chemically synthesized
gttaacagggccacaatcattt

SEQ ID NO: 154832 - DNA, 22 bp, Artificial Sequence
  chemically synthesized
acagggccacaatcatttatcc

SEQ ID NO: 154833 - DNA, 22 bp, Artificial Sequence
  chemically synthesized
atccatttccttgaaatccata

SEQ ID NO: 154834 - DNA, 22 bp, Artificial Sequence
  chemically synthesized
tccatttccttgaaatccatag

SEQ ID NO: 154835 - DNA, 22 bp, Artificial Sequence
  chemically synthesized
ccttgaaatccatagaaattta

SEQ ID NO: 154836 - DNA, 22 bp, Artificial Sequence
  chemically synthesized
cttgaaatccatagaaatttaa

SEQ ID NO: 154837 - DNA, 22 bp, Artificial Sequence
  chemically synthesized
gaaatccatagaaatttaaaaa

SEQ ID NO: 154838 - DNA, 22 bp, Artificial Sequence
  chemically synthesized
aaatccatagaaatttaaaaac

SEQ ID NO: 154839 - DNA, 22 bp, Artificial Sequence
  chemically synthesized
aaaaactgagtcttttaacagc

SEQ ID NO: 154840 - DNA, 22 bp, Artificial Sequence
  chemically synthesized
aaaactgagtcttttaacagca

SEQ ID NO: 154841 - DNA, 22 bp, Artificial Sequence
  chemically synthesized
agtcttttaacagcacaatctg

SEQ ID NO: 154842 - DNA, 22 bp, Artificial Sequence
  chemically synthesized
ttaacagcacaatctgctctaa

SEQ ID NO: 154843 - DNA, 22 bp, Artificial Sequence
  chemically synthesized
taacagcacaatctgctctaaa

SEQ ID NO: 154844 - DNA, 22 bp, Artificial Sequence
  chemically synthesized
aacagcacaatctgctctaaag

SEQ ID NO: 154845 - DNA, 22 bp, Artificial Sequence
  chemically synthesized
acagcacaatctgctctaaagt

SEQ ID NO: 154846 - DNA, 22 bp, Artificial Sequence
  chemically synthesized
ctctaaagtgatggcaatttct

SEQ ID NO: 154847 - DNA, 22 bp, Artificial Sequence
  chemically synthesized
taaagtgatggcaatttctgac

SEQ ID NO: 154848 - DNA, 22 bp, Artificial Sequence
  chemically synthesized
aagtgatggcaatttctgacat

SEQ ID NO: 154849 - DNA, 22 bp, Artificial Sequence
  chemically synthesized
ctgacatgaacttatgtgagaa

SEQ ID NO: 154850 - DNA, 22 bp, Artificial Sequence
  chemically synthesized
tgacatgaacttatgtgagaat

SEQ ID NO: 154851 - DNA, 22 bp, Artificial Sequence
  chemically synthesized
acatgaacttatgtgagaattt

SEQ ID NO: 154852 - DNA, 22 bp, Artificial Sequence
  chemically synthesized
atgtgagaatttttataatctt

SEQ ID NO: 154853 - DNA, 22 bp, Artificial Sequence
  chemically synthesized
tgtgagaatttttataatcttt

SEQ ID NO: 154854 - DNA, 22 bp, Artificial Sequence
  chemically synthesized
ttataatctttatttattctac

SEQ ID NO: 154855 - DNA, 22 bp, Artificial Sequence
  chemically synthesized
tataatctttatttattctaca

SEQ ID NO: 154856 - DNA, 22 bp, Artificial Sequence
  chemically synthesized
ataatctttatttattctacat

SEQ ID NO: 154857 - DNA, 22 bp, Artificial Sequence
  chemically synthesized
taatctttatttattctacata

SEQ ID NO: 154858 - DNA, 22 bp, Artificial Sequence
  chemically synthesized
tatttattctacataatactta

SEQ ID NO: 154859 - DNA, 22 bp, Artificial Sequence
  chemically synthesized
atttattctacataatacttac

SEQ ID NO: 154860 - DNA, 22 bp, Artificial Sequence
  chemically synthesized
tttattctacataatacttaca

SEQ ID NO: 154861 - DNA, 22 bp, Artificial Sequence
  chemically synthesized
attctacataatacttacatgt

SEQ ID NO: 154862 - DNA, 22 bp, Artificial Sequence
  chemically synthesized
ttctacataatacttacatgtt

SEQ ID NO: 154863 - DNA, 22 bp, Artificial Sequence
  chemically synthesized
tacataatacttacatgttccc

SEQ ID NO: 154864 - DNA, 22 bp, Artificial Sequence
  chemically synthesized
cataatacttacatgttccctg

SEQ ID NO: 154865 - DNA, 22 bp, Artificial Sequence
  chemically synthesized
acatgttccctgcaaaaatatc

SEQ ID NO: 154866 - DNA, 22 bp, Artificial Sequence
  chemically synthesized
catgttccctgcaaaaatatct

SEQ ID NO: 154867 - DNA, 22 bp, Artificial Sequence
  chemically synthesized
cctgcaaaaatatctaggtata

SEQ ID NO: 154868 - DNA, 22 bp, Artificial Sequence
  chemically synthesized
caaaaatatctaggtatattag

SEQ ID NO: 154869 - DNA, 22 bp, Artificial Sequence
  chemically synthesized
ggtatattagataatcatatag

SEQ ID NO: 154870 - DNA, 22 bp, Artificial Sequence
  chemically synthesized
gataatcatatagatatatgat

SEQ ID NO: 154871 - DNA, 22 bp, Artificial Sequence
  chemically synthesized
ttaagggcataccgagattcca

SEQ ID NO: 154872 - DNA, 22 bp, Artificial Sequence
  chemically synthesized
agggcataccgagattccaatg

SEQ ID NO: 154873 - DNA, 22 bp, Artificial Sequence
  chemically synthesized
caatgatattgttacttgatgt

SEQ ID NO: 154874 - DNA, 22 bp, Artificial Sequence
  chemically synthesized
ttacttgatgtcaataatatta

SEQ ID NO: 154875 - DNA, 22 bp, Artificial Sequence
  chemically synthesized
cttgatgtcaataatattatat

SEQ ID NO: 154876 - DNA, 22 bp, Artificial Sequence
  chemically synthesized
gatgtcaataatattatataac

SEQ ID NO: 154877 - DNA, 22 bp, Artificial Sequence
  chemically synthesized
atgtcaataatattatataaca

SEQ ID NO: 154878 - DNA, 22 bp, Artificial Sequence
  chemically synthesized
tataacattcataaaaattgga

SEQ ID NO: 154879 - DNA, 22 bp, Artificial Sequence
  chemically synthesized
ataaaaattggaaaattatttt

SEQ ID NO: 154880 - DNA, 22 bp, Artificial Sequence
  chemically synthesized
gaaaattatttttctaaagcat

SEQ ID NO: 154881 - DNA, 22 bp, Artificial Sequence
  chemically synthesized
tttttctaaagcatgtggctca

SEQ ID NO: 154882 - DNA, 22 bp, Artificial Sequence
  chemically synthesized
ttctaaagcatgtggctcaaag

SEQ ID NO: 154883 - DNA, 22 bp, Artificial Sequence
  chemically synthesized
tctaaagcatgtggctcaaaga

SEQ ID NO: 154884 - DNA, 22 bp, Artificial Sequence
  chemically synthesized
ctaaagcatgtggctcaaagac

SEQ ID NO: 154885 - DNA, 22 bp, Artificial Sequence
  chemically synthesized
taaagcatgtggctcaaagact

SEQ ID NO: 154886 - DNA, 22 bp, Artificial Sequence
  chemically synthesized
aagcatgtggctcaaagactgt

SEQ ID NO: 154887 - DNA, 22 bp, Artificial Sequence
  chemically synthesized
aaagactgtagacttctataag

SEQ ID NO: 154888 - DNA, 22 bp, Artificial Sequence
  chemically synthesized
tagacttctataagaaaactaa

SEQ ID NO: 154889 - DNA, 22 bp, Artificial Sequence
  chemically synthesized
ctataagaaaactaaacatatt

SEQ ID NO: 154890 - DNA, 22 bp, Artificial Sequence
  chemically synthesized
tataagaaaactaaacatatta

SEQ ID NO: 154891 - DNA, 22 bp, Artificial Sequence
  chemically synthesized
taagaaaactaaacatattaaa

SEQ ID NO: 154892 - DNA, 22 bp, Artificial Sequence
  chemically synthesized
aacatattaaattaaacatatc

SEQ ID NO: 154893 - DNA, 22 bp, Artificial Sequence
  chemically synthesized
aattaaacatatcaataactat

SEQ ID NO: 154894 - DNA, 22 bp, Artificial Sequence
  chemically synthesized
aacatatcaataactattattt

SEQ ID NO: 154895 - DNA, 22 bp, Artificial Sequence
  chemically synthesized
ttatttcatctgcatagaatat

SEQ ID NO: 154896 - DNA, 22 bp, Artificial Sequence
  chemically synthesized
tttcatctgcatagaatattgc

SEQ ID NO: 154897 - DNA, 22 bp, Artificial Sequence
  chemically synthesized
catctgcatagaatattgctga

SEQ ID NO: 154898 - DNA, 22 bp, Artificial Sequence
  chemically synthesized
atctgcatagaatattgctgaa

SEQ ID NO: 154899 - DNA, 22 bp, Artificial Sequence
  chemically synthesized
catagaatattgctgaaggtgt

SEQ ID NO: 154900 - DNA, 22 bp, Artificial Sequence
  chemically synthesized
ctgaaggtgtgttttaaagtag

SEQ ID NO: 154901 - DNA, 22 bp, Artificial Sequence
  chemically synthesized
aaggtgtgttttaaagtagtaa

SEQ ID NO: 154902 - DNA, 22 bp, Artificial Sequence
  chemically synthesized
taaagtagtaacatggtacttg

SEQ ID NO: 154903 - DNA, 22 bp, Artificial Sequence
  chemically synthesized
aaagtagtaacatggtacttgt

SEQ ID NO: 154904 - DNA, 22 bp, Artificial Sequence
  chemically synthesized
aagtagtaacatggtacttgta

SEQ ID NO: 154905 - DNA, 22 bp, Artificial Sequence
  chemically synthesized
gtatcacagcagccgtagtttg

SEQ ID NO: 154906 - DNA, 22 bp, Artificial Sequence
  chemically synthesized
tatcacagcagccgtagtttgg

SEQ ID NO: 154907 - DNA, 22 bp, Artificial Sequence
  chemically synthesized
ggatcactgccctcttgcatat

SEQ ID NO: 154908 - DNA, 22 bp, Artificial Sequence
  chemically synthesized
gatcactgccctcttgcatatt

SEQ ID NO: 154909 - DNA, 22 bp, Artificial Sequence
  chemically synthesized
ccctcttgcatattatatttat

SEQ ID NO: 154910 - DNA, 22 bp, Artificial Sequence
  chemically synthesized
ttgcatattatatttatcagaa

SEQ ID NO: 154911 - DNA, 22 bp, Artificial Sequence
  chemically synthesized
gcatattatatttatcagaaat

SEQ ID NO: 154912 - DNA, 22 bp, Artificial Sequence
  chemically synthesized
catattatatttatcagaaatc

SEQ ID NO: 154913 - DNA, 22 bp, Artificial Sequence
  chemically synthesized
tatttatcagaaatcattattt

SEQ ID NO: 154914 - DNA, 22 bp, Artificial Sequence
  chemically synthesized
atcagaaatcattatttactga

SEQ ID NO: 154915 - DNA, 22 bp, Artificial Sequence
  chemically synthesized
tcagaaatcattatttactgaa

SEQ ID NO: 154916 - DNA, 22 bp, Artificial Sequence
  chemically synthesized
tttactgaaaacatttgctcaa

SEQ ID NO: 154917 - DNA, 22 bp, Artificial Sequence
  chemically synthesized
actgaaaacatttgctcaaaaa

SEQ ID NO: 154918 - DNA, 22 bp, Artificial Sequence
  chemically synthesized
ctgaaaacatttgctcaaaaaa

SEQ ID NO: 154919 - DNA, 22 bp, Artificial Sequence
  chemically synthesized
aaaacatttgctcaaaaaaaaa

SEQ ID NO: 154920 - DNA, 22 bp, Artificial Sequence
  chemically synthesized
gctcaaaaaaaaattcttcaag

SEQ ID NO: 154921 - DNA, 22 bp, Artificial Sequence
  chemically synthesized
ctcaaaaaaaaattcttcaagt

SEQ ID NO: 154922 - DNA, 22 bp, Artificial Sequence
  chemically synthesized
aaaaaaaaattcttcaagtttt

SEQ ID NO: 154923 - DNA, 22 bp, Artificial Sequence
  chemically synthesized
ttcaagttttagagtccccaga

SEQ ID NO: 154924 - DNA, 22 bp, Artificial Sequence
  chemically synthesized
caagttttagagtccccagatt

SEQ ID NO: 154925 - DNA, 22 bp, Artificial Sequence
  chemically synthesized
aagttttagagtccccagattt

SEQ ID NO: 154926 - DNA, 22 bp, Artificial Sequence
  chemically synthesized
tagagtccccagatttaaaaac

SEQ ID NO: 154927 - DNA, 22 bp, Artificial Sequence
  chemically synthesized
agagtccccagatttaaaaaca

SEQ ID NO: 154928 - DNA, 22 bp, Artificial Sequence
  chemically synthesized
gagtccccagatttaaaaacat

SEQ ID NO: 154929 - DNA, 22 bp, Artificial Sequence
  chemically synthesized
aaaaacattataataagttatc

SEQ ID NO: 154930 - DNA, 22 bp, Artificial Sequence
  chemically synthesized
aaaacattataataagttatca

SEQ ID NO: 154931 - DNA, 22 bp, Artificial Sequence
  chemically synthesized
taataagttatcagcagagtat

SEQ ID NO: 154932 - DNA, 22 bp, Artificial Sequence
  chemically synthesized
tcagcagagtatacctcttgga

SEQ ID NO: 154933 - DNA, 22 bp, Artificial Sequence
  chemically synthesized
ttggattctattctttgttctt

SEQ ID NO: 154934 - DNA, 22 bp, Artificial Sequence
  chemically synthesized
ggattctattctttgttcttcc

SEQ ID NO: 154935 - DNA, 22 bp, Artificial Sequence
  chemically synthesized
gattctattctttgttcttcct

SEQ ID NO: 154936 - DNA, 22 bp, Artificial Sequence
  chemically synthesized
tattctttgttcttcctgtcac

SEQ ID NO: 154937 - DNA, 22 bp, Artificial Sequence
  chemically synthesized
ttctttgttcttcctgtcacta

SEQ ID NO: 154938 - DNA, 22 bp, Artificial Sequence
  chemically synthesized
tttgttcttcctgtcactatca

SEQ ID NO: 154939 - DNA, 22 bp, Artificial Sequence
  chemically synthesized
tgttcttcctgtcactatcagg

SEQ ID NO: 154940 - DNA, 22 bp, Artificial Sequence
  chemically synthesized
gttcttcctgtcactatcaggt

SEQ ID NO: 154941 - DNA, 22 bp, Artificial Sequence
  chemically synthesized
ttcttcctgtcactatcaggta

SEQ ID NO: 154942 - DNA, 22 bp, Artificial Sequence
  chemically synthesized
ttcctgtcactatcaggtagtc

SEQ ID NO: 154943 - DNA, 22 bp, Artificial Sequence
  chemically synthesized
cctgtcactatcaggtagtcag

SEQ ID NO: 154944 - DNA, 22 bp, Artificial Sequence
  chemically synthesized
ctgtcactatcaggtagtcaga

SEQ ID NO: 154945 - DNA, 22 bp, Artificial Sequence
  chemically synthesized
tcactatcaggtagtcagatgc

SEQ ID NO: 154946 - DNA, 22 bp, Artificial Sequence
  chemically synthesized
tcaggtagtcagatgcagacat

SEQ ID NO: 154947 - DNA, 22 bp, Artificial Sequence
  chemically synthesized
ctgttgtcccctaaattctcct

SEQ ID NO: 154948 - DNA, 22 bp, Artificial Sequence
  chemically synthesized
tgttgtcccctaaattctcctt

SEQ ID NO: 154949 - DNA, 22 bp, Artificial Sequence
  chemically synthesized
ttgtcccctaaattctccttgt

SEQ ID NO: 154950 - DNA, 22 bp, Artificial Sequence
  chemically synthesized
tcccctaaattctccttgtcct

SEQ ID NO: 154951 - DNA, 22 bp, Artificial Sequence
  chemically synthesized
aattctccttgtcctttctcca

SEQ ID NO: 154952 - DNA, 22 bp, Artificial Sequence
  chemically synthesized
tccttgtcctttctccatctct

SEQ ID NO: 154953 - DNA, 22 bp, Artificial Sequence
  chemically synthesized
cttgtcctttctccatctcttt

SEQ ID NO: 154954 - DNA, 22 bp, Artificial Sequence
  chemically synthesized
gtcctttctccatctctttttc

SEQ ID NO: 154955 - DNA, 22 bp, Artificial Sequence
  chemically synthesized
tcctttctccatctctttttct

SEQ ID NO: 154956 - DNA, 22 bp, Artificial Sequence
  chemically synthesized
tctccatctctttttctataat

SEQ ID NO: 154957 - DNA, 22 bp, Artificial Sequence
  chemically synthesized
ctccatctctttttctataata

SEQ ID NO: 154958 - DNA, 22 bp, Artificial Sequence
  chemically synthesized
tccatctctttttctataatat

SEQ ID NO: 154959 - DNA, 22 bp, Artificial Sequence
  chemically synthesized
catctctttttctataatatcc

SEQ ID NO: 154960 - DNA, 22 bp, Artificial Sequence
  chemically synthesized
tttttctataatatcctttgat

SEQ ID NO: 154961 - DNA, 22 bp, Artificial Sequence
  chemically synthesized
tttctataatatcctttgattc

SEQ ID NO: 154962 - DNA, 22 bp, Artificial Sequence
  chemically synthesized
ttctataatatcctttgattcc

SEQ ID NO: 154963 - DNA, 22 bp, Artificial Sequence
  chemically synthesized
tctataatatcctttgattcct

SEQ ID NO: 154964 - DNA, 22 bp, Artificial Sequence
  chemically synthesized
ctataatatcctttgattcctt

SEQ ID NO: 154965 - DNA, 22 bp, Artificial Sequence
  chemically synthesized
tataatatcctttgattccttt

SEQ ID NO: 154966 - DNA, 22 bp, Artificial Sequence
  chemically synthesized
taatatcctttgattcctttaa

SEQ ID NO: 154967 - DNA, 22 bp, Artificial Sequence
  chemically synthesized
tgattcctttaatttcttttcc

SEQ ID NO: 154968 - DNA, 22 bp, Artificial Sequence
  chemically synthesized
gattcctttaatttcttttcca

SEQ ID NO: 154969 - DNA, 22 bp, Artificial Sequence
  chemically synthesized
attcctttaatttcttttccaa

SEQ ID NO: 154970 - DNA, 22 bp, Artificial Sequence
  chemically synthesized
ctttaatttcttttccaaggat

SEQ ID NO: 154971 - DNA, 22 bp, Artificial Sequence
  chemically synthesized
taatttcttttccaaggatagg

SEQ ID NO: 154972 - DNA, 22 bp, Artificial Sequence
  chemically synthesized
aatttcttttccaaggataggt

SEQ ID NO: 154973 - DNA, 22 bp, Artificial Sequence
  chemically synthesized
atttcttttccaaggataggtg

SEQ ID NO: 154974 - DNA, 22 bp, Artificial Sequence
  chemically synthesized
cttttccaaggataggtgggaa

SEQ ID NO: 154975 - DNA, 22 bp, Artificial Sequence
  chemically synthesized
ttttccaaggataggtgggaag

SEQ ID NO: 154976 - DNA, 22 bp, Artificial Sequence
  chemically synthesized
ttccaaggataggtgggaagat

SEQ ID NO: 154977 - DNA, 22 bp, Artificial Sequence
  chemically synthesized
tccaaggataggtgggaagata

SEQ ID NO: 154978 - DNA, 22 bp, Artificial Sequence
  chemically synthesized
ccaaggataggtgggaagataa

SEQ ID NO: 154979 - DNA, 22 bp, Artificial Sequence
  chemically synthesized
caaggataggtgggaagataag

SEQ ID NO: 154980 - DNA, 22 bp, Artificial Sequence
  chemically synthesized
tcctttctttaatgtctaaaaa

SEQ ID NO: 154981 - DNA, 22 bp, Artificial Sequence
  chemically synthesized
tctttaatgtctaaaaaagcaa

SEQ ID NO: 154982 - DNA, 22 bp, Artificial Sequence
  chemically synthesized
ctttaatgtctaaaaaagcaag

SEQ ID NO: 154983 - DNA, 22 bp, Artificial Sequence
  chemically synthesized
tttaatgtctaaaaaagcaagg

SEQ ID NO: 154984 - DNA, 22 bp, Artificial Sequence
  chemically synthesized
taatgtctaaaaaagcaaggtg

SEQ ID NO: 154985 - DNA, 22 bp, Artificial Sequence
  chemically synthesized
aatgtctaaaaaagcaaggtga

SEQ ID NO: 154986 - DNA, 22 bp, Artificial Sequence
  chemically synthesized
atgtctaaaaaagcaaggtgaa

SEQ ID NO: 154987 - DNA, 22 bp, Artificial Sequence
  chemically synthesized
aaaaagcaaggtgaagccatcc

SEQ ID NO: 154988 - DNA, 22 bp, Artificial Sequence
  chemically synthesized
accctcactatggtttcaagac

SEQ ID NO: 154989 - DNA, 22 bp, Artificial Sequence
  chemically synthesized
ccctcactatggtttcaagacc

SEQ ID NO: 154990 - DNA, 22 bp, Artificial Sequence
  chemically synthesized
actatggtttcaagacctttga

SEQ ID NO: 154991 - DNA, 22 bp, Artificial Sequence
  chemically synthesized
tggtttcaagacctttgaatgg

SEQ ID NO: 154992 - DNA, 22 bp, Artificial Sequence
  chemically synthesized
caagacctttgaatggaaagca

SEQ ID NO: 154993 - DNA, 22 bp, Artificial Sequence
  chemically synthesized
aagacctttgaatggaaagcac

SEQ ID NO: 154994 - DNA, 22 bp, Artificial Sequence
  chemically synthesized
tgaatggaaagcacttgaaatg

SEQ ID NO: 154995 - DNA, 22 bp, Artificial Sequence
  chemically synthesized
gaatggaaagcacttgaaatgc

SEQ ID NO: 154996 - DNA, 22 bp, Artificial Sequence
  chemically synthesized
aatggaaagcacttgaaatgca

SEQ ID NO: 154997 - DNA, 22 bp, Artificial Sequence
  chemically synthesized
gaaatgcatgtgataattctta

SEQ ID NO: 154998 - DNA, 22 bp, Artificial Sequence
  chemically synthesized
aaatgcatgtgataattcttat

SEQ ID NO: 154999 - DNA, 22 bp, Artificial Sequence
  chemically synthesized
ttatatctcccaccatatagca

SEQ ID NO: 155000 - DNA, 22 bp, Artificial Sequence
  chemically synthesized
atatctcccaccatatagcact

SEQ ID NO: 155001 - DNA, 22 bp, Artificial Sequence
  chemically synthesized
tatctcccaccatatagcactc

SEQ ID NO: 155002 - DNA, 22 bp, Artificial Sequence
  chemically synthesized
ccaccatatagcactcacactt

SEQ ID NO: 155003 - DNA, 22 bp, Artificial Sequence
  chemically synthesized
acacttacgtaataaaatatga

SEQ ID NO: 155004 - DNA, 22 bp, Artificial Sequence
  chemically synthesized
acgtaataaaatatgacctctc

SEQ ID NO: 155005 - DNA, 22 bp, Artificial Sequence
  chemically synthesized
cgtaataaaatatgacctctct

SEQ ID NO: 155006 - DNA, 22 bp, Artificial Sequence
  chemically synthesized
tcttagccagtgagaactaaga

SEQ ID NO: 155007 - DNA, 22 bp, Artificial Sequence
  chemically synthesized
ttagccagtgagaactaagatg

SEQ ID NO: 155008 - DNA, 22 bp, Artificial Sequence
  chemically synthesized
agccagtgagaactaagatgcc

SEQ ID NO: 155009 - DNA, 22 bp, Artificial Sequence
  chemically synthesized
gccagtgagaactaagatgcct

SEQ ID NO: 155010 - DNA, 22 bp, Artificial Sequence
  chemically synthesized
agatgcctagatgactgattgg

SEQ ID NO: 155011 - DNA, 22 bp, Artificial Sequence
  chemically synthesized
gatgactgattggaggacctgg

SEQ ID NO: 155012 - DNA, 22 bp, Artificial Sequence
  chemically synthesized
attggaggacctgggcacttgc

SEQ ID NO: 155013 - DNA, 22 bp, Artificial Sequence
  chemically synthesized
gaggacctgggcacttgcctag

SEQ ID NO: 155014 - DNA, 22 bp, Artificial Sequence
  chemically synthesized
ggcacttgcctagcatccaatc

SEQ ID NO: 155015 - DNA, 22 bp, Artificial Sequence
  chemically synthesized
gcctagcatccaatcaagatca

SEQ ID NO: 155016 - DNA, 22 bp, Artificial Sequence
  chemically synthesized
cctagcatccaatcaagatcat

SEQ ID NO: 155017 - DNA, 22 bp, Artificial Sequence
  chemically synthesized
gcatccaatcaagatcatccag

SEQ ID NO: 155018 - DNA, 22 bp, Artificial Sequence
  chemically synthesized
atgtcaaacatcatatttatag

SEQ ID NO: 155019 - DNA, 22 bp, Artificial Sequence
  chemically synthesized
atagggaagttttactattttt

SEQ ID NO: 155020 - DNA, 22 bp, Artificial Sequence
  chemically synthesized
tagggaagttttactatttttt

SEQ ID NO: 155021 - DNA, 22 bp, Artificial Sequence
  chemically synthesized
tactatttttttttactaagtt

SEQ ID NO: 155022 - DNA, 22 bp, Artificial Sequence
  chemically synthesized
actatttttttttactaagttt

SEQ ID NO: 155023 - DNA, 22 bp, Artificial Sequence
  chemically synthesized
ctatttttttttactaagtttt

SEQ ID NO: 155024 - DNA, 22 bp, Artificial Sequence
  chemically synthesized
tttttttttactaagttttact

SEQ ID NO: 155025 - DNA, 22 bp, Artificial Sequence
  chemically synthesized
ttttttactaagttttactact

SEQ ID NO: 155026 - DNA, 22 bp, Artificial Sequence
  chemically synthesized
tttttactaagttttactacta

SEQ ID NO: 155027 - DNA, 22 bp, Artificial Sequence
  chemically synthesized
ttttactaagttttactactat

SEQ ID NO: 155028 - DNA, 22 bp, Artificial Sequence
  chemically synthesized
tttactaagttttactactata

SEQ ID NO: 155029 - DNA, 22 bp, Artificial Sequence
  chemically synthesized
ttactaagttttactactatag

SEQ ID NO: 155030 - DNA, 22 bp, Artificial Sequence
  chemically synthesized
tactaagttttactactatagg

SEQ ID NO: 155031 - DNA, 22 bp, Artificial Sequence
  chemically synthesized
actaagttttactactataggt

SEQ ID NO: 155032 - DNA, 22 bp, Artificial Sequence
  chemically synthesized
ctaagttttactactataggtg

SEQ ID NO: 155033 - DNA, 22 bp, Artificial Sequence
  chemically synthesized
agttttactactataggtgaaa

SEQ ID NO: 155034 - DNA, 22 bp, Artificial Sequence
  chemically synthesized
tactactataggtgaaaaaagc

SEQ ID NO: 155035 - DNA, 22 bp, Artificial Sequence
  chemically synthesized
actactataggtgaaaaaagct

SEQ ID NO: 155036 - DNA, 22 bp, Artificial Sequence
  chemically synthesized
ctactataggtgaaaaaagctt

SEQ ID NO: 155037 - DNA, 22 bp, Artificial Sequence
  chemically synthesized
ctataggtgaaaaaagcttcta

SEQ ID NO: 155038 - DNA, 22 bp, Artificial Sequence
  chemically synthesized
taggtgaaaaaagcttctaggg

SEQ ID NO: 155039 - DNA, 22 bp, Artificial Sequence
  chemically synthesized
ctagggattctttgaaaaatat

SEQ ID NO: 155040 - DNA, 22 bp, Artificial Sequence
  chemically synthesized
tagggattctttgaaaaatatc

SEQ ID NO: 155041 - DNA, 22 bp, Artificial Sequence
  chemically synthesized
gggattctttgaaaaatatcag

SEQ ID NO: 155042 - DNA, 22 bp, Artificial Sequence
  chemically synthesized
tttgaaaaatatcagaaaatca

SEQ ID NO: 155043 - DNA, 22 bp, Artificial Sequence
  chemically synthesized
tgaaaaatatcagaaaatcaca

SEQ ID NO: 155044 - DNA, 22 bp, Artificial Sequence
  chemically synthesized
gaaaaatatcagaaaatcacag

SEQ ID NO: 155045 - DNA, 22 bp, Artificial Sequence
  chemically synthesized
aaaaatatcagaaaatcacaga

SEQ ID NO: 155046 - DNA, 22 bp, Artificial Sequence
  chemically synthesized
cacttgagagaataaggaaaca

SEQ ID NO: 155047 - DNA, 22 bp, Artificial Sequence
  chemically synthesized
gagagaataaggaaacatctct

SEQ ID NO: 155048 - DNA, 22 bp, Artificial Sequence
  chemically synthesized
agagaataaggaaacatctctc

SEQ ID NO: 155049 - DNA, 22 bp, Artificial Sequence
  chemically synthesized
tctccataaatctggcttatca

SEQ ID NO: 155050 - DNA, 22 bp, Artificial Sequence
  chemically synthesized
tccataaatctggcttatcagt

SEQ ID NO: 155051 - DNA, 22 bp, Artificial Sequence
  chemically synthesized
cataaatctggcttatcagtgt

SEQ ID NO: 155052 - DNA, 22 bp, Artificial Sequence
  chemically synthesized
gcttatcagtgtgaagccagtt

SEQ ID NO: 155053 - DNA, 22 bp, Artificial Sequence
  chemically synthesized
atcagtgtgaagccagttttta

SEQ ID NO: 155054 - DNA, 22 bp, Artificial Sequence
  chemically synthesized
tcagtgtgaagccagtttttaa

SEQ ID NO: 155055 - DNA, 22 bp, Artificial Sequence
  chemically synthesized
ttaattccatgaatatcatggt

SEQ ID NO: 155056 - DNA, 22 bp, Artificial Sequence
  chemically synthesized
taattccatgaatatcatggta

SEQ ID NO: 155057 - DNA, 22 bp, Artificial Sequence
  chemically synthesized
aattccatgaatatcatggtat

SEQ ID NO: 155058 - DNA, 22 bp, Artificial Sequence
  chemically synthesized
attccatgaatatcatggtatt

SEQ ID NO: 155059 - DNA, 22 bp, Artificial Sequence
  chemically synthesized
catgaatatcatggtatttgtt

SEQ ID NO: 155060 - DNA, 22 bp, Artificial Sequence
  chemically synthesized
gtttctatctttttatcttcat

SEQ ID NO: 155061 - DNA, 22 bp, Artificial Sequence
  chemically synthesized
tttctatctttttatcttcatc

SEQ ID NO: 155062 - DNA, 22 bp, Artificial Sequence
  chemically synthesized
ctatctttttatcttcatctgt

SEQ ID NO: 155063 - DNA, 22 bp, Artificial Sequence
  chemically synthesized
tatctttttatcttcatctgta

SEQ ID NO: 155064 - DNA, 22 bp, Artificial Sequence
  chemically synthesized
tctttttatcttcatctgtatt

SEQ ID NO: 155065 - DNA, 22 bp, Artificial Sequence
  chemically synthesized
tttatcttcatctgtattcctc

SEQ ID NO: 155066 - DNA, 22 bp, Artificial Sequence
  chemically synthesized
ttatcttcatctgtattcctca

SEQ ID NO: 155067 - DNA, 22 bp, Artificial Sequence
  chemically synthesized
tatcttcatctgtattcctcat

SEQ ID NO: 155068 - DNA, 22 bp, Artificial Sequence
  chemically synthesized
atcttcatctgtattcctcatt

SEQ ID NO: 155069 - DNA, 22 bp, Artificial Sequence
  chemically synthesized
tcttcatctgtattcctcatta

SEQ ID NO: 155070 - DNA, 22 bp, Artificial Sequence
  chemically synthesized
catctgtattcctcattaaagt

SEQ ID NO: 155071 - DNA, 22 bp, Artificial Sequence
  chemically synthesized
atctgtattcctcattaaagta

SEQ ID NO: 155072 - DNA, 22 bp, Artificial Sequence
  chemically synthesized
tattcctcattaaagtatcctt

SEQ ID NO: 155073 - DNA, 22 bp, Artificial Sequence
  chemically synthesized
ctcattaaagtatccttcaaga

SEQ ID NO: 155074 - DNA, 22 bp, Artificial Sequence
  chemically synthesized
attaaagtatccttcaagagaa

SEQ ID NO: 155075 - DNA, 22 bp, Artificial Sequence
  chemically synthesized
aagtatccttcaagagaatggg

SEQ ID NO: 155076 - DNA, 22 bp, Artificial Sequence
  chemically synthesized
caagagaatgggatatctacag

SEQ ID NO: 155077 - DNA, 22 bp, Artificial Sequence
  chemically synthesized
aagagaatgggatatctacagt

SEQ ID NO: 155078 - DNA, 22 bp, Artificial Sequence
  chemically synthesized
cagtagctaatataatttcttg

SEQ ID NO: 155079 - DNA, 22 bp, Artificial Sequence
  chemically synthesized
atataatttcttggcccttcag

SEQ ID NO: 155080 - DNA, 22 bp, Artificial Sequence
  chemically synthesized
cttggcccttcagattctgacc

SEQ ID NO: 155081 - DNA, 22 bp, Artificial Sequence
  chemically synthesized
ttggcccttcagattctgaccc

SEQ ID NO: 155082 - DNA, 22 bp, Artificial Sequence
  chemically synthesized
ggcccttcagattctgacccat

SEQ ID NO: 155083 - DNA, 22 bp, Artificial Sequence
  chemically synthesized
gcccttcagattctgacccatt

SEQ ID NO: 155084 - DNA, 22 bp, Artificial Sequence
  chemically synthesized
cagattctgacccatttaccat

SEQ ID NO: 155085 - DNA, 22 bp, Artificial Sequence
  chemically synthesized
agattctgacccatttaccatg

SEQ ID NO: 155086 - DNA, 22 bp, Artificial Sequence
  chemically synthesized
tgacccatttaccatgtgacca

SEQ ID NO: 155087 - DNA, 22 bp, Artificial Sequence
  chemically synthesized
acccatttaccatgtgaccaag

SEQ ID NO: 155088 - DNA, 22 bp, Artificial Sequence
  chemically synthesized
accatgtgaccaagaaaaagca

SEQ ID NO: 155089 - DNA, 22 bp, Artificial Sequence
  chemically synthesized
ccatgtgaccaagaaaaagcag

SEQ ID NO: 155090 - DNA, 22 bp, Artificial Sequence
  chemically synthesized
aaaaattaaagggaaataaaat

SEQ ID NO: 155091 - DNA, 22 bp, Artificial Sequence
  chemically synthesized
aaaattaaagggaaataaaatg

SEQ ID NO: 155092 - DNA, 22 bp, Artificial Sequence
  chemically synthesized
aagggaaataaaatgagagaat

SEQ ID NO: 155093 - DNA, 22 bp, Artificial Sequence
  chemically synthesized
acttttaggtgccatctaagat

SEQ ID NO: 155094 - DNA, 22 bp, Artificial Sequence
  chemically synthesized
ttaggtgccatctaagatgtgt

SEQ ID NO: 155095 - DNA, 22 bp, Artificial Sequence
  chemically synthesized
taggtgccatctaagatgtgta

SEQ ID NO: 155096 - DNA, 22 bp, Artificial Sequence
  chemically synthesized
aggtgccatctaagatgtgtaa

SEQ ID NO: 155097 - DNA, 22 bp, Artificial Sequence
  chemically synthesized
ggtgccatctaagatgtgtaaa

SEQ ID NO: 155098 - DNA, 22 bp, Artificial Sequence
  chemically synthesized
agatgtgtaaagtccttctccc

SEQ ID NO: 155099 - DNA, 22 bp, Artificial Sequence
  chemically synthesized
ctcccacatgtctcctttgcaa

SEQ ID NO: 155100 - DNA, 22 bp, Artificial Sequence
  chemically synthesized
tcccacatgtctcctttgcaac

SEQ ID NO: 155101 - DNA, 22 bp, Artificial Sequence
  chemically synthesized
ccacatgtctcctttgcaacct

SEQ ID NO: 155102 - DNA, 22 bp, Artificial Sequence
  chemically synthesized
ctttgcaacctatatttgccaa

SEQ ID NO: 155103 - DNA, 22 bp, Artificial Sequence
  chemically synthesized
tgcaacctatatttgccaatgg

SEQ ID NO: 155104 - DNA, 22 bp, Artificial Sequence
  chemically synthesized
gcaacctatatttgccaatggc

SEQ ID NO: 155105 - DNA, 22 bp, Artificial Sequence
  chemically synthesized
caacctatatttgccaatggct

SEQ ID NO: 155106 - DNA, 22 bp, Artificial Sequence
  chemically synthesized
tatttgccaatggctcattgga

SEQ ID NO: 155107 - DNA, 22 bp, Artificial Sequence
  chemically synthesized
gccaatggctcattggaaacaa

SEQ ID NO: 155108 - DNA, 22 bp, Artificial Sequence
  chemically synthesized
ccaatggctcattggaaacaat

SEQ ID NO: 155109 - DNA, 22 bp, Artificial Sequence
  chemically synthesized
attggaaacaatatatgacagg

SEQ ID NO: 155110 - DNA, 22 bp, Artificial Sequence
  chemically synthesized
gaaacaatatatgacagggaca

SEQ ID NO: 155111 - DNA, 22 bp, Artificial Sequence
  chemically synthesized
gacatgtagatgtatgtattaa

SEQ ID NO: 155112 - DNA, 22 bp, Artificial Sequence
  chemically synthesized
acttaggtgtcagagagtggtg

SEQ ID NO: 155113 - DNA, 22 bp, Artificial Sequence
  chemically synthesized
aggtgtcagagagtggtggctg

SEQ ID NO: 155114 - DNA, 22 bp, Artificial Sequence
  chemically synthesized
ggtgtcagagagtggtggctga

SEQ ID NO: 155115 - DNA, 22 bp, Artificial Sequence
  chemically synthesized
aagaaaaaaaatgcacaaatta

SEQ ID NO: 155116 - DNA, 22 bp, Artificial Sequence
  chemically synthesized
taatgaaagagaatgcagtatg

SEQ ID NO: 155117 - DNA, 22 bp, Artificial Sequence
  chemically synthesized
ctccctgtggactatgtaccag

SEQ ID NO: 155118 - DNA, 22 bp, Artificial Sequence
  chemically synthesized
tccctgtggactatgtaccaga

SEQ ID NO: 155119 - DNA, 22 bp, Artificial Sequence
  chemically synthesized
cctgtggactatgtaccagaag

SEQ ID NO: 155120 - DNA, 22 bp, Artificial Sequence
  chemically synthesized
tggactatgtaccagaagcagc

SEQ ID NO: 155121 - DNA, 22 bp, Artificial Sequence
  chemically synthesized
tgtaccagaagcagctctgtgt

SEQ ID NO: 155122 - DNA, 22 bp, Artificial Sequence
  chemically synthesized
tgtgtcatctccttccatggga

SEQ ID NO: 155123 - DNA, 22 bp, Artificial Sequence
  chemically synthesized
tgtcatctccttccatgggagg

SEQ ID NO: 155124 - DNA, 22 bp, Artificial Sequence
  chemically synthesized
cttccatgggaggagtaaaatt

SEQ ID NO: 155125 - DNA, 22 bp, Artificial Sequence
  chemically synthesized
ccatgggaggagtaaaattcgt

SEQ ID NO: 155126 - DNA, 22 bp, Artificial Sequence
  chemically synthesized
catgggaggagtaaaattcgtc

SEQ ID NO: 155127 - DNA, 22 bp, Artificial Sequence
  chemically synthesized
gtcctcttaagctgaaaacctt

SEQ ID NO: 155128 - DNA, 22 bp, Artificial Sequence
  chemically synthesized
ttaagctgaaaaccttgggccc

SEQ ID NO: 155129 - DNA, 22 bp, Artificial Sequence
  chemically synthesized
aagctgaaaaccttgggcccaa

SEQ ID NO: 155130 - DNA, 22 bp, Artificial Sequence
  chemically synthesized
agctgaaaaccttgggcccaag

SEQ ID NO: 155131 - DNA, 22 bp, Artificial Sequence
  chemically synthesized
aaaaccttgggcccaagacatg

SEQ ID NO: 155132 - DNA, 22 bp, Artificial Sequence
  chemically synthesized
gggcccaagacatgctttaaaa

SEQ ID NO: 155133 - DNA, 22 bp, Artificial Sequence
  chemically synthesized
ggcccaagacatgctttaaaag

SEQ ID NO: 155134 - DNA, 22 bp, Artificial Sequence
  chemically synthesized
taaaagaagtataaatagttcc

SEQ ID NO: 155135 - DNA, 22 bp, Artificial Sequence
  chemically synthesized
aaaagaagtataaatagttcca

SEQ ID NO: 155136 - DNA, 22 bp, Artificial Sequence
  chemically synthesized
aaagaagtataaatagttccag

SEQ ID NO: 155137 - DNA, 22 bp, Artificial Sequence
  chemically synthesized
cagatttcctaatctctttgca

SEQ ID NO: 155138 - DNA, 22 bp, Artificial Sequence
  chemically synthesized
cctaatctctttgcatttattt

SEQ ID NO: 155139 - DNA, 22 bp, Artificial Sequence
  chemically synthesized
ctaatctctttgcatttatttt

SEQ ID NO: 155140 - DNA, 22 bp, Artificial Sequence
  chemically synthesized
atctctttgcatttattttgtc

SEQ ID NO: 155141 - DNA, 22 bp, Artificial Sequence
  chemically synthesized
tttgcatttattttgtctcctc

SEQ ID NO: 155142 - DNA, 22 bp, Artificial Sequence
  chemically synthesized
tgcatttattttgtctcctctc

SEQ ID NO: 155143 - DNA, 22 bp, Artificial Sequence
  chemically synthesized
gcatttattttgtctcctctca

SEQ ID NO: 155144 - DNA, 22 bp, Artificial Sequence
  chemically synthesized
catttattttgtctcctctcaa

SEQ ID NO: 155145 - DNA, 22 bp, Artificial Sequence
  chemically synthesized
attttgtctcctctcaacctgc

SEQ ID NO: 155146 - DNA, 22 bp, Artificial Sequence
  chemically synthesized
ttttgtctcctctcaacctgct

SEQ ID NO: 155147 - DNA, 22 bp, Artificial Sequence
  chemically synthesized
tgtctcctctcaacctgctaaa

SEQ ID NO: 155148 - DNA, 22 bp, Artificial Sequence
  chemically synthesized
gtctcctctcaacctgctaaat

SEQ ID NO: 155149 - DNA, 22 bp, Artificial Sequence
  chemically synthesized
tctcctctcaacctgctaaata

SEQ ID NO: 155150 - DNA, 22 bp, Artificial Sequence
  chemically synthesized
ctctcaacctgctaaatatctt

SEQ ID NO: 155151 - DNA, 22 bp, Artificial Sequence
  chemically synthesized
tcaacctgctaaatatcttcag

SEQ ID NO: 155152 - DNA, 22 bp, Artificial Sequence
  chemically synthesized
aacctgctaaatatcttcagga

SEQ ID NO: 155153 - DNA, 22 bp, Artificial Sequence
  chemically synthesized
ctaaatatcttcaggattctag

SEQ ID NO: 155154 - DNA, 22 bp, Artificial Sequence
  chemically synthesized
aatatcttcaggattctagaaa

SEQ ID NO: 155155 - DNA, 22 bp, Artificial Sequence
  chemically synthesized
caggattctagaaaatgcaagt

SEQ ID NO: 155156 - DNA, 22 bp, Artificial Sequence
  chemically synthesized
aggattctagaaaatgcaagta

SEQ ID NO: 155157 - DNA, 22 bp, Artificial Sequence
  chemically synthesized
tagaaaatgcaagtaagtaaac

SEQ ID NO: 155158 - DNA, 22 bp, Artificial Sequence
  chemically synthesized
gaaaatgcaagtaagtaaactg

SEQ ID NO: 155159 - DNA, 22 bp, Artificial Sequence
  chemically synthesized
agttatgctcaatgaaaacttg

SEQ ID NO: 155160 - DNA, 22 bp, Artificial Sequence
  chemically synthesized
tgctcaatgaaaacttgtagaa

SEQ ID NO: 155161 - DNA, 22 bp, Artificial Sequence
  chemically synthesized
aatgaaaacttgtagaaaataa

SEQ ID NO: 155162 - DNA, 22 bp, Artificial Sequence
  chemically synthesized
gtagaaaataacaccagaaaaa

SEQ ID NO: 155163 - DNA, 22 bp, Artificial Sequence
  chemically synthesized
tagaaaataacaccagaaaaaa

SEQ ID NO: 155164 - DNA, 22 bp, Artificial Sequence
  chemically synthesized
cagaagcagctcattcttccga

SEQ ID NO: 155165 - DNA, 22 bp, Artificial Sequence
  chemically synthesized
attcttccgataacttaatcat

SEQ ID NO: 155166 - DNA, 22 bp, Artificial Sequence
  chemically synthesized
ttccgataacttaatcatctaa

SEQ ID NO: 155167 - DNA, 22 bp, Artificial Sequence
  chemically synthesized
ccgataacttaatcatctaaca

SEQ ID NO: 155168 - DNA, 22 bp, Artificial Sequence
  chemically synthesized
cgataacttaatcatctaacat

SEQ ID NO: 155169 - DNA, 22 bp, Artificial Sequence
  chemically synthesized
aatcatctaacattttccttga

SEQ ID NO: 155170 - DNA, 22 bp, Artificial Sequence
  chemically synthesized
atcatctaacattttccttgat

SEQ ID NO: 155171 - DNA, 22 bp, Artificial Sequence
  chemically synthesized
acattttccttgatttttgacc

SEQ ID NO: 155172 - DNA, 22 bp, Artificial Sequence
  chemically synthesized
tccttgatttttgacccatgga

SEQ ID NO: 155173 - DNA, 22 bp, Artificial Sequence
  chemically synthesized
ccttgatttttgacccatggaa

SEQ ID NO: 155174 - DNA, 22 bp, Artificial Sequence
  chemically synthesized
cttgatttttgacccatggaat

SEQ ID NO: 155175 - DNA, 22 bp, Artificial Sequence
  chemically synthesized
gatttttgacccatggaatact

SEQ ID NO: 155176 - DNA, 22 bp, Artificial Sequence
  chemically synthesized
atttttgacccatggaatacta

SEQ ID NO: 155177 - DNA, 22 bp, Artificial Sequence
  chemically synthesized
ttgacccatggaatactagact

SEQ ID NO: 155178 - DNA, 22 bp, Artificial Sequence
  chemically synthesized
tgacccatggaatactagactt

SEQ ID NO: 155179 - DNA, 22 bp, Artificial Sequence
  chemically synthesized
gacccatggaatactagacttg

SEQ ID NO: 155180 - DNA, 22 bp, Artificial Sequence
  chemically synthesized
acccatggaatactagacttgg

SEQ ID NO: 155181 - DNA, 22 bp, Artificial Sequence
  chemically synthesized
gacttggctttagctggagttg

SEQ ID NO: 155182 - DNA, 22 bp, Artificial Sequence
  chemically synthesized
ggctttagctggagttgatttg

SEQ ID NO: 155183 - DNA, 22 bp, Artificial Sequence
  chemically synthesized
gctttagctggagttgatttgc

SEQ ID NO: 155184 - DNA, 22 bp, Artificial Sequence
  chemically synthesized
tagctggagttgatttgcaatt

SEQ ID NO: 155185 - DNA, 22 bp, Artificial Sequence
  chemically synthesized
agctggagttgatttgcaattg

SEQ ID NO: 155186 - DNA, 22 bp, Artificial Sequence
  chemically synthesized
gctggagttgatttgcaattgt

SEQ ID NO: 155187 - DNA, 22 bp, Artificial Sequence
  chemically synthesized
gagttgatttgcaattgtagta

SEQ ID NO: 155188 - DNA, 22 bp, Artificial Sequence
  chemically synthesized
atttgcaattgtagtatttttt

SEQ ID NO: 155189 - DNA, 22 bp, Artificial Sequence
  chemically synthesized
gcaattgtagtattttttgtgt

SEQ ID NO: 155190 - DNA, 22 bp, Artificial Sequence
  chemically synthesized
caattgtagtattttttgtgtt

SEQ ID NO: 155191 - DNA, 22 bp, Artificial Sequence
  chemically synthesized
tagtattttttgtgttcttgta

SEQ ID NO: 155192 - DNA, 22 bp, Artificial Sequence
  chemically synthesized
tttgtgttcttgtattaagtaa

SEQ ID NO: 155193 - DNA, 22 bp, Artificial Sequence
  chemically synthesized
ttgtgttcttgtattaagtaag

SEQ ID NO: 155194 - DNA, 22 bp, Artificial Sequence
  chemically synthesized
tgtgttcttgtattaagtaagt

SEQ ID NO: 155195 - DNA, 22 bp, Artificial Sequence
  chemically synthesized
gtgttcttgtattaagtaagtc

SEQ ID NO: 155196 - DNA, 22 bp, Artificial Sequence
  chemically synthesized
tgttcttgtattaagtaagtca

SEQ ID NO: 155197 - DNA, 22 bp, Artificial Sequence
  chemically synthesized
ttgtattaagtaagtcattttc

SEQ ID NO: 155198 - DNA, 22 bp, Artificial Sequence
  chemically synthesized
gtattaagtaagtcattttcaa

SEQ ID NO: 155199 - DNA, 22 bp, Artificial Sequence
  chemically synthesized
tattaagtaagtcattttcaaa

SEQ ID NO: 155200 - DNA, 22 bp, Artificial Sequence
  chemically synthesized
agtaagtcattttcaaaaagaa

SEQ ID NO: 155201 - DNA, 22 bp, Artificial Sequence
  chemically synthesized
tcaaaaagaatattttagtttt

SEQ ID NO: 155202 - DNA, 22 bp, Artificial Sequence
  chemically synthesized
caaaaagaatattttagttttc

SEQ ID NO: 155203 - DNA, 22 bp, Artificial Sequence
  chemically synthesized
aaaaagaatattttagttttct

SEQ ID NO: 155204 - DNA, 22 bp, Artificial Sequence
  chemically synthesized
tagttttctcttagaatatgtt

SEQ ID NO: 155205 - DNA, 22 bp, Artificial Sequence
  chemically synthesized
agttttctcttagaatatgttt

SEQ ID NO: 155206 - DNA, 22 bp, Artificial Sequence
  chemically synthesized
gttttctcttagaatatgttta

SEQ ID NO: 155207 - DNA, 22 bp, Artificial Sequence
  chemically synthesized
tctcttagaatatgtttaaata

SEQ ID NO: 155208 - DNA, 22 bp, Artificial Sequence
  chemically synthesized
ctcttagaatatgtttaaataa

SEQ ID NO: 155209 - DNA, 22 bp, Artificial Sequence
  chemically synthesized
tcttagaatatgtttaaataat

SEQ ID NO: 155210 - DNA, 22 bp, Artificial Sequence
  chemically synthesized
ttagaatatgtttaaataatgc

SEQ ID NO: 155211 - DNA, 22 bp, Artificial Sequence
  chemically synthesized
agaatatgtttaaataatgctc

SEQ ID NO: 155212 - DNA, 22 bp, Artificial Sequence
  chemically synthesized
gaatatgtttaaataatgctca

SEQ ID NO: 155213 - DNA, 22 bp, Artificial Sequence
  chemically synthesized
aaataatgctcattttctttga

SEQ ID NO: 155214 - DNA, 22 bp, Artificial Sequence
  chemically synthesized
aataatgctcattttctttgat

SEQ ID NO: 155215 - DNA, 22 bp, Artificial Sequence
  chemically synthesized
attttctttgatatgcagattt

SEQ ID NO: 155216 - DNA, 22 bp, Artificial Sequence
  chemically synthesized
tctttgatatgcagatttgaat

SEQ ID NO: 155217 - DNA, 22 bp, Artificial Sequence
  chemically synthesized
ctttgatatgcagatttgaatg

SEQ ID NO: 155218 - DNA, 22 bp, Artificial Sequence
  chemically synthesized
tttgatatgcagatttgaatgt

SEQ ID NO: 155219 - DNA, 22 bp, Artificial Sequence
  chemically synthesized
tgatatgcagatttgaatgttg

SEQ ID NO: 155220 - DNA, 22 bp, Artificial Sequence
  chemically synthesized
gatatgcagatttgaatgttgt

SEQ ID NO: 155221 - DNA, 22 bp, Artificial Sequence
  chemically synthesized
atatgcagatttgaatgttgta

SEQ ID NO: 155222 - DNA, 22 bp, Artificial Sequence
  chemically synthesized
gaatgttgtacaaagattcaat

SEQ ID NO: 155223 - DNA, 22 bp, Artificial Sequence
  chemically synthesized
aatgttgtacaaagattcaatg

SEQ ID NO: 155224 - DNA, 22 bp, Artificial Sequence
  chemically synthesized
tacaaagattcaatgaatttat

SEQ ID NO: 155225 - DNA, 22 bp, Artificial Sequence
  chemically synthesized
aatgaatttatattctagtagt

SEQ ID NO: 155226 - DNA, 22 bp, Artificial Sequence
  chemically synthesized
atattctagtagttaaaacaag

SEQ ID NO: 155227 - DNA, 22 bp, Artificial Sequence
  chemically synthesized
tattctagtagttaaaacaagg

SEQ ID NO: 155228 - DNA, 22 bp, Artificial Sequence
  chemically synthesized
tagtagttaaaacaaggctcag

SEQ ID NO: 155229 - DNA, 22 bp, Artificial Sequence
  chemically synthesized
gtagttaaaacaaggctcagta

SEQ ID NO: 155230 - DNA, 22 bp, Artificial Sequence
  chemically synthesized
aaacaaggctcagtaataaaaa

SEQ ID NO: 155231 - DNA, 22 bp, Artificial Sequence
  chemically synthesized
agtaataaaaaattttagtagt

SEQ ID NO: 155232 - DNA, 22 bp, Artificial Sequence
  chemically synthesized
tagtagtttaatgtgtgtgtgt

SEQ ID NO: 155233 - DNA, 22 bp, Artificial Sequence
  chemically synthesized
agtagtttaatgtgtgtgtgtg

SEQ ID NO: 155234 - DNA, 22 bp, Artificial Sequence
  chemically synthesized
gtagtttaatgtgtgtgtgtgt

SEQ ID NO: 155235 - DNA, 22 bp, Artificial Sequence
  chemically synthesized
aatgtgtgtgtgtgtgtgcatc

SEQ ID NO: 155236 - DNA, 22 bp, Artificial Sequence
  chemically synthesized
atgtgtgtgtgtgtgtgcatcg

SEQ ID NO: 155237 - DNA, 22 bp, Artificial Sequence
  chemically synthesized
tgtagtttattgactattactc

SEQ ID NO: 155238 - DNA, 22 bp, Artificial Sequence
  chemically synthesized
tagtttattgactattactcat

SEQ ID NO: 155239 - DNA, 22 bp, Artificial Sequence
  chemically synthesized
attgactattactcatcaggta

SEQ ID NO: 155240 - DNA, 22 bp, Artificial Sequence
  chemically synthesized
ttgactattactcatcaggtaa

SEQ ID NO: 155241 - DNA, 22 bp, Artificial Sequence
  chemically synthesized
actattactcatcaggtaatag

SEQ ID NO: 155242 - DNA, 22 bp, Artificial Sequence
  chemically synthesized
ttactcatcaggtaatagtcta

SEQ ID NO: 155243 - DNA, 22 bp, Artificial Sequence
  chemically synthesized
ctcatcaggtaatagtctaggc

SEQ ID NO: 155244 - DNA, 22 bp, Artificial Sequence
  chemically synthesized
atcaggtaatagtctaggcaca

SEQ ID NO: 155245 - DNA, 22 bp, Artificial Sequence
  chemically synthesized
ggcacagattaagaagctggca

SEQ ID NO: 155246 - DNA, 22 bp, Artificial Sequence
  chemically synthesized
agaagctggcactccaaaattt

SEQ ID NO: 155247 - DNA, 22 bp, Artificial Sequence
  chemically synthesized
gcactccaaaatttttaactct

SEQ ID NO: 155248 - DNA, 22 bp, Artificial Sequence
  chemically synthesized
caaaatttttaactctcttccc

SEQ ID NO: 155249 - DNA, 22 bp, Artificial Sequence
  chemically synthesized
ttaactctcttccctatgtaac

SEQ ID NO: 155250 - DNA, 22 bp, Artificial Sequence
  chemically synthesized
taactctcttccctatgtaaca

SEQ ID NO: 155251 - DNA, 22 bp, Artificial Sequence
  chemically synthesized
aactctcttccctatgtaacaa

SEQ ID NO: 155252 - DNA, 22 bp, Artificial Sequence
  chemically synthesized
actctcttccctatgtaacaaa

SEQ ID NO: 155253 - DNA, 22 bp, Artificial Sequence
  chemically synthesized
tcttccctatgtaacaaagata

SEQ ID NO: 155254 - DNA, 22 bp, Artificial Sequence
  chemically synthesized
ttccctatgtaacaaagatatt

SEQ ID NO: 155255 - DNA, 22 bp, Artificial Sequence
  chemically synthesized
ccctatgtaacaaagatattat

SEQ ID NO: 155256 - DNA, 22 bp, Artificial Sequence
  chemically synthesized
cctatgtaacaaagatattata

SEQ ID NO: 155257 - DNA, 22 bp, Artificial Sequence
  chemically synthesized
tgtaacaaagatattatactgg

SEQ ID NO: 155258 - DNA, 22 bp, Artificial Sequence
  chemically synthesized
tactggtgatggggcaaaaata

SEQ ID NO: 155259 - DNA, 22 bp, Artificial Sequence
  chemically synthesized
gtgatggggcaaaaataaaact

SEQ ID NO: 155260 - DNA, 22 bp, Artificial Sequence
  chemically synthesized
catttcaaaattcatgtgtctg

SEQ ID NO: 155261 - DNA, 22 bp, Artificial Sequence
  chemically synthesized
caaaattcatgtgtctgtcacc

SEQ ID NO: 155262 - DNA, 22 bp, Artificial Sequence
  chemically synthesized
aaaattcatgtgtctgtcacca

SEQ ID NO: 155263 - DNA, 22 bp, Artificial Sequence
  chemically synthesized
atgtgtctgtcaccatgctgaa

SEQ ID NO: 155264 - DNA, 22 bp, Artificial Sequence
  chemically synthesized
tcaccatgctgaactatttgca

SEQ ID NO: 155265 - DNA, 22 bp, Artificial Sequence
  chemically synthesized
aactatttgcaccttataaaag

SEQ ID NO: 155266 - DNA, 22 bp, Artificial Sequence
  chemically synthesized
tttgcaccttataaaagtaaat

SEQ ID NO: 155267 - DNA, 22 bp, Artificial Sequence
  chemically synthesized
gcaccttataaaagtaaatgac

SEQ ID NO: 155268 - DNA, 22 bp, Artificial Sequence
  chemically synthesized
caccttataaaagtaaatgaca

SEQ ID NO: 155269 - DNA, 22 bp, Artificial Sequence
  chemically synthesized
ataaaagtaaatgacagataca

SEQ ID NO: 155270 - DNA, 22 bp, Artificial Sequence
  chemically synthesized
taaaagtaaatgacagatacag

SEQ ID NO: 155271 - DNA, 22 bp, Artificial Sequence
  chemically synthesized
ccaattgataccatgtgcccag

SEQ ID NO: 155272 - DNA, 22 bp, Artificial Sequence
  chemically synthesized
ataccatgtgcccagtataaga

SEQ ID NO: 155273 - DNA, 22 bp, Artificial Sequence
  chemically synthesized
attaaaaaaaaatttattccta

SEQ ID NO: 155274 - DNA, 22 bp, Artificial Sequence
  chemically synthesized
ttaaaaaaaaatttattcctag

SEQ ID NO: 155275 - DNA, 22 bp, Artificial Sequence
  chemically synthesized
aaaaaaaatttattcctagtat

SEQ ID NO: 155276 - DNA, 22 bp, Artificial Sequence
  chemically synthesized
attcctagtatttatggatact

SEQ ID NO: 155277 - DNA, 22 bp, Artificial Sequence
  chemically synthesized
ttcctagtatttatggatactc

SEQ ID NO: 155278 - DNA, 22 bp, Artificial Sequence
  chemically synthesized
ctagtatttatggatactctaa

SEQ ID NO: 155279 - DNA, 22 bp, Artificial Sequence
  chemically synthesized
gtatttatggatactctaaatc

SEQ ID NO: 155280 - DNA, 22 bp, Artificial Sequence
  chemically synthesized
atggatactctaaatcaattca

SEQ ID NO: 155281 - DNA, 22 bp, Artificial Sequence
  chemically synthesized
tggatactctaaatcaattcaa

SEQ ID NO: 155282 - DNA, 22 bp, Artificial Sequence
  chemically synthesized
taaatcaattcaatctcagttt

SEQ ID NO: 155283 - DNA, 22 bp, Artificial Sequence
  chemically synthesized
aatcaattcaatctcagtttga

SEQ ID NO: 155284 - DNA, 22 bp, Artificial Sequence
  chemically synthesized
aatctcagtttgatggataata

SEQ ID NO: 155285 - DNA, 22 bp, Artificial Sequence
  chemically synthesized
agtttgatggataataagcctg

SEQ ID NO: 155286 - DNA, 22 bp, Artificial Sequence
  chemically synthesized
gatggataataagcctgaagtc

SEQ ID NO: 155287 - DNA, 22 bp, Artificial Sequence
  chemically synthesized
atggataataagcctgaagtcc

SEQ ID NO: 155288 - DNA, 22 bp, Artificial Sequence
  chemically synthesized
aagtcctgaaagttaaacttat

SEQ ID NO: 155289 - DNA, 22 bp, Artificial Sequence
  chemically synthesized
aaagttaaacttattccagttg

SEQ ID NO: 155290 - DNA, 22 bp, Artificial Sequence
  chemically synthesized
aacttattccagttgacaataa

SEQ ID NO: 155291 - DNA, 22 bp, Artificial Sequence
  chemically synthesized
attccagttgacaataattttg

SEQ ID NO: 155292 - DNA, 22 bp, Artificial Sequence
  chemically synthesized
ttccagttgacaataattttgg

SEQ ID NO: 155293 - DNA, 22 bp, Artificial Sequence
  chemically synthesized
cagttgacaataattttggtct

SEQ ID NO: 155294 - DNA, 22 bp, Artificial Sequence
  chemically synthesized
acaataattttggtcttaattg

SEQ ID NO: 155295 - DNA, 22 bp, Artificial Sequence
  chemically synthesized
tggtcttaattgctacaatttt

SEQ ID NO: 155296 - DNA, 22 bp, Artificial Sequence
  chemically synthesized
ggtcttaattgctacaattttg

SEQ ID NO: 155297 - DNA, 22 bp, Artificial Sequence
  chemically synthesized
gtcttaattgctacaattttgt

SEQ ID NO: 155298 - DNA, 22 bp, Artificial Sequence
  chemically synthesized
aattgctacaattttgttagtg

SEQ ID NO: 155299 - DNA, 22 bp, Artificial Sequence
  chemically synthesized
attgctacaattttgttagtgt

SEQ ID NO: 155300 - DNA, 22 bp, Artificial Sequence
  chemically synthesized
ctacaattttgttagtgtcctg

SEQ ID NO: 155301 - DNA, 22 bp, Artificial Sequence
  chemically synthesized
caattttgttagtgtcctgatg

SEQ ID NO: 155302 - DNA, 22 bp, Artificial Sequence
  chemically synthesized
tgttagtgtcctgatgtcatct

SEQ ID NO: 155303 - DNA, 22 bp, Artificial Sequence
  chemically synthesized
gttagtgtcctgatgtcatcta

SEQ ID NO: 155304 - DNA, 22 bp, Artificial Sequence
  chemically synthesized
ttagtgtcctgatgtcatctat

SEQ ID NO: 155305 - DNA, 22 bp, Artificial Sequence
  chemically synthesized
gtgtcctgatgtcatctattgt

SEQ ID NO: 155306 - DNA, 22 bp, Artificial Sequence
  chemically synthesized
atgtcatctattgttgggatag

SEQ ID NO: 155307 - DNA, 22 bp, Artificial Sequence
  chemically synthesized
ttgttgggatagagatataaat

SEQ ID NO: 155308 - DNA, 22 bp, Artificial Sequence
  chemically synthesized
ttgggatagagatataaatgac

SEQ ID NO: 155309 - DNA, 22 bp, Artificial Sequence
  chemically synthesized
ggatagagatataaatgactta

SEQ ID NO: 155310 - DNA, 22 bp, Artificial Sequence
  chemically synthesized
atgtagctaccttcctaagaca

SEQ ID NO: 155311 - DNA, 22 bp, Artificial Sequence
  chemically synthesized
tgtagctaccttcctaagacac

SEQ ID NO: 155312 - DNA, 22 bp, Artificial Sequence
  chemically synthesized
ccttcctaagacactgacttca

SEQ ID NO: 155313 - DNA, 22 bp, Artificial Sequence
  chemically synthesized
cctaagacactgacttcagaaa

SEQ ID NO: 155314 - DNA, 22 bp, Artificial Sequence
  chemically synthesized
ctaagacactgacttcagaaaa

SEQ ID NO: 155315 - DNA, 22 bp, Artificial Sequence
  chemically synthesized
agacactgacttcagaaaagac

SEQ ID NO: 155316 - DNA, 22 bp, Artificial Sequence
  chemically synthesized
acttcagaaaagactcacattt

SEQ ID NO: 155317 - DNA, 22 bp, Artificial Sequence
  chemically synthesized
cagaaaagactcacattttaaa

SEQ ID NO: 155318 - DNA, 22 bp, Artificial Sequence
  chemically synthesized
agaaaagactcacattttaaat

SEQ ID NO: 155319 - DNA, 22 bp, Artificial Sequence
  chemically synthesized
acattttaaatttatgcttatt

SEQ ID NO: 155320 - DNA, 22 bp, Artificial Sequence
  chemically synthesized
taaatttatgcttattgttagg

SEQ ID NO: 155321 - DNA, 22 bp, Artificial Sequence
  chemically synthesized
aaatttatgcttattgttaggt

SEQ ID NO: 155322 - DNA, 22 bp, Artificial Sequence
  chemically synthesized
aatttatgcttattgttaggta

SEQ ID NO: 155323 - DNA, 22 bp, Artificial Sequence
  chemically synthesized
atgcttattgttaggtatttta

SEQ ID NO: 155324 - DNA, 22 bp, Artificial Sequence
  chemically synthesized
tgcttattgttaggtattttac

SEQ ID NO: 155325 - DNA, 22 bp, Artificial Sequence
  chemically synthesized
attgttaggtattttacaagca

SEQ ID NO: 155326 - DNA, 22 bp, Artificial Sequence
  chemically synthesized
ttgttaggtattttacaagcaa

SEQ ID NO: 155327 - DNA, 22 bp, Artificial Sequence
  chemically synthesized
ttaggtattttacaagcaagag

SEQ ID NO: 155328 - DNA, 22 bp, Artificial Sequence
  chemically synthesized
ggtattttacaagcaagagaac

SEQ ID NO: 155329 - DNA, 22 bp, Artificial Sequence
  chemically synthesized
tacaagcaagagaactaaagtt

SEQ ID NO: 155330 - DNA, 22 bp, Artificial Sequence
  chemically synthesized
acaagcaagagaactaaagttt

SEQ ID NO: 155331 - DNA, 22 bp, Artificial Sequence
  chemically synthesized
caagcaagagaactaaagttta

SEQ ID NO: 155332 - DNA, 22 bp, Artificial Sequence
  chemically synthesized
aagtttaaattaaatgacgtgt

SEQ ID NO: 155333 - DNA, 22 bp, Artificial Sequence
  chemically synthesized
aaattaaatgacgtgtccaggg

SEQ ID NO: 155334 - DNA, 22 bp, Artificial Sequence
  chemically synthesized
aattaaatgacgtgtccagggt

SEQ ID NO: 155335 - DNA, 22 bp, Artificial Sequence
  chemically synthesized
aatgacgtgtccagggtcatag

SEQ ID NO: 155336 - DNA, 22 bp, Artificial Sequence
  chemically synthesized
agccagtatttaaatacaacta

SEQ ID NO: 155337 - DNA, 22 bp, Artificial Sequence
  chemically synthesized
gccagtatttaaatacaactat

SEQ ID NO: 155338 - DNA, 22 bp, Artificial Sequence
  chemically synthesized
aaatacaactatatatgtcctt

SEQ ID NO: 155339 - DNA, 22 bp, Artificial Sequence
  chemically synthesized
aatacaactatatatgtcctta

SEQ ID NO: 155340 - DNA, 22 bp, Artificial Sequence
  chemically synthesized
tatatgtccttagagctatact

SEQ ID NO: 155341 - DNA, 22 bp, Artificial Sequence
  chemically synthesized
agagctatactgtttctattac

SEQ ID NO: 155342 - DNA, 22 bp, Artificial Sequence
  chemically synthesized
gagctatactgtttctattaca

SEQ ID NO: 155343 - DNA, 22 bp, Artificial Sequence
  chemically synthesized
tactgtttctattacaccacac

SEQ ID NO: 155344 - DNA, 22 bp, Artificial Sequence
  chemically synthesized
tttctattacaccacactatct

SEQ ID NO: 155345 - DNA, 22 bp, Artificial Sequence
  chemically synthesized
ctattacaccacactatctttg

SEQ ID NO: 155346 - DNA, 22 bp, Artificial Sequence
  chemically synthesized
tattacaccacactatctttgc

SEQ ID NO: 155347 - DNA, 22 bp, Artificial Sequence
  chemically synthesized
ttacaccacactatctttgctc

SEQ ID NO: 155348 - DNA, 22 bp, Artificial Sequence
  chemically synthesized
caccacactatctttgctccgt

SEQ ID NO: 155349 - DNA, 22 bp, Artificial Sequence
  chemically synthesized
tctttgctccgtggatacattc

SEQ ID NO: 155350 - DNA, 22 bp, Artificial Sequence
  chemically synthesized
tgctccgtggatacattcatga

SEQ ID NO: 155351 - DNA, 22 bp, Artificial Sequence
  chemically synthesized
gctccgtggatacattcatgat

SEQ ID NO: 155352 - DNA, 22 bp, Artificial Sequence
  chemically synthesized
ctccgtggatacattcatgatt

SEQ ID NO: 155353 - DNA, 22 bp, Artificial Sequence
  chemically synthesized
cgtggatacattcatgattcag

SEQ ID NO: 155354 - DNA, 22 bp, Artificial Sequence
  chemically synthesized
atgattcagtcagaatatgctg

SEQ ID NO: 155355 - DNA, 22 bp, Artificial Sequence
  chemically synthesized
agtcagaatatgctgtcagaaa

SEQ ID NO: 155356 - DNA, 22 bp, Artificial Sequence
  chemically synthesized
tcagaaatatcctagaataatg

SEQ ID NO: 155357 - DNA, 22 bp, Artificial Sequence
  chemically synthesized
gaataatgctacaaggaaccca

SEQ ID NO: 155358 - DNA, 22 bp, Artificial Sequence
  chemically synthesized
caaggaacccaggcctataatt

SEQ ID NO: 155359 - DNA, 22 bp, Artificial Sequence
  chemically synthesized
taatttgggtcatcacatatga

SEQ ID NO: 155360 - DNA, 22 bp, Artificial Sequence
  chemically synthesized
gggtcatcacatatgacaatgt

SEQ ID NO: 155361 - DNA, 22 bp, Artificial Sequence
  chemically synthesized
ggtcatcacatatgacaatgtt

SEQ ID NO: 155362 - DNA, 22 bp, Artificial Sequence
  chemically synthesized
taggaaaaacaaaaaaacaaac

SEQ ID NO: 155363 - DNA, 22 bp, Artificial Sequence
  chemically synthesized
aggaaaaacaaaaaaacaaaca

SEQ ID NO: 155364 - DNA, 22 bp, Artificial Sequence
  chemically synthesized
ggaaaaacaaaaaaacaaacaa

SEQ ID NO: 155365 - DNA, 22 bp, Artificial Sequence
  chemically synthesized
aaaaaccataggtatcacaaaa

SEQ ID NO: 155366 - DNA, 22 bp, Artificial Sequence
  chemically synthesized
aaaaccataggtatcacaaaag

SEQ ID NO: 155367 - DNA, 22 bp, Artificial Sequence
  chemically synthesized
aaaggccagaaaatctgttttc

SEQ ID NO: 155368 - DNA, 22 bp, Artificial Sequence
  chemically synthesized
aaggccagaaaatctgttttct

SEQ ID NO: 155369 - DNA, 22 bp, Artificial Sequence
  chemically synthesized
ttttctttcccccttatcttca

SEQ ID NO: 155370 - DNA, 22 bp, Artificial Sequence
  chemically synthesized
tctttcccccttatcttcattc

SEQ ID NO: 155371 - DNA, 22 bp, Artificial Sequence
  chemically synthesized
ctttcccccttatcttcattcc

SEQ ID NO: 155372 - DNA, 22 bp, Artificial Sequence
  chemically synthesized
tttcccccttatcttcattcct

SEQ ID NO: 155373 - DNA, 22 bp, Artificial Sequence
  chemically synthesized
tcccccttatcttcattcctgt

SEQ ID NO: 155374 - DNA, 22 bp, Artificial Sequence
  chemically synthesized
cccccttatcttcattcctgta

SEQ ID NO: 155375 - DNA, 22 bp, Artificial Sequence
  chemically synthesized
ccccttatcttcattcctgtat

SEQ ID NO: 155376 - DNA, 22 bp, Artificial Sequence
  chemically synthesized
atcttcattcctgtattttttt

SEQ ID NO: 155377 - DNA, 22 bp, Artificial Sequence
  chemically synthesized
tcttcattcctgtatttttttt

SEQ ID NO: 155378 - DNA, 22 bp, Artificial Sequence
  chemically synthesized
cattcctgtatttttttttcac

SEQ ID NO: 155379 - DNA, 22 bp, Artificial Sequence
  chemically synthesized
attcctgtatttttttttcact

SEQ ID NO: 155380 - DNA, 22 bp, Artificial Sequence
  chemically synthesized
ctgtatttttttttcacttaga

SEQ ID NO: 155381 - DNA, 22 bp, Artificial Sequence
  chemically synthesized
tatttttttttcacttagattc

SEQ ID NO: 155382 - DNA, 22 bp, Artificial Sequence
  chemically synthesized
ttttttcacttagattcttctc

SEQ ID NO: 155383 - DNA, 22 bp, Artificial Sequence
  chemically synthesized
tttttcacttagattcttctct

SEQ ID NO: 155384 - DNA, 22 bp, Artificial Sequence
  chemically synthesized
ttttcacttagattcttctctc

SEQ ID NO: 155385 - DNA, 22 bp, Artificial Sequence
  chemically synthesized
tttcacttagattcttctctcc

SEQ ID NO: 155386 - DNA, 22 bp, Artificial Sequence
  chemically synthesized
ttcacttagattcttctctccc

SEQ ID NO: 155387 - DNA, 22 bp, Artificial Sequence
  chemically synthesized
tcacttagattcttctctccca

SEQ ID NO: 155388 - DNA, 22 bp, Artificial Sequence
  chemically synthesized
cacttagattcttctctcccat

SEQ ID NO: 155389 - DNA, 22 bp, Artificial Sequence
  chemically synthesized
acttagattcttctctcccatc

SEQ ID NO: 155390 - DNA, 22 bp, Artificial Sequence
  chemically synthesized
agattcttctctcccatcccta

SEQ ID NO: 155391 - DNA, 22 bp, Artificial Sequence
  chemically synthesized
gattcttctctcccatccctaa

SEQ ID NO: 155392 - DNA, 22 bp, Artificial Sequence
  chemically synthesized
ttctctcccatccctaatgtcc

SEQ ID NO: 155393 - DNA, 22 bp, Artificial Sequence
  chemically synthesized
ctctcccatccctaatgtcctg

SEQ ID NO: 155394 - DNA, 22 bp, Artificial Sequence
  chemically synthesized
tctcccatccctaatgtcctga

SEQ ID NO: 155395 - DNA, 22 bp, Artificial Sequence
  chemically synthesized
tcccatccctaatgtcctgatg

SEQ ID NO: 155396 - DNA, 22 bp, Artificial Sequence
  chemically synthesized
ccatccctaatgtcctgatgaa

SEQ ID NO: 155397 - DNA, 22 bp, Artificial Sequence
  chemically synthesized
atgtcctgatgaagccccagtc

SEQ ID NO: 155398 - DNA, 22 bp, Artificial Sequence
  chemically synthesized
atgaagccccagtcactgtaac

SEQ ID NO: 155399 - DNA, 22 bp, Artificial Sequence
  chemically synthesized
taaccctcacttctataactac

SEQ ID NO: 155400 - DNA, 22 bp, Artificial Sequence
  chemically synthesized
acttctataactacgcttcact

SEQ ID NO: 155401 - DNA, 22 bp, Artificial Sequence
  chemically synthesized
ctataactacgcttcactcaca

SEQ ID NO: 155402 - DNA, 22 bp, Artificial Sequence
  chemically synthesized
tataactacgcttcactcacat

SEQ ID NO: 155403 - DNA, 22 bp, Artificial Sequence
  chemically synthesized
taactacgcttcactcacatgc

SEQ ID NO: 155404 - DNA, 22 bp, Artificial Sequence
  chemically synthesized
cgcttcactcacatgcatggct

SEQ ID NO: 155405 - DNA, 22 bp, Artificial Sequence
  chemically synthesized
cactcacatgcatggctctggc

SEQ ID NO: 155406 - DNA, 22 bp, Artificial Sequence
  chemically synthesized
actcacatgcatggctctggcc

SEQ ID NO: 155407 - DNA, 22 bp, Artificial Sequence
  chemically synthesized
acatgcatggctctggcctaga

SEQ ID NO: 155408 - DNA, 22 bp, Artificial Sequence
  chemically synthesized
tggcctagaactgtgtcaggaa

SEQ ID NO: 155409 - DNA, 22 bp, Artificial Sequence
  chemically synthesized
gcctagaactgtgtcaggaatg

SEQ ID NO: 155410 - DNA, 22 bp, Artificial Sequence
  chemically synthesized
gaactgtgtcaggaatgcttca

SEQ ID NO: 155411 - DNA, 22 bp, Artificial Sequence
  chemically synthesized
tgtcaggaatgcttcaaaatta

SEQ ID NO: 155412 - DNA, 22 bp, Artificial Sequence
  chemically synthesized
caaaattattctttcctttctc

SEQ ID NO: 155413 - DNA, 22 bp, Artificial Sequence
  chemically synthesized
aaaattattctttcctttctct

SEQ ID NO: 155414 - DNA, 22 bp, Artificial Sequence
  chemically synthesized
ttctttcctttctctgaaacat

SEQ ID NO: 155415 - DNA, 22 bp, Artificial Sequence
  chemically synthesized
tttcctttctctgaaacatcaa

SEQ ID NO: 155416 - DNA, 22 bp, Artificial Sequence
  chemically synthesized
tcctttctctgaaacatcaaca

SEQ ID NO: 155417 - DNA, 22 bp, Artificial Sequence
  chemically synthesized
cctttctctgaaacatcaacag

SEQ ID NO: 155418 - DNA, 22 bp, Artificial Sequence
  chemically synthesized
ctttctctgaaacatcaacagt

SEQ ID NO: 155419 - DNA, 22 bp, Artificial Sequence
  chemically synthesized
tctctgaaacatcaacagttta

SEQ ID NO: 155420 - DNA, 22 bp, Artificial Sequence
  chemically synthesized
ctctgaaacatcaacagtttac

SEQ ID NO: 155421 - DNA, 22 bp, Artificial Sequence
  chemically synthesized
tctgaaacatcaacagtttact

SEQ ID NO: 155422 - DNA, 22 bp, Artificial Sequence
  chemically synthesized
tgaaacatcaacagtttactta

SEQ ID NO: 155423 - DNA, 22 bp, Artificial Sequence
  chemically synthesized
aaacatcaacagtttacttaaa

SEQ ID NO: 155424 - DNA, 22 bp, Artificial Sequence
  chemically synthesized
acttaaaatattctaacaatgt

SEQ ID NO: 155425 - DNA, 22 bp, Artificial Sequence
  chemically synthesized
cttaaaatattctaacaatgtg

SEQ ID NO: 155426 - DNA, 22 bp, Artificial Sequence
  chemically synthesized
aaaatattctaacaatgtgaga

SEQ ID NO: 155427 - DNA, 22 bp, Artificial Sequence
  chemically synthesized
aaatattctaacaatgtgagat

SEQ ID NO: 155428 - DNA, 22 bp, Artificial Sequence
  chemically synthesized
taacaatgtgagatatatatta

SEQ ID NO: 155429 - DNA, 22 bp, Artificial Sequence
  chemically synthesized
acaatgtgagatatatattaaa

SEQ ID NO: 155430 - DNA, 22 bp, Artificial Sequence
  chemically synthesized
aatagtaaaacaattagtttat

SEQ ID NO: 155431 - DNA, 22 bp, Artificial Sequence
  chemically synthesized
gtttatgtaaataaagtagatc

SEQ ID NO: 155432 - DNA, 22 bp, Artificial Sequence
  chemically synthesized
atgtaaataaagtagatccaca

SEQ ID NO: 155433 - DNA, 22 bp, Artificial Sequence
  chemically synthesized
tgtaaataaagtagatccacag

SEQ ID NO: 155434 - DNA, 22 bp, Artificial Sequence
  chemically synthesized
aataacttcaaattttatctta

SEQ ID NO: 155435 - DNA, 22 bp, Artificial Sequence
  chemically synthesized
caaattttatcttaatattttt

SEQ ID NO: 155436 - DNA, 22 bp, Artificial Sequence
  chemically synthesized
aaattttatcttaatattttta

SEQ ID NO: 155437 - DNA, 22 bp, Artificial Sequence
  chemically synthesized
tatcttaatatttttaaagaac

SEQ ID NO: 155438 - DNA, 22 bp, Artificial Sequence
  chemically synthesized
atcttaatatttttaaagaacc

SEQ ID NO: 155439 - DNA, 22 bp, Artificial Sequence
  chemically synthesized
tcttaatatttttaaagaacct

SEQ ID NO: 155440 - DNA, 22 bp, Artificial Sequence
  chemically synthesized
aatatttttaaagaacctcatt

SEQ ID NO: 155441 - DNA, 22 bp, Artificial Sequence
  chemically synthesized
atatttttaaagaacctcattc

SEQ ID NO: 155442 - DNA, 22 bp, Artificial Sequence
  chemically synthesized
ttaaagaacctcattccaactt

SEQ ID NO: 155443 - DNA, 22 bp, Artificial Sequence
  chemically synthesized
taaagaacctcattccaactta

SEQ ID NO: 155444 - DNA, 22 bp, Artificial Sequence
  chemically synthesized
aaagaacctcattccaacttaa

SEQ ID NO: 155445 - DNA, 22 bp, Artificial Sequence
  chemically synthesized
aagaacctcattccaacttaaa

SEQ ID NO: 155446 - DNA, 22 bp, Artificial Sequence
  chemically synthesized
attccaacttaaagcaagggta

SEQ ID NO: 155447 - DNA, 22 bp, Artificial Sequence
  chemically synthesized
caacttaaagcaagggtaaatt

SEQ ID NO: 155448 - DNA, 22 bp, Artificial Sequence
  chemically synthesized
aaagcaagggtaaattgctcag

SEQ ID NO: 155449 - DNA, 22 bp, Artificial Sequence
  chemically synthesized
aagcaagggtaaattgctcagc

SEQ ID NO: 155450 - DNA, 22 bp, Artificial Sequence
  chemically synthesized
ctcagctgtgtgggtattttaa

SEQ ID NO: 155451 - DNA, 22 bp, Artificial Sequence
  chemically synthesized
agctgtgtgggtattttaaatt

SEQ ID NO: 155452 - DNA, 22 bp, Artificial Sequence
  chemically synthesized
tgtgggtattttaaattctaaa

SEQ ID NO: 155453 - DNA, 22 bp, Artificial Sequence
  chemically synthesized
taaattctaaactgtaactcaa

SEQ ID NO: 155454 - DNA, 22 bp, Artificial Sequence
  chemically synthesized
aaattctaaactgtaactcaaa

SEQ ID NO: 155455 - DNA, 22 bp, Artificial Sequence
  chemically synthesized
aattctaaactgtaactcaaaa

SEQ ID NO: 155456 - DNA, 22 bp, Artificial Sequence
  chemically synthesized
taaactgtaactcaaaaaatgg

SEQ ID NO: 155457 - DNA, 22 bp, Artificial Sequence
  chemically synthesized
aactgtaactcaaaaaatggga

SEQ ID NO: 155458 - DNA, 22 bp, Artificial Sequence
  chemically synthesized
taactcaaaaaatgggacccaa

SEQ ID NO: 155459 - DNA, 22 bp, Artificial Sequence
  chemically synthesized
aaaaaatgggacccaaacattt

SEQ ID NO: 155460 - DNA, 22 bp, Artificial Sequence
  chemically synthesized
ccatcatataaaatttgagacc

SEQ ID NO: 155461 - DNA, 22 bp, Artificial Sequence
  chemically synthesized
catcatataaaatttgagacca

SEQ ID NO: 155462 - DNA, 22 bp, Artificial Sequence
  chemically synthesized
gagaccagaatatttagcactt

SEQ ID NO: 155463 - DNA, 22 bp, Artificial Sequence
  chemically synthesized
agaccagaatatttagcactta

SEQ ID NO: 155464 - DNA, 22 bp, Artificial Sequence
  chemically synthesized
agcacttagcaaaaacaaaagt

SEQ ID NO: 155465 - DNA, 22 bp, Artificial Sequence
  chemically synthesized
gcacttagcaaaaacaaaagta

SEQ ID NO: 155466 - DNA, 22 bp, Artificial Sequence
  chemically synthesized
agcaaaaacaaaagtaaaggta

SEQ ID NO: 155467 - DNA, 22 bp, Artificial Sequence
  chemically synthesized
gcaaaaacaaaagtaaaggtag

SEQ ID NO: 155468 - DNA, 22 bp, Artificial Sequence
  chemically synthesized
tgctatacaatgatcagtatat

SEQ ID NO: 155469 - DNA, 22 bp, Artificial Sequence
  chemically synthesized
tacaatgatcagtatattgaac

SEQ ID NO: 155470 - DNA, 22 bp, Artificial Sequence
  chemically synthesized
aactgtaatggaatcaagagat

SEQ ID NO: 155471 - DNA, 22 bp, Artificial Sequence
  chemically synthesized
taatggaatcaagagatggggg

SEQ ID NO: 155472 - DNA, 22 bp, Artificial Sequence
  chemically synthesized
cttaagcccctgtgccacctca

SEQ ID NO: 155473 - DNA, 22 bp, Artificial Sequence
  chemically synthesized
ttaagcccctgtgccacctcaa

SEQ ID NO: 155474 - DNA, 22 bp, Artificial Sequence
  chemically synthesized
aagcccctgtgccacctcaaaa

SEQ ID NO: 155475 - DNA, 22 bp, Artificial Sequence
  chemically synthesized
agcccctgtgccacctcaaaaa

SEQ ID NO: 155476 - DNA, 22 bp, Artificial Sequence
  chemically synthesized
tgccacctcaaaaaacaagaac

SEQ ID NO: 155477 - DNA, 22 bp, Artificial Sequence
  chemically synthesized
aaaaaacaagaactttagccag

SEQ ID NO: 155478 - DNA, 22 bp, Artificial Sequence
  chemically synthesized
tagccagcttttacttgagaaa

SEQ ID NO: 155479 - DNA, 22 bp, Artificial Sequence
  chemically synthesized
agccagcttttacttgagaaag

SEQ ID NO: 155480 - DNA, 22 bp, Artificial Sequence
  chemically synthesized
gccagcttttacttgagaaagg

SEQ ID NO: 155481 - DNA, 22 bp, Artificial Sequence
  chemically synthesized
ttacttgagaaagggaacttag

SEQ ID NO: 155482 - DNA, 22 bp, Artificial Sequence
  chemically synthesized
tacttgagaaagggaacttaga

SEQ ID NO: 155483 - DNA, 22 bp, Artificial Sequence
  chemically synthesized
acttgagaaagggaacttagag

SEQ ID NO: 155484 - DNA, 22 bp, Artificial Sequence
  chemically synthesized
cttgagaaagggaacttagaga

SEQ ID NO: 155485 - DNA, 22 bp, Artificial Sequence
  chemically synthesized
gagaaagggaacttagagagta

SEQ ID NO: 155486 - DNA, 22 bp, Artificial Sequence
  chemically synthesized
agaaagggaacttagagagtat

SEQ ID NO: 155487 - DNA, 22 bp, Artificial Sequence
  chemically synthesized
agagagtatagaagccacctgt

SEQ ID NO: 155488 - DNA, 22 bp, Artificial Sequence
  chemically synthesized
gagagtatagaagccacctgtc

SEQ ID NO: 155489 - DNA, 22 bp, Artificial Sequence
  chemically synthesized
tcattcacatattattatctat

SEQ ID NO: 155490 - DNA, 22 bp, Artificial Sequence
  chemically synthesized
acatattattatctatgtttat

SEQ ID NO: 155491 - DNA, 22 bp, Artificial Sequence
  chemically synthesized
ttatctatgtttatacccatgc

SEQ ID NO: 155492 - DNA, 22 bp, Artificial Sequence
  chemically synthesized
tctatgtttatacccatgcatc

SEQ ID NO: 155493 - DNA, 22 bp, Artificial Sequence
  chemically synthesized
tgtttatacccatgcatctatc

SEQ ID NO: 155494 - DNA, 22 bp, Artificial Sequence
  chemically synthesized
atacccatgcatctatctatct

SEQ ID NO: 155495 - DNA, 22 bp, Artificial Sequence
  chemically synthesized
tacccatgcatctatctatcta

SEQ ID NO: 155496 - DNA, 22 bp, Artificial Sequence
  chemically synthesized
tctatctatctatctatctatc

SEQ ID NO: 155497 - DNA, 22 bp, Artificial Sequence
  chemically synthesized
tctatctatctatctatctatc

SEQ ID NO: 155498 - DNA, 22 bp, Artificial Sequence
  chemically synthesized
tctatctatctatctatctatc

SEQ ID NO: 155499 - DNA, 22 bp, Artificial Sequence
  chemically synthesized
tctatctatctatctatctatc

SEQ ID NO: 155500 - DNA, 22 bp, Artificial Sequence
  chemically synthesized
tctatctatctatctatctatc

SEQ ID NO: 155501 - DNA, 22 bp, Artificial Sequence
  chemically synthesized
tctatctatctatctatctatc

SEQ ID NO: 155502 - DNA, 22 bp, Artificial Sequence
  chemically synthesized
tctatctatctatctatctatc

SEQ ID NO: 155503 - DNA, 22 bp, Artificial Sequence
  chemically synthesized
tctatctatctatctatctttc

SEQ ID NO: 155504 - DNA, 22 bp, Artificial Sequence
  chemically synthesized
tctatctatctatctttctagc

SEQ ID NO: 155505 - DNA, 22 bp, Artificial Sequence
  chemically synthesized
tctatctatctttctagctagc

SEQ ID NO: 155506 - DNA, 22 bp, Artificial Sequence
  chemically synthesized
tctatctttctagctagctagc

SEQ ID NO: 155507 - DNA, 22 bp, Artificial Sequence
  chemically synthesized
tctttctagctagctagctagc

SEQ ID NO: 155508 - DNA, 22 bp, Artificial Sequence
  chemically synthesized
tctagctagctagctagctagc

SEQ ID NO: 155509 - DNA, 22 bp, Artificial Sequence
  chemically synthesized
ctagctagctagctagctagct

SEQ ID NO: 155510 - DNA, 22 bp, Artificial Sequence
  chemically synthesized
tagctagctagctagctagcta

SEQ ID NO: 155511 - DNA, 22 bp, Artificial Sequence
  chemically synthesized
gctagctagctagctagctagc

SEQ ID NO: 155512 - DNA, 22 bp, Artificial Sequence
  chemically synthesized
gctagctagctagctagctagc

SEQ ID NO: 155513 - DNA, 22 bp, Artificial Sequence
  chemically synthesized
gctagctagctagctagctatc

SEQ ID NO: 155514 - DNA, 22 bp, Artificial Sequence
  chemically synthesized
gctagctagctagctatctacc

SEQ ID NO: 155515 - DNA, 22 bp, Artificial Sequence
  chemically synthesized
gctagctagctatctacctatc

SEQ ID NO: 155516 - DNA, 22 bp, Artificial Sequence
  chemically synthesized
gctagctatctacctatctaat

SEQ ID NO: 155517 - DNA, 22 bp, Artificial Sequence
  chemically synthesized
gctatctacctatctaatctat

SEQ ID NO: 155518 - DNA, 22 bp, Artificial Sequence
  chemically synthesized
tctacctatctaatctatctct

SEQ ID NO: 155519 - DNA, 22 bp, Artificial Sequence
  chemically synthesized
cctatctaatctatctctgtat

SEQ ID NO: 155520 - DNA, 22 bp, Artificial Sequence
  chemically synthesized
tctaatctatctctgtatatgt

SEQ ID NO: 155521 - DNA, 22 bp, Artificial Sequence
  chemically synthesized
atctatctctgtatatgtcacc

SEQ ID NO: 155522 - DNA, 22 bp, Artificial Sequence
  chemically synthesized
tctctgtatatgtcacctaccc

SEQ ID NO: 155523 - DNA, 22 bp, Artificial Sequence
  chemically synthesized
tgtatatgtcacctaccctggt

SEQ ID NO: 155524 - DNA, 22 bp, Artificial Sequence
  chemically synthesized
tatatgtcacctaccctggtgt

SEQ ID NO: 155525 - DNA, 22 bp, Artificial Sequence
  chemically synthesized
ccctggtgttgcatctcctaat

SEQ ID NO: 155526 - DNA, 22 bp, Artificial Sequence
  chemically synthesized
gtgttgcatctcctaatcttat

SEQ ID NO: 155527 - DNA, 22 bp, Artificial Sequence
  chemically synthesized
catctcctaatcttattttcca

SEQ ID NO: 155528 - DNA, 22 bp, Artificial Sequence
  chemically synthesized
ctaatcttattttccactcaat

SEQ ID NO: 155529 - DNA, 22 bp, Artificial Sequence
  chemically synthesized
atcttattttccactcaatatt

SEQ ID NO: 155530 - DNA, 22 bp, Artificial Sequence
  chemically synthesized
attttccactcaatattaaact

SEQ ID NO: 155531 - DNA, 22 bp, Artificial Sequence
  chemically synthesized
ttttccactcaatattaaactt

SEQ ID NO: 155532 - DNA, 22 bp, Artificial Sequence
  chemically synthesized
tccactcaatattaaacttgct

SEQ ID NO: 155533 - DNA, 22 bp, Artificial Sequence
  chemically synthesized
ccactcaatattaaacttgctt

SEQ ID NO: 155534 - DNA, 22 bp, Artificial Sequence
  chemically synthesized
cactcaatattaaacttgcttc

SEQ ID NO: 155535 - DNA, 22 bp, Artificial Sequence
  chemically synthesized
aatattaaacttgcttctatcc

SEQ ID NO: 155536 - DNA, 22 bp, Artificial Sequence
  chemically synthesized
aacttgcttctatccacatttt

SEQ ID NO: 155537 - DNA, 22 bp, Artificial Sequence
  chemically synthesized
gcttctatccacattttttaga

SEQ ID NO: 155538 - DNA, 22 bp, Artificial Sequence
  chemically synthesized
cttctatccacattttttagaa

SEQ ID NO: 155539 - DNA, 22 bp, Artificial Sequence
  chemically synthesized
ctatccacattttttagaacta

SEQ ID NO: 155540 - DNA, 22 bp, Artificial Sequence
  chemically synthesized
tatccacattttttagaactag

SEQ ID NO: 155541 - DNA, 22 bp, Artificial Sequence
  chemically synthesized
tccacattttttagaactagta

SEQ ID NO: 155542 - DNA, 22 bp, Artificial Sequence
  chemically synthesized
tttagaactagtaattagtaat

SEQ ID NO: 155543 - DNA, 22 bp, Artificial Sequence
  chemically synthesized
ttagaactagtaattagtaata

SEQ ID NO: 155544 - DNA, 22 bp, Artificial Sequence
  chemically synthesized
tagaactagtaattagtaataa

SEQ ID NO: 155545 - DNA, 22 bp, Artificial Sequence
  chemically synthesized
agaactagtaattagtaataac

SEQ ID NO: 155546 - DNA, 22 bp, Artificial Sequence
  chemically synthesized
gaactagtaattagtaataaca

SEQ ID NO: 155547 - DNA, 22 bp, Artificial Sequence
  chemically synthesized
gtaattagtaataacaagtaat

SEQ ID NO: 155548 - DNA, 22 bp, Artificial Sequence
  chemically synthesized
gtaataacaagtaatatattga

SEQ ID NO: 155549 - DNA, 22 bp, Artificial Sequence
  chemically synthesized
aagtaatatagactcctgtttt

SEQ ID NO: 155550 - DNA, 22 bp, Artificial Sequence
  chemically synthesized
ctgttttataatgtgaaaacat

SEQ ID NO: 155551 - DNA, 22 bp, Artificial Sequence
  chemically synthesized
ttttataatgtgaaaacattaa

SEQ ID NO: 155552 - DNA, 22 bp, Artificial Sequence
  chemically synthesized
tataatgtgaaaacattaaatt

SEQ ID NO: 155553 - DNA, 22 bp, Artificial Sequence
  chemically synthesized
ataatgtgaaaacattaaatta

SEQ ID NO: 155554 - DNA, 22 bp, Artificial Sequence
  chemically synthesized
taatgtgaaaacattaaattac

SEQ ID NO: 155555 - DNA, 22 bp, Artificial Sequence
  chemically synthesized
aattacttgctgctgtggtggt

SEQ ID NO: 155556 - DNA, 22 bp, Artificial Sequence
  chemically synthesized
cttgctgctgtggtggtactta

SEQ ID NO: 155557 - DNA, 22 bp, Artificial Sequence
  chemically synthesized
gctgctgtggtggtacttagat

SEQ ID NO: 155558 - DNA, 22 bp, Artificial Sequence
  chemically synthesized
ctgctgtggtggtacttagata

SEQ ID NO: 155559 - DNA, 22 bp, Artificial Sequence
  chemically synthesized
ctgtggtggtacttagatatac

SEQ ID NO: 155560 - DNA, 22 bp, Artificial Sequence
  chemically synthesized
tggtggtacttagatatacaat

SEQ ID NO: 155561 - DNA, 22 bp, Artificial Sequence
  chemically synthesized
agatatacaatgtgtaaactat

SEQ ID NO: 155562 - DNA, 22 bp, Artificial Sequence
  chemically synthesized
gatatacaatgtgtaaactatt

SEQ ID NO: 155563 - DNA, 22 bp, Artificial Sequence
  chemically synthesized
ttaattattgtctcaatttcag

SEQ ID NO: 155564 - DNA, 22 bp, Artificial Sequence
  chemically synthesized
attattgtctcaatttcagagc

SEQ ID NO: 155565 - DNA, 22 bp, Artificial Sequence
  chemically synthesized
ttgtctcaatttcagagcctat

SEQ ID NO: 155566 - DNA, 22 bp, Artificial Sequence
  chemically synthesized
tctcaatttcagagcctattat

SEQ ID NO: 155567 - DNA, 22 bp, Artificial Sequence
  chemically synthesized
aatttcagagcctattatttgt

SEQ ID NO: 155568 - DNA, 22 bp, Artificial Sequence
  chemically synthesized
cagagcctattatttgtctatt

SEQ ID NO: 155569 - DNA, 22 bp, Artificial Sequence
  chemically synthesized
agagcctattatttgtctatta

SEQ ID NO: 155570 - DNA, 22 bp, Artificial Sequence
  chemically synthesized
ttatttgtctattaagagattc

SEQ ID NO: 155571 - DNA, 22 bp, Artificial Sequence
  chemically synthesized
tttgtctattaagagattcaat

SEQ ID NO: 155572 - DNA, 22 bp, Artificial Sequence
  chemically synthesized
gtctattaagagattcaatttc

SEQ ID NO: 155573 - DNA, 22 bp, Artificial Sequence
  chemically synthesized
tctattaagagattcaatttct

SEQ ID NO: 155574 - DNA, 22 bp, Artificial Sequence
  chemically synthesized
ttaagagattcaatttctccct

SEQ ID NO: 155575 - DNA, 22 bp, Artificial Sequence
  chemically synthesized
agagattcaatttctccctggt

SEQ ID NO: 155576 - DNA, 22 bp, Artificial Sequence
  chemically synthesized
aatttctccctggtttagtctt

SEQ ID NO: 155577 - DNA, 22 bp, Artificial Sequence
  chemically synthesized
ctccctggtttagtcttgggag

SEQ ID NO: 155578 - DNA, 22 bp, Artificial Sequence
  chemically synthesized
tccctggtttagtcttgggagg

SEQ ID NO: 155579 - DNA, 22 bp, Artificial Sequence
  chemically synthesized
cctggtttagtcttgggagggt

SEQ ID NO: 155580 - DNA, 22 bp, Artificial Sequence
  chemically synthesized
gtttagtcttgggagggtgtat

SEQ ID NO: 155581 - DNA, 22 bp, Artificial Sequence
  chemically synthesized
agtcttgggagggtgtatgtgt

SEQ ID NO: 155582 - DNA, 22 bp, Artificial Sequence
  chemically synthesized
gtcttgggagggtgtatgtgtc

SEQ ID NO: 155583 - DNA, 22 bp, Artificial Sequence
  chemically synthesized
gggagggtgtatgtgtcgagga

SEQ ID NO: 155584 - DNA, 22 bp, Artificial Sequence
  chemically synthesized
ggagggtgtatgtgtcgaggaa

SEQ ID NO: 155585 - DNA, 22 bp, Artificial Sequence
  chemically synthesized
atccatttctactagattttct

SEQ ID NO: 155586 - DNA, 22 bp, Artificial Sequence
  chemically synthesized
tccatttctactagattttcta

SEQ ID NO: 155587 - DNA, 22 bp, Artificial Sequence
  chemically synthesized
ctactagattttctagtttatt

SEQ ID NO: 155588 - DNA, 22 bp, Artificial Sequence
  chemically synthesized
tactagattttctagtttattt

SEQ ID NO: 155589 - DNA, 22 bp, Artificial Sequence
  chemically synthesized
ctagattttctagtttatttgc

SEQ ID NO: 155590 - DNA, 22 bp, Artificial Sequence
  chemically synthesized
gattttctagtttatttgcgta

SEQ ID NO: 155591 - DNA, 22 bp, Artificial Sequence
  chemically synthesized
tctagtttatttgcgtagaggt

SEQ ID NO: 155592 - DNA, 22 bp, Artificial Sequence
  chemically synthesized
ctagtttatttgcgtagaggtg

SEQ ID NO: 155593 - DNA, 22 bp, Artificial Sequence
  chemically synthesized
tagtttatttgcgtagaggtgt

SEQ ID NO: 155594 - DNA, 22 bp, Artificial Sequence
  chemically synthesized
gtttatttgcgtagaggtgttt

SEQ ID NO: 155595 - DNA, 22 bp, Artificial Sequence
  chemically synthesized
atttgcgtagaggtgtttatag

SEQ ID NO: 155596 - DNA, 22 bp, Artificial Sequence
  chemically synthesized
tttgcgtagaggtgtttatagt

SEQ ID NO: 155597 - DNA, 22 bp, Artificial Sequence
  chemically synthesized
gcgtagaggtgtttatagtatt

SEQ ID NO: 155598 - DNA, 22 bp, Artificial Sequence
  chemically synthesized
cgtagaggtgtttatagtattc

SEQ ID NO: 155599 - DNA, 22 bp, Artificial Sequence
  chemically synthesized
atagtattctctgatggtagtt

SEQ ID NO: 155600 - DNA, 22 bp, Artificial Sequence
  chemically synthesized
tagtattctctgatggtagttt

SEQ ID NO: 155601 - DNA, 22 bp, Artificial Sequence
  chemically synthesized
tctgatggtagtttgtatgtct

SEQ ID NO: 155602 - DNA, 22 bp, Artificial Sequence
  chemically synthesized
tgatggtagtttgtatgtctgt

SEQ ID NO: 155603 - DNA, 22 bp, Artificial Sequence
  chemically synthesized
atggtagtttgtatgtctgtgg

SEQ ID NO: 155604 - DNA, 22 bp, Artificial Sequence
  chemically synthesized
gtatgtctgtgggattggtggt

SEQ ID NO: 155605 - DNA, 22 bp, Artificial Sequence
  chemically synthesized
tatgtctgtgggattggtggtg

SEQ ID NO: 155606 - DNA, 22 bp, Artificial Sequence
  chemically synthesized
tgggattggtggtgatatcccc

SEQ ID NO: 155607 - DNA, 22 bp, Artificial Sequence
  chemically synthesized
gtggtgatatcccctttatcat

SEQ ID NO: 155608 - DNA, 22 bp, Artificial Sequence
  chemically synthesized
tatcatttcttattgcatctat

SEQ ID NO: 155609 - DNA, 22 bp, Artificial Sequence
  chemically synthesized
atcatttcttattgcatctatt

SEQ ID NO: 155610 - DNA, 22 bp, Artificial Sequence
  chemically synthesized
tcatttcttattgcatctattt

SEQ ID NO: 155611 - DNA, 22 bp, Artificial Sequence
  chemically synthesized
cttattgcatctatttgagtct

SEQ ID NO: 155612 - DNA, 22 bp, Artificial Sequence
  chemically synthesized
ttattgcatctatttgagtctt

SEQ ID NO: 155613 - DNA, 22 bp, Artificial Sequence
  chemically synthesized
attgcatctatttgagtcttct

SEQ ID NO: 155614 - DNA, 22 bp, Artificial Sequence
  chemically synthesized
ttgcatctatttgagtcttctc

SEQ ID NO: 155615 - DNA, 22 bp, Artificial Sequence
  chemically synthesized
catctatttgagtcttctctct

SEQ ID NO: 155616 - DNA, 22 bp, Artificial Sequence
  chemically synthesized
tttgagtcttctctcttttctt

SEQ ID NO: 155617 - DNA, 22 bp, Artificial Sequence
  chemically synthesized
gagtcttctctcttttcttctt

SEQ ID NO: 155618 - DNA, 22 bp, Artificial Sequence
  chemically synthesized
agtcttctctcttttcttcttt

SEQ ID NO: 155619 - DNA, 22 bp, Artificial Sequence
  chemically synthesized
ctctcttttcttctttattagt

SEQ ID NO: 155620 - DNA, 22 bp, Artificial Sequence
  chemically synthesized
tctcttttcttctttattagtc

SEQ ID NO: 155621 - DNA, 22 bp, Artificial Sequence
  chemically synthesized
tcttttcttctttattagtctt

SEQ ID NO: 155622 - DNA, 22 bp, Artificial Sequence
  chemically synthesized
ttttcttctttattagtcttgc

SEQ ID NO: 155623 - DNA, 22 bp, Artificial Sequence
  chemically synthesized
ttcttctttattagtcttgcta

SEQ ID NO: 155624 - DNA, 22 bp, Artificial Sequence
  chemically synthesized
tcttctttattagtcttgctag

SEQ ID NO: 155625 - DNA, 22 bp, Artificial Sequence
  chemically synthesized
cttctttattagtcttgctagc

SEQ ID NO: 155626 - DNA, 22 bp, Artificial Sequence
  chemically synthesized
ttctttattagtcttgctagca

SEQ ID NO: 155627 - DNA, 22 bp, Artificial Sequence
  chemically synthesized
ctttattagtcttgctagcagt

SEQ ID NO: 155628 - DNA, 22 bp, Artificial Sequence
  chemically synthesized
tttattagtcttgctagcagtc

SEQ ID NO: 155629 - DNA, 22 bp, Artificial Sequence
  chemically synthesized
tattagtcttgctagcagtcta

SEQ ID NO: 155630 - DNA, 22 bp, Artificial Sequence
  chemically synthesized
attagtcttgctagcagtctat

SEQ ID NO: 155631 - DNA, 22 bp, Artificial Sequence
  chemically synthesized
ttagtcttgctagcagtctatc

SEQ ID NO: 155632 - DNA, 22 bp, Artificial Sequence
  chemically synthesized
gtcttgctagcagtctatcaat

SEQ ID NO: 155633 - DNA, 22 bp, Artificial Sequence
  chemically synthesized
gctagcagtctatcaattttgt

SEQ ID NO: 155634 - DNA, 22 bp, Artificial Sequence
  chemically synthesized
ctagcagtctatcaattttgtt

SEQ ID NO: 155635 - DNA, 22 bp, Artificial Sequence
  chemically synthesized
gcagtctatcaattttgttgat

SEQ ID NO: 155636 - DNA, 22 bp, Artificial Sequence
  chemically synthesized
tcaattttgttgatcttttcaa

SEQ ID NO: 155637 - DNA, 22 bp, Artificial Sequence
  chemically synthesized
tgttgatcttttcaaaaaacca

SEQ ID NO: 155638 - DNA, 22 bp, Artificial Sequence
  chemically synthesized
gttgatcttttcaaaaaaccag

SEQ ID NO: 155639 - DNA, 22 bp, Artificial Sequence
  chemically synthesized
ttgatcttttcaaaaaaccagc

SEQ ID NO: 155640 - DNA, 22 bp, Artificial Sequence
  chemically synthesized
atcttttcaaaaaaccagctcc

SEQ ID NO: 155641 - DNA, 22 bp, Artificial Sequence
  chemically synthesized
ttcaaaaaaccagctcctggat

SEQ ID NO: 155642 - DNA, 22 bp, Artificial Sequence
  chemically synthesized
tcaaaaaaccagctcctggatt

SEQ ID NO: 155643 - DNA, 22 bp, Artificial Sequence
  chemically synthesized
caaaaaaccagctcctggattc

SEQ ID NO: 155644 - DNA, 22 bp, Artificial Sequence
  chemically synthesized
aaaaaaccagctcctggattca

SEQ ID NO: 155645 - DNA, 22 bp, Artificial Sequence
  chemically synthesized
ctggattcattgatttttttaa

SEQ ID NO: 155646 - DNA, 22 bp, Artificial Sequence
  chemically synthesized
gattcattgatttttttaaggg

SEQ ID NO: 155647 - DNA, 22 bp, Artificial Sequence
  chemically synthesized
attgatttttttaagggttttt

SEQ ID NO: 155648 - DNA, 22 bp, Artificial Sequence
  chemically synthesized
atttttttaagggttttttgtg

SEQ ID NO: 155649 - DNA, 22 bp, Artificial Sequence
  chemically synthesized
ttttaagggttttttgtgtctc

SEQ ID NO: 155650 - DNA, 22 bp, Artificial Sequence
  chemically synthesized
tttaagggttttttgtgtctca

SEQ ID NO: 155651 - DNA, 22 bp, Artificial Sequence
  chemically synthesized
ttaagggttttttgtgtctcaa

SEQ ID NO: 155652 - DNA, 22 bp, Artificial Sequence
  chemically synthesized
taagggttttttgtgtctcaat

SEQ ID NO: 155653 - DNA, 22 bp, Artificial Sequence
  chemically synthesized
aagggttttttgtgtctcaatc

SEQ ID NO: 155654 - DNA, 22 bp, Artificial Sequence
  chemically synthesized
agggttttttgtgtctcaatct

SEQ ID NO: 155655 - DNA, 22 bp, Artificial Sequence
  chemically synthesized
tttgtgtctcaatctccttcac

SEQ ID NO: 155656 - DNA, 22 bp, Artificial Sequence
  chemically synthesized
ttgtgtctcaatctccttcact

SEQ ID NO: 155657 - DNA, 22 bp, Artificial Sequence
  chemically synthesized
tgtgtctcaatctccttcactt

SEQ ID NO: 155658 - DNA, 22 bp, Artificial Sequence
  chemically synthesized
gtgtctcaatctccttcacttc

SEQ ID NO: 155659 - DNA, 22 bp, Artificial Sequence
  chemically synthesized
tgtctcaatctccttcacttct

SEQ ID NO: 155660 - DNA, 22 bp, Artificial Sequence
  chemically synthesized
aatctccttcacttctgctctg

SEQ ID NO: 155661 - DNA, 22 bp, Artificial Sequence
  chemically synthesized
cttcacttctgctctgatctta

SEQ ID NO: 155662 - DNA, 22 bp, Artificial Sequence
  chemically synthesized
cacttctgctctgatcttactt

SEQ ID NO: 155663 - DNA, 22 bp, Artificial Sequence
  chemically synthesized
acttctgctctgatcttactta

SEQ ID NO: 155664 - DNA, 22 bp, Artificial Sequence
  chemically synthesized
ctgctctgatcttacttatttc

SEQ ID NO: 155665 - DNA, 22 bp, Artificial Sequence
  chemically synthesized
tgctctgatcttacttatttct

SEQ ID NO: 155666 - DNA, 22 bp, Artificial Sequence
  chemically synthesized
ctctgatcttacttatttcttg

SEQ ID NO: 155667 - DNA, 22 bp, Artificial Sequence
  chemically synthesized
tgatcttacttatttcttgcct

SEQ ID NO: 155668 - DNA, 22 bp, Artificial Sequence
  chemically synthesized
atcttacttatttcttgccttc

SEQ ID NO: 155669 - DNA, 22 bp, Artificial Sequence
  chemically synthesized
acttatttcttgccttccgcta

SEQ ID NO: 155670 - DNA, 22 bp, Artificial Sequence
  chemically synthesized
cttatttcttgccttccgctag

SEQ ID NO: 155671 - DNA, 22 bp, Artificial Sequence
  chemically synthesized
atttcttgccttccgctagctt

SEQ ID NO: 155672 - DNA, 22 bp, Artificial Sequence
  chemically synthesized
tttcttgccttccgctagcttt

SEQ ID NO: 155673 - DNA, 22 bp, Artificial Sequence
  chemically synthesized
cttgccttccgctagcttttga

SEQ ID NO: 155674 - DNA, 22 bp, Artificial Sequence
  chemically synthesized
ttgccttccgctagcttttgaa

SEQ ID NO: 155675 - DNA, 22 bp, Artificial Sequence
  chemically synthesized
gccttccgctagcttttgaaag

SEQ ID NO: 155676 - DNA, 22 bp, Artificial Sequence
  chemically synthesized
ccttccgctagcttttgaaagt

SEQ ID NO: 155677 - DNA, 22 bp, Artificial Sequence
  chemically synthesized
ccgctagcttttgaaagtgttt

SEQ ID NO: 155678 - DNA, 22 bp, Artificial Sequence
  chemically synthesized
cgctagcttttgaaagtgtttg

SEQ ID NO: 155679 - DNA, 22 bp, Artificial Sequence
  chemically synthesized
gcttttgaaagtgtttgctctt

SEQ ID NO: 155680 - DNA, 22 bp, Artificial Sequence
  chemically synthesized
ttgaaagtgtttgctcttgctt

SEQ ID NO: 155681 - DNA, 22 bp, Artificial Sequence
  chemically synthesized
tgaaagtgtttgctcttgcttc

SEQ ID NO: 155682 - DNA, 22 bp, Artificial Sequence
  chemically synthesized
gaaagtgtttgctcttgcttct

SEQ ID NO: 155683 - DNA, 22 bp, Artificial Sequence
  chemically synthesized
aaagtgtttgctcttgcttctc

SEQ ID NO: 155684 - DNA, 22 bp, Artificial Sequence
  chemically synthesized
gctcttgcttctctagttcttt

SEQ ID NO: 155685 - DNA, 22 bp, Artificial Sequence
  chemically synthesized
ctcttgcttctctagttctttt

SEQ ID NO: 155686 - DNA, 22 bp, Artificial Sequence
  chemically synthesized
ttgcttctctagttcttttaat

SEQ ID NO: 155687 - DNA, 22 bp, Artificial Sequence
  chemically synthesized
gcttctctagttcttttaattg

SEQ ID NO: 155688 - DNA, 22 bp, Artificial Sequence
  chemically synthesized
cttctctagttcttttaattgt

SEQ ID NO: 155689 - DNA, 22 bp, Artificial Sequence
  chemically synthesized
ctctagttcttttaattgtgat

SEQ ID NO: 155690 - DNA, 22 bp, Artificial Sequence
  chemically synthesized
tctagttcttttaattgtgatg

SEQ ID NO: 155691 - DNA, 22 bp, Artificial Sequence
  chemically synthesized
tagttcttttaattgtgatgtt

SEQ ID NO: 155692 - DNA, 22 bp, Artificial Sequence
  chemically synthesized
gttcttttaattgtgatgttag

SEQ ID NO: 155693 - DNA, 22 bp, Artificial Sequence
  chemically synthesized
ttttaattgtgatgttagggtg

SEQ ID NO: 155694 - DNA, 22 bp, Artificial Sequence
  chemically synthesized
ttaattgtgatgttagggtgtc

SEQ ID NO: 155695 - DNA, 22 bp, Artificial Sequence
  chemically synthesized
taattgtgatgttagggtgtca

SEQ ID NO: 155696 - DNA, 22 bp, Artificial Sequence
  chemically synthesized
aattgtgatgttagggtgtcaa

SEQ ID NO: 155697 - DNA, 22 bp, Artificial Sequence
  chemically synthesized
attgtgatgttagggtgtcaat

SEQ ID NO: 155698 - DNA, 22 bp, Artificial Sequence
  chemically synthesized
tgatgttagggtgtcaatttta

SEQ ID NO: 155699 - DNA, 22 bp, Artificial Sequence
  chemically synthesized
gggtgtcaattttagatctttc

SEQ ID NO: 155700 - DNA, 22 bp, Artificial Sequence
  chemically synthesized
tagatctttcctgctttctttt

SEQ ID NO: 155701 - DNA, 22 bp, Artificial Sequence
  chemically synthesized
agatctttcctgctttcttttg

SEQ ID NO: 155702 - DNA, 22 bp, Artificial Sequence
  chemically synthesized
gatctttcctgctttcttttgt

SEQ ID NO: 155703 - DNA, 22 bp, Artificial Sequence
  chemically synthesized
tcctgctttcttttgtgggcat

SEQ ID NO: 155704 - DNA, 22 bp, Artificial Sequence
  chemically synthesized
cctgctttcttttgtgggcatt

SEQ ID NO: 155705 - DNA, 22 bp, Artificial Sequence
  chemically synthesized
ctgctttcttttgtgggcattt

SEQ ID NO: 155706 - DNA, 22 bp, Artificial Sequence
  chemically synthesized
ctttcttttgtgggcatttagt

SEQ ID NO: 155707 - DNA, 22 bp, Artificial Sequence
  chemically synthesized
tcttttgtgggcatttagtgct

SEQ ID NO: 155708 - DNA, 22 bp, Artificial Sequence
  chemically synthesized
cttttgtgggcatttagtgcta

SEQ ID NO: 155709 - DNA, 22 bp, Artificial Sequence
  chemically synthesized
ttttgtgggcatttagtgctat

SEQ ID NO: 155710 - DNA, 22 bp, Artificial Sequence
  chemically synthesized
ttgtgggcatttagtgctataa

SEQ ID NO: 155711 - DNA, 22 bp, Artificial Sequence
  chemically synthesized
tgtgggcatttagtgctataaa

SEQ ID NO: 155712 - DNA, 22 bp, Artificial Sequence
  chemically synthesized
gtgggcatttagtgctataaat

SEQ ID NO: 155713 - DNA, 22 bp, Artificial Sequence
  chemically synthesized
tgggcatttagtgctataaatt

SEQ ID NO: 155714 - DNA, 22 bp, Artificial Sequence
  chemically synthesized
agtgctataaatttccctctac

SEQ ID NO: 155715 - DNA, 22 bp, Artificial Sequence
  chemically synthesized
gtgctataaatttccctctaca

SEQ ID NO: 155716 - DNA, 22 bp, Artificial Sequence
  chemically synthesized
taaatttccctctacacactgc

SEQ ID NO: 155717 - DNA, 22 bp, Artificial Sequence
  chemically synthesized
ccctctacacactgctttaaat

SEQ ID NO: 155718 - DNA, 22 bp, Artificial Sequence
  chemically synthesized
cctctacacactgctttaaatg

SEQ ID NO: 155719 - DNA, 22 bp, Artificial Sequence
  chemically synthesized
tacacactgctttaaatgtgtc

SEQ ID NO: 155720 - DNA, 22 bp, Artificial Sequence
  chemically synthesized
cacactgctttaaatgtgtccc

SEQ ID NO: 155721 - DNA, 22 bp, Artificial Sequence
  chemically synthesized
ctttaaatgtgtcccagagatt

SEQ ID NO: 155722 - DNA, 22 bp, Artificial Sequence
  chemically synthesized
taaatgtgtcccagagattctg

SEQ ID NO: 155723 - DNA, 22 bp, Artificial Sequence
  chemically synthesized
aaatgtgtcccagagattctgt

SEQ ID NO: 155724 - DNA, 22 bp, Artificial Sequence
  chemically synthesized
aatgtgtcccagagattctgtt

SEQ ID NO: 155725 - DNA, 22 bp, Artificial Sequence
  chemically synthesized
tgttttgttgtatctttattct

SEQ ID NO: 155726 - DNA, 22 bp, Artificial Sequence
  chemically synthesized
ttttgttgtatctttattctcg

SEQ ID NO: 155727 - DNA, 22 bp, Artificial Sequence
  chemically synthesized
tgttgtatctttattctcgttg

SEQ ID NO: 155728 - DNA, 22 bp, Artificial Sequence
  chemically synthesized
gttgtatctttattctcgttgg

SEQ ID NO: 155729 - DNA, 22 bp, Artificial Sequence
  chemically synthesized
ttgtatctttattctcgttggt

SEQ ID NO: 155730 - DNA, 22 bp, Artificial Sequence
  chemically synthesized
tatctttattctcgttggtttc

SEQ ID NO: 155731 - DNA, 22 bp, Artificial Sequence
  chemically synthesized
tattctcgttggtttcaaagaa

SEQ ID NO: 155732 - DNA, 22 bp, Artificial Sequence
  chemically synthesized
attctcgttggtttcaaagaac

SEQ ID NO: 155733 - DNA, 22 bp, Artificial Sequence
  chemically synthesized
ttctcgttggtttcaaagaaca

SEQ ID NO: 155734 - DNA, 22 bp, Artificial Sequence
  chemically synthesized
tcgttggtttcaaagaacatct

SEQ ID NO: 155735 - DNA, 22 bp, Artificial Sequence
  chemically synthesized
gttggtttcaaagaacatcttt

SEQ ID NO: 155736 - DNA, 22 bp, Artificial Sequence
  chemically synthesized
gtttcaaagaacatctttattt

SEQ ID NO: 155737 - DNA, 22 bp, Artificial Sequence
  chemically synthesized
caaagaacatctttatttctgc

SEQ ID NO: 155738 - DNA, 22 bp, Artificial Sequence
  chemically synthesized
aaagaacatctttatttctgcc

SEQ ID NO: 155739 - DNA, 22 bp, Artificial Sequence
  chemically synthesized
tatttctgccttcattttgtta

SEQ ID NO: 155740 - DNA, 22 bp, Artificial Sequence
  chemically synthesized
atttctgccttcattttgttat

SEQ ID NO: 155741 - DNA, 22 bp, Artificial Sequence
  chemically synthesized
tttctgccttcattttgttatg

SEQ ID NO: 155742 - DNA, 22 bp, Artificial Sequence
  chemically synthesized
ctgccttcattttgttatgtac

SEQ ID NO: 155743 - DNA, 22 bp, Artificial Sequence
  chemically synthesized
tgccttcattttgttatgtacc

SEQ ID NO: 155744 - DNA, 22 bp, Artificial Sequence
  chemically synthesized
ccttcattttgttatgtaccca

SEQ ID NO: 155745 - DNA, 22 bp, Artificial Sequence
  chemically synthesized
cattttgttatgtacccagtag

SEQ ID NO: 155746 - DNA, 22 bp, Artificial Sequence
  chemically synthesized
attttgttatgtacccagtagt

SEQ ID NO: 155747 - DNA, 22 bp, Artificial Sequence
  chemically synthesized
tgttatgtacccagtagtcatt

SEQ ID NO: 155748 - DNA, 22 bp, Artificial Sequence
  chemically synthesized
gttatgtacccagtagtcattc

SEQ ID NO: 155749 - DNA, 22 bp, Artificial Sequence
  chemically synthesized
ttatgtacccagtagtcattca

SEQ ID NO: 155750 - DNA, 22 bp, Artificial Sequence
  chemically synthesized
tgtacccagtagtcattcagga

SEQ ID NO: 155751 - DNA, 22 bp, Artificial Sequence
  chemically synthesized
aggagcaggctgttcagtttcc

SEQ ID NO: 155752 - DNA, 22 bp, Artificial Sequence
  chemically synthesized
ttcagtttccatgtagttgagt

SEQ ID NO: 155753 - DNA, 22 bp, Artificial Sequence
  chemically synthesized
agtttccatgtagttgagtggt

SEQ ID NO: 155754 - DNA, 22 bp, Artificial Sequence
  chemically synthesized
ccatgtagttgagtggttttga

SEQ ID NO: 155755 - DNA, 22 bp, Artificial Sequence
  chemically synthesized
catgtagttgagtggttttgag

SEQ ID NO: 155756 - DNA, 22 bp, Artificial Sequence
  chemically synthesized
agtggttttgagtgagtttctt

SEQ ID NO: 155757 - DNA, 22 bp, Artificial Sequence
  chemically synthesized
tgagtgagtttcttaatcctga

SEQ ID NO: 155758 - DNA, 22 bp, Artificial Sequence
  chemically synthesized
gagtgagtttcttaatcctgag

SEQ ID NO: 155759 - DNA, 22 bp, Artificial Sequence
  chemically synthesized
agtgagtttcttaatcctgagt

SEQ ID NO: 155760 - DNA, 22 bp, Artificial Sequence
  chemically synthesized
cttaatcctgagttctagtttg

SEQ ID NO: 155761 - DNA, 22 bp, Artificial Sequence
  chemically synthesized
ttaatcctgagttctagtttga

SEQ ID NO: 155762 - DNA, 22 bp, Artificial Sequence
  chemically synthesized
aatcctgagttctagtttgatt

SEQ ID NO: 155763 - DNA, 22 bp, Artificial Sequence
  chemically synthesized
atcctgagttctagtttgattg

SEQ ID NO: 155764 - DNA, 22 bp, Artificial Sequence
  chemically synthesized
agttctagtttgattgcactgt

SEQ ID NO: 155765 - DNA, 22 bp, Artificial Sequence
  chemically synthesized
tagtttgattgcactgtggtct

SEQ ID NO: 155766 - DNA, 22 bp, Artificial Sequence
  chemically synthesized
gtttgattgcactgtggtctga

SEQ ID NO: 155767 - DNA, 22 bp, Artificial Sequence
  chemically synthesized
gattgcactgtggtctgagaga

SEQ ID NO: 155768 - DNA, 22 bp, Artificial Sequence
  chemically synthesized
attgcactgtggtctgagagac

SEQ ID NO: 155769 - DNA, 22 bp, Artificial Sequence
  chemically synthesized
cactgtggtctgagagacagtt

SEQ ID NO: 155770 - DNA, 22 bp, Artificial Sequence
  chemically synthesized
tggtctgagagacagtttgtta

SEQ ID NO: 155771 - DNA, 22 bp, Artificial Sequence
  chemically synthesized
agagacagtttgttattgtttc

SEQ ID NO: 155772 - DNA, 22 bp, Artificial Sequence
  chemically synthesized
gttattgtttctgttcttttac

SEQ ID NO: 155773 - DNA, 22 bp, Artificial Sequence
  chemically synthesized
ttattgtttctgttcttttacg

SEQ ID NO: 155774 - DNA, 22 bp, Artificial Sequence
  chemically synthesized
ttgtttctgttcttttacgttt

SEQ ID NO: 155775 - DNA, 22 bp, Artificial Sequence
  chemically synthesized
tttctgttcttttacgtttgct

SEQ ID NO: 155776 - DNA, 22 bp, Artificial Sequence
  chemically synthesized
ctgttcttttacgtttgctgag

SEQ ID NO: 155777 - DNA, 22 bp, Artificial Sequence
  chemically synthesized
tgttcttttacgtttgctgagg

SEQ ID NO: 155778 - DNA, 22 bp, Artificial Sequence
  chemically synthesized
ttcttttacgtttgctgaggag

SEQ ID NO: 155779 - DNA, 22 bp, Artificial Sequence
  chemically synthesized
ttttacgtttgctgaggagtgc

SEQ ID NO: 155780 - DNA, 22 bp, Artificial Sequence
  chemically synthesized
ttacgtttgctgaggagtgctt

SEQ ID NO: 155781 - DNA, 22 bp, Artificial Sequence
  chemically synthesized
tacgtttgctgaggagtgcttc

SEQ ID NO: 155782 - DNA, 22 bp, Artificial Sequence
  chemically synthesized
acgtttgctgaggagtgcttca

SEQ ID NO: 155783 - DNA, 22 bp, Artificial Sequence
  chemically synthesized
cgtttgctgaggagtgcttcac

SEQ ID NO: 155784 - DNA, 22 bp, Artificial Sequence
  chemically synthesized
gctgaggagtgcttcacttcca

SEQ ID NO: 155785 - DNA, 22 bp, Artificial Sequence
  chemically synthesized
ctgaggagtgcttcacttccaa

SEQ ID NO: 155786 - DNA, 22 bp, Artificial Sequence
  chemically synthesized
aggagtgcttcacttccaacta

SEQ ID NO: 155787 - DNA, 22 bp, Artificial Sequence
  chemically synthesized
cacttccaactatgtggtcaac

SEQ ID NO: 155788 - DNA, 22 bp, Artificial Sequence
  chemically synthesized
acttccaactatgtggtcaact

SEQ ID NO: 155789 - DNA, 22 bp, Artificial Sequence
  chemically synthesized
ccaactatgtggtcaactggaa

SEQ ID NO: 155790 - DNA, 22 bp, Artificial Sequence
  chemically synthesized
caactatgtggtcaactggaat

SEQ ID NO: 155791 - DNA, 22 bp, Artificial Sequence
  chemically synthesized
tgtggtcaactggaataggtgt

SEQ ID NO: 155792 - DNA, 22 bp, Artificial Sequence
  chemically synthesized
gaataggtgtggtgtggtgctg

SEQ ID NO: 155793 - DNA, 22 bp, Artificial Sequence
  chemically synthesized
agaagaatgtatattctattga

SEQ ID NO: 155794 - DNA, 22 bp, Artificial Sequence
  chemically synthesized
tattgatttgggatggagagtt

SEQ ID NO: 155795 - DNA, 22 bp, Artificial Sequence
  chemically synthesized
ttgatttgggatggagagttct

SEQ ID NO: 155796 - DNA, 22 bp, Artificial Sequence
  chemically synthesized
atttgggatggagagttctgta

SEQ ID NO: 155797 - DNA, 22 bp, Artificial Sequence
  chemically synthesized
gggatggagagttctgtagatg

SEQ ID NO: 155798 - DNA, 22 bp, Artificial Sequence
  chemically synthesized
ggatggagagttctgtagatgt

SEQ ID NO: 155799 - DNA, 22 bp, Artificial Sequence
  chemically synthesized
tgtagatgtctattaggtctgc

SEQ ID NO: 155800 - DNA, 22 bp, Artificial Sequence
  chemically synthesized
tagatgtctattaggtctgctt

SEQ ID NO: 155801 - DNA, 22 bp, Artificial Sequence
  chemically synthesized
ttaggtctgcttggtgcagagc

SEQ ID NO: 155802 - DNA, 22 bp, Artificial Sequence
  chemically synthesized
ggtctgcttggtgcagagctga

SEQ ID NO: 155803 - DNA, 22 bp, Artificial Sequence
  chemically synthesized
cttggtgcagagctgaattcaa

SEQ ID NO: 155804 - DNA, 22 bp, Artificial Sequence
  chemically synthesized
ggtgcagagctgaattcaattc

SEQ ID NO: 155805 - DNA, 22 bp, Artificial Sequence
  chemically synthesized
gtgcagagctgaattcaattcc

SEQ ID NO: 155806 - DNA, 22 bp, Artificial Sequence
  chemically synthesized
aattcaattcctggatatcctt

SEQ ID NO: 155807 - DNA, 22 bp, Artificial Sequence
  chemically synthesized
aattcctggatatccttgttaa

SEQ ID NO: 155808 - DNA, 22 bp, Artificial Sequence
  chemically synthesized
ctggatatccttgttaactttc

SEQ ID NO: 155809 - DNA, 22 bp, Artificial Sequence
  chemically synthesized
gatatccttgttaactttctgt

SEQ ID NO: 155810 - DNA, 22 bp, Artificial Sequence
  chemically synthesized
gttaactttctgtctcgttgat

SEQ ID NO: 155811 - DNA, 22 bp, Artificial Sequence
  chemically synthesized
ttaactttctgtctcgttgatc

SEQ ID NO: 155812 - DNA, 22 bp, Artificial Sequence
  chemically synthesized
actttctgtctcgttgatctgt

SEQ ID NO: 155813 - DNA, 22 bp, Artificial Sequence
  chemically synthesized
tctgtctcgttgatctgtctaa

SEQ ID NO: 155814 - DNA, 22 bp, Artificial Sequence
  chemically synthesized
ctgtctcgttgatctgtctaat

SEQ ID NO: 155815 - DNA, 22 bp, Artificial Sequence
  chemically synthesized
tgtctcgttgatctgtctaatg

SEQ ID NO: 155816 - DNA, 22 bp, Artificial Sequence
  chemically synthesized
tctcgttgatctgtctaatgtt

SEQ ID NO: 155817 - DNA, 22 bp, Artificial Sequence
  chemically synthesized
gttgatctgtctaatgttgaca

SEQ ID NO: 155818 - DNA, 22 bp, Artificial Sequence
  chemically synthesized
atctgtctaatgttgacagtgg

SEQ ID NO: 155819 - DNA, 22 bp, Artificial Sequence
  chemically synthesized
tctaatgttgacagtggggtgt

SEQ ID NO: 155820 - DNA, 22 bp, Artificial Sequence
  chemically synthesized
atgttgacagtggggtgttaaa

SEQ ID NO: 155821 - DNA, 22 bp, Artificial Sequence
  chemically synthesized
acagtggggtgttaaagtctcc

SEQ ID NO: 155822 - DNA, 22 bp, Artificial Sequence
  chemically synthesized
aagtctcccattattattgtgt

SEQ ID NO: 155823 - DNA, 22 bp, Artificial Sequence
  chemically synthesized
ccattattattgtgtgggagtc

SEQ ID NO: 155824 - DNA, 22 bp, Artificial Sequence
  chemically synthesized
ttattgtgtgggagtctaagtc

SEQ ID NO: 155825 - DNA, 22 bp, Artificial Sequence
  chemically synthesized
ttgtgtgggagtctaagtctct

SEQ ID NO: 155826 - DNA, 22 bp, Artificial Sequence
  chemically synthesized
tgtgggagtctaagtctctttg

SEQ ID NO: 155827 - DNA, 22 bp, Artificial Sequence
  chemically synthesized
agtctctttgtaggtctctaag

SEQ ID NO: 155828 - DNA, 22 bp, Artificial Sequence
  chemically synthesized
tttgtaggtctctaaggacttg

SEQ ID NO: 155829 - DNA, 22 bp, Artificial Sequence
  chemically synthesized
tgtaggtctctaaggacttgct

SEQ ID NO: 155830 - DNA, 22 bp, Artificial Sequence
  chemically synthesized
gtaggtctctaaggacttgctt

SEQ ID NO: 155831 - DNA, 22 bp, Artificial Sequence
  chemically synthesized
taggtctctaaggacttgcttt

SEQ ID NO: 155832 - DNA, 22 bp, Artificial Sequence
  chemically synthesized
taaggacttgctttatgaatct

SEQ ID NO: 155833 - DNA, 22 bp, Artificial Sequence
  chemically synthesized
aggacttgctttatgaatctgg

SEQ ID NO: 155834 - DNA, 22 bp, Artificial Sequence
  chemically synthesized
gctttatgaatctgggtgctgc

SEQ ID NO: 155835 - DNA, 22 bp, Artificial Sequence
  chemically synthesized
ctttatgaatctgggtgctgct

SEQ ID NO: 155836 - DNA, 22 bp, Artificial Sequence
  chemically synthesized
tatgaatctgggtgctgctgta

SEQ ID NO: 155837 - DNA, 22 bp, Artificial Sequence
  chemically synthesized
atgaatctgggtgctgctgtat

SEQ ID NO: 155838 - DNA, 22 bp, Artificial Sequence
  chemically synthesized
tgaatctgggtgctgctgtatt

SEQ ID NO: 155839 - DNA, 22 bp, Artificial Sequence
  chemically synthesized
ggtgctgctgtattgggtgcat

SEQ ID NO: 155840 - DNA, 22 bp, Artificial Sequence
  chemically synthesized
ctgtattgggtgcatatatatt

SEQ ID NO: 155841 - DNA, 22 bp, Artificial Sequence
  chemically synthesized
tattgggtgcatatatatttag

SEQ ID NO: 155842 - DNA, 22 bp, Artificial Sequence
  chemically synthesized
ggtgcatatatatttaggatag

SEQ ID NO: 155843 - DNA, 22 bp, Artificial Sequence
  chemically synthesized
aggatagttagctcttcttgtt

SEQ ID NO: 155844 - DNA, 22 bp, Artificial Sequence
  chemically synthesized
ggatagttagctcttcttgttg

SEQ ID NO: 155845 - DNA, 22 bp, Artificial Sequence
  chemically synthesized
gctcttcttgttgaattgatcc

SEQ ID NO: 155846 - DNA, 22 bp, Artificial Sequence
  chemically synthesized
ttcttgttgaattgatcccttt

SEQ ID NO: 155847 - DNA, 22 bp, Artificial Sequence
  chemically synthesized
cttgttgaattgatccctttac

SEQ ID NO: 155848 - DNA, 22 bp, Artificial Sequence
  chemically synthesized
ttgttgaattgatccctttacc

SEQ ID NO: 155849 - DNA, 22 bp, Artificial Sequence
  chemically synthesized
gttgaattgatccctttaccag

SEQ ID NO: 155850 - DNA, 22 bp, Artificial Sequence
  chemically synthesized
ttgaattgatccctttaccagt

SEQ ID NO: 155851 - DNA, 22 bp, Artificial Sequence
  chemically synthesized
aattgatccctttaccagtatg

SEQ ID NO: 155852 - DNA, 22 bp, Artificial Sequence
  chemically synthesized
atccctttaccagtatgtaatg

SEQ ID NO: 155853 - DNA, 22 bp, Artificial Sequence
  chemically synthesized
taccagtatgtaatggccttct

SEQ ID NO: 155854 - DNA, 22 bp, Artificial Sequence
  chemically synthesized
accagtatgtaatggccttctt

SEQ ID NO: 155855 - DNA, 22 bp, Artificial Sequence
  chemically synthesized
ccagtatgtaatggccttcttt

SEQ ID NO: 155856 - DNA, 22 bp, Artificial Sequence
  chemically synthesized
ctttgtctcttttgatctttgt

SEQ ID NO: 155857 - DNA, 22 bp, Artificial Sequence
  chemically synthesized
tttgtctcttttgatctttgtt

SEQ ID NO: 155858 - DNA, 22 bp, Artificial Sequence
  chemically synthesized
tgtctcttttgatctttgttgg

SEQ ID NO: 155859 - DNA, 22 bp, Artificial Sequence
  chemically synthesized
gtctcttttgatctttgttggt

SEQ ID NO: 155860 - DNA, 22 bp, Artificial Sequence
  chemically synthesized
tctcttttgatctttgttggtt

SEQ ID NO: 155861 - DNA, 22 bp, Artificial Sequence
  chemically synthesized
ttttgatctttgttggtttaaa

SEQ ID NO: 155862 - DNA, 22 bp, Artificial Sequence
  chemically synthesized
ttgatctttgttggtttaaagt

SEQ ID NO: 155863 - DNA, 22 bp, Artificial Sequence
  chemically synthesized
tgatctttgttggtttaaagtc

SEQ ID NO: 155864 - DNA, 22 bp, Artificial Sequence
  chemically synthesized
gatctttgttggtttaaagtct

SEQ ID NO: 155865 - DNA, 22 bp, Artificial Sequence
  chemically synthesized
atctttgttggtttaaagtctg

SEQ ID NO: 155866 - DNA, 22 bp, Artificial Sequence
  chemically synthesized
tgttggtttaaagtctgtttta

SEQ ID NO: 155867 - DNA, 22 bp, Artificial Sequence
  chemically synthesized
gttggtttaaagtctgttttat

SEQ ID NO: 155868 - DNA, 22 bp, Artificial Sequence
  chemically synthesized
ttggtttaaagtctgttttatc

SEQ ID NO: 155869 - DNA, 22 bp, Artificial Sequence
  chemically synthesized
gtttaaagtctgttttatcaga

SEQ ID NO: 155870 - DNA, 22 bp, Artificial Sequence
  chemically synthesized
aaagtctgttttatcagagact

SEQ ID NO: 155871 - DNA, 22 bp, Artificial Sequence
  chemically synthesized
aagtctgttttatcagagacta

SEQ ID NO: 155872 - DNA, 22 bp, Artificial Sequence
  chemically synthesized
ttttatcagagactaagattgc

SEQ ID NO: 155873 - DNA, 22 bp, Artificial Sequence
  chemically synthesized
tatcagagactaagattgcaaa

SEQ ID NO: 155874 - DNA, 22 bp, Artificial Sequence
  chemically synthesized
atcagagactaagattgcaaac

SEQ ID NO: 155875 - DNA, 22 bp, Artificial Sequence
  chemically synthesized
tcagagactaagattgcaaacc

SEQ ID NO: 155876 - DNA, 22 bp, Artificial Sequence
  chemically synthesized
agattgcaaaccctgccttttt

SEQ ID NO: 155877 - DNA, 22 bp, Artificial Sequence
  chemically synthesized
caaaccctgccttttttttgtt

SEQ ID NO: 155878 - DNA, 22 bp, Artificial Sequence
  chemically synthesized
ccttttttttgttttccatttg

SEQ ID NO: 155879 - DNA, 22 bp, Artificial Sequence
  chemically synthesized
ttttttgttttccatttgcttg

SEQ ID NO: 155880 - DNA, 22 bp, Artificial Sequence
  chemically synthesized
tttttgttttccatttgcttgg

SEQ ID NO: 155881 - DNA, 22 bp, Artificial Sequence
  chemically synthesized
ttttgttttccatttgcttggt

SEQ ID NO: 155882 - DNA, 22 bp, Artificial Sequence
  chemically synthesized
tttgttttccatttgcttggta

SEQ ID NO: 155883 - DNA, 22 bp, Artificial Sequence
  chemically synthesized
ttgttttccatttgcttggtag

SEQ ID NO: 155884 - DNA, 22 bp, Artificial Sequence
  chemically synthesized
tgttttccatttgcttggtaga

SEQ ID NO: 155885 - DNA, 22 bp, Artificial Sequence
  chemically synthesized
gttttccatttgcttggtagat

SEQ ID NO: 155886 - DNA, 22 bp, Artificial Sequence
  chemically synthesized
ttttccatttgcttggtagatc

SEQ ID NO: 155887 - DNA, 22 bp, Artificial Sequence
  chemically synthesized
tccatttgcttggtagatcttc

SEQ ID NO: 155888 - DNA, 22 bp, Artificial Sequence
  chemically synthesized
ccatttgcttggtagatcttcc

SEQ ID NO: 155889 - DNA, 22 bp, Artificial Sequence
  chemically synthesized
catttgcttggtagatcttcct

SEQ ID NO: 155890 - DNA, 22 bp, Artificial Sequence
  chemically synthesized
gcttggtagatcttcctccatc

SEQ ID NO: 155891 - DNA, 22 bp, Artificial Sequence
  chemically synthesized
cttggtagatcttcctccatcc

SEQ ID NO: 155892 - DNA, 22 bp, Artificial Sequence
  chemically synthesized
ggtagatcttcctccatccctt

SEQ ID NO: 155893 - DNA, 22 bp, Artificial Sequence
  chemically synthesized
gtagatcttcctccatcccttt

SEQ ID NO: 155894 - DNA, 22 bp, Artificial Sequence
  chemically synthesized
cctccatccctttattttgagc

SEQ ID NO: 155895 - DNA, 22 bp, Artificial Sequence
  chemically synthesized
ctccatccctttattttgagcc

SEQ ID NO: 155896 - DNA, 22 bp, Artificial Sequence
  chemically synthesized
catccctttattttgagcctat

SEQ ID NO: 155897 - DNA, 22 bp, Artificial Sequence
  chemically synthesized
tattttgagcctatgtgtgtct

SEQ ID NO: 155898 - DNA, 22 bp, Artificial Sequence
  chemically synthesized
attttgagcctatgtgtgtctc

SEQ ID NO: 155899 - DNA, 22 bp, Artificial Sequence
  chemically synthesized
ttttgagcctatgtgtgtctct

SEQ ID NO: 155900 - DNA, 22 bp, Artificial Sequence
  chemically synthesized
tgagcctatgtgtgtctctcca

SEQ ID NO: 155901 - DNA, 22 bp, Artificial Sequence
  chemically synthesized
gagcctatgtgtgtctctccac

SEQ ID NO: 155902 - DNA, 22 bp, Artificial Sequence
  chemically synthesized
agcctatgtgtgtctctccaca

SEQ ID NO: 155903 - DNA, 22 bp, Artificial Sequence
  chemically synthesized
tgtgtgtctctccacatgagat

SEQ ID NO: 155904 - DNA, 22 bp, Artificial Sequence
  chemically synthesized
tccacatgagattggtttcctg

SEQ ID NO: 155905 - DNA, 22 bp, Artificial Sequence
  chemically synthesized
cacatgagattggtttcctgaa

SEQ ID NO: 155906 - DNA, 22 bp, Artificial Sequence
  chemically synthesized
gtttcctgaatacagcacactg

SEQ ID NO: 155907 - DNA, 22 bp, Artificial Sequence
  chemically synthesized
cctgaatacagcacactgatag

SEQ ID NO: 155908 - DNA, 22 bp, Artificial Sequence
  chemically synthesized
ctgaatacagcacactgatagg

SEQ ID NO: 155909 - DNA, 22 bp, Artificial Sequence
  chemically synthesized
aatacagcacactgataggtct

SEQ ID NO: 155910 - DNA, 22 bp, Artificial Sequence
  chemically synthesized
ataggtcttgactctttatcca

SEQ ID NO: 155911 - DNA, 22 bp, Artificial Sequence
  chemically synthesized
gactctttatccaatttgccag

SEQ ID NO: 155912 - DNA, 22 bp, Artificial Sequence
  chemically synthesized
actctttatccaatttgccagt

SEQ ID NO: 155913 - DNA, 22 bp, Artificial Sequence
  chemically synthesized
tttatccaatttgccagtctgt

SEQ ID NO: 155914 - DNA, 22 bp, Artificial Sequence
  chemically synthesized
tatccaatttgccagtctgtgt

SEQ ID NO: 155915 - DNA, 22 bp, Artificial Sequence
  chemically synthesized
atccaatttgccagtctgtgtc

SEQ ID NO: 155916 - DNA, 22 bp, Artificial Sequence
  chemically synthesized
tccaatttgccagtctgtgtct

SEQ ID NO: 155917 - DNA, 22 bp, Artificial Sequence
  chemically synthesized
gccagtctgtgtcttttaattg

SEQ ID NO: 155918 - DNA, 22 bp, Artificial Sequence
  chemically synthesized
ccagtctgtgtcttttaattgg

SEQ ID NO: 155919 - DNA, 22 bp, Artificial Sequence
  chemically synthesized
tgtcttttaattggagcattta

SEQ ID NO: 155920 - DNA, 22 bp, Artificial Sequence
  chemically synthesized
ttaattggagcatttagctcat

SEQ ID NO: 155921 - DNA, 22 bp, Artificial Sequence
  chemically synthesized
taattggagcatttagctcatt

SEQ ID NO: 155922 - DNA, 22 bp, Artificial Sequence
  chemically synthesized
aattggagcatttagctcattt

SEQ ID NO: 155923 - DNA, 22 bp, Artificial Sequence
  chemically synthesized
attggagcatttagctcattta

SEQ ID NO: 155924 - DNA, 22 bp, Artificial Sequence
  chemically synthesized
gagcatttagctcatttacatt

SEQ ID NO: 155925 - DNA, 22 bp, Artificial Sequence
  chemically synthesized
agctcatttacatttaaggtta

SEQ ID NO: 155926 - DNA, 22 bp, Artificial Sequence
  chemically synthesized
gctcatttacatttaaggttaa

SEQ ID NO: 155927 - DNA, 22 bp, Artificial Sequence
  chemically synthesized
atttacatttaaggttaatatt

SEQ ID NO: 155928 - DNA, 22 bp, Artificial Sequence
  chemically synthesized
acatttaaggttaatattgtta

SEQ ID NO: 155929 - DNA, 22 bp, Artificial Sequence
  chemically synthesized
catttaaggttaatattgttat

SEQ ID NO: 155930 - DNA, 22 bp, Artificial Sequence
  chemically synthesized
aaggttaatattgttatgtgag

SEQ ID NO: 155931 - DNA, 22 bp, Artificial Sequence
  chemically synthesized
aggttaatattgttatgtgaga

SEQ ID NO: 155932 - DNA, 22 bp, Artificial Sequence
  chemically synthesized
atattgttatgtgagaatttga

SEQ ID NO: 155933 - DNA, 22 bp, Artificial Sequence
  chemically synthesized
ttatgtgagaatttgatcctgt

SEQ ID NO: 155934 - DNA, 22 bp, Artificial Sequence
  chemically synthesized
tgtgagaatttgatcctgtcat

SEQ ID NO: 155935 - DNA, 22 bp, Artificial Sequence
  chemically synthesized
gatcctgtcattatgatgttag

SEQ ID NO: 155936 - DNA, 22 bp, Artificial Sequence
  chemically synthesized
atcctgtcattatgatgttagc

SEQ ID NO: 155937 - DNA, 22 bp, Artificial Sequence
  chemically synthesized
tcattatgatgttagctggtta

SEQ ID NO: 155938 - DNA, 22 bp, Artificial Sequence
  chemically synthesized
tgatgttagctggttattttgc

SEQ ID NO: 155939 - DNA, 22 bp, Artificial Sequence
  chemically synthesized
gctggttattttgcttgctagt

SEQ ID NO: 155940 - DNA, 22 bp, Artificial Sequence
  chemically synthesized
gttattttgcttgctagttgat

SEQ ID NO: 155941 - DNA, 22 bp, Artificial Sequence
  chemically synthesized
ttttgcttgctagttgatgcag

SEQ ID NO: 155942 - DNA, 22 bp, Artificial Sequence
  chemically synthesized
tgcttgctagttgatgcagttt

SEQ ID NO: 155943 - DNA, 22 bp, Artificial Sequence
  chemically synthesized
gcttgctagttgatgcagtttc

SEQ ID NO: 155944 - DNA, 22 bp, Artificial Sequence
  chemically synthesized
cttgctagttgatgcagtttct

SEQ ID NO: 155945 - DNA, 22 bp, Artificial Sequence
  chemically synthesized
gctagttgatgcagtttctccc

SEQ ID NO: 155946 - DNA, 22 bp, Artificial Sequence
  chemically synthesized
ctagttgatgcagtttctccct

SEQ ID NO: 155947 - DNA, 22 bp, Artificial Sequence
  chemically synthesized
gttgatgcagtttctccctagc

SEQ ID NO: 155948 - DNA, 22 bp, Artificial Sequence
  chemically synthesized
atgcagtttctccctagccttg

SEQ ID NO: 155949 - DNA, 22 bp, Artificial Sequence
  chemically synthesized
ctccctagccttgatggtcttt

SEQ ID NO: 155950 - DNA, 22 bp, Artificial Sequence
  chemically synthesized
tccctagccttgatggtcttta

SEQ ID NO: 155951 - DNA, 22 bp, Artificial Sequence
  chemically synthesized
cctagccttgatggtctttaca

SEQ ID NO: 155952 - DNA, 22 bp, Artificial Sequence
  chemically synthesized
gccttgatggtctttacaattt

SEQ ID NO: 155953 - DNA, 22 bp, Artificial Sequence
  chemically synthesized
gatggtctttacaatttggcat

SEQ ID NO: 155954 - DNA, 22 bp, Artificial Sequence
  chemically synthesized
atggtctttacaatttggcatg

SEQ ID NO: 155955 - DNA, 22 bp, Artificial Sequence
  chemically synthesized
tacaatttggcatgtttttgca

SEQ ID NO: 155956 - DNA, 22 bp, Artificial Sequence
  chemically synthesized
acaatttggcatgtttttgcag

SEQ ID NO: 155957 - DNA, 22 bp, Artificial Sequence
  chemically synthesized
caatttggcatgtttttgcagt

SEQ ID NO: 155958 - DNA, 22 bp, Artificial Sequence
  chemically synthesized
ggcatgtttttgcagtggctgg

SEQ ID NO: 155959 - DNA, 22 bp, Artificial Sequence
  chemically synthesized
gcatgtttttgcagtggctggt

SEQ ID NO: 155960 - DNA, 22 bp, Artificial Sequence
  chemically synthesized
ttgcagtggctggtactggttg

SEQ ID NO: 155961 - DNA, 22 bp, Artificial Sequence
  chemically synthesized
tgcagtggctggtactggttgt

SEQ ID NO: 155962 - DNA, 22 bp, Artificial Sequence
  chemically synthesized
gcagtggctggtactggttgtt

SEQ ID NO: 155963 - DNA, 22 bp, Artificial Sequence
  chemically synthesized
cagtggctggtactggttgttt

SEQ ID NO: 155964 - DNA, 22 bp, Artificial Sequence
  chemically synthesized
gtactggttgtttctttccatg

SEQ ID NO: 155965 - DNA, 22 bp, Artificial Sequence
  chemically synthesized
gttgtttctttccatgtttact

SEQ ID NO: 155966 - DNA, 22 bp, Artificial Sequence
  chemically synthesized
tttctttccatgtttactgctt

SEQ ID NO: 155967 - DNA, 22 bp, Artificial Sequence
  chemically synthesized
ctttccatgtttactgcttcct

SEQ ID NO: 155968 - DNA, 22 bp, Artificial Sequence
  chemically synthesized
tttccatgtttactgcttcctt

SEQ ID NO: 155969 - DNA, 22 bp, Artificial Sequence
  chemically synthesized
tccatgtttactgcttccttca

SEQ ID NO: 155970 - DNA, 22 bp, Artificial Sequence
  chemically synthesized
ccatgtttactgcttccttcag

SEQ ID NO: 155971 - DNA, 22 bp, Artificial Sequence
  chemically synthesized
catgtttactgcttccttcagg

SEQ ID NO: 155972 - DNA, 22 bp, Artificial Sequence
  chemically synthesized
actgcttccttcaggagctctt

SEQ ID NO: 155973 - DNA, 22 bp, Artificial Sequence
  chemically synthesized
ctgcttccttcaggagctcttt

SEQ ID NO: 155974 - DNA, 22 bp, Artificial Sequence
  chemically synthesized
cttccttcaggagctcttttag

SEQ ID NO: 155975 - DNA, 22 bp, Artificial Sequence
  chemically synthesized
ccttcaggagctcttttagggc

SEQ ID NO: 155976 - DNA, 22 bp, Artificial Sequence
  chemically synthesized
cttcaggagctcttttagggca

SEQ ID NO: 155977 - DNA, 22 bp, Artificial Sequence
  chemically synthesized
caggagctcttttagggcaggc

SEQ ID NO: 155978 - DNA, 22 bp, Artificial Sequence
  chemically synthesized
aggagctcttttagggcaggcc

SEQ ID NO: 155979 - DNA, 22 bp, Artificial Sequence
  chemically synthesized
ttttagggcaggcctggtggtg

SEQ ID NO: 155980 - DNA, 22 bp, Artificial Sequence
  chemically synthesized
ttagggcaggcctggtggtgac

SEQ ID NO: 155981 - DNA, 22 bp, Artificial Sequence
  chemically synthesized
tagggcaggcctggtggtgaca

SEQ ID NO: 155982 - DNA, 22 bp, Artificial Sequence
  chemically synthesized
agggcaggcctggtggtgacaa

SEQ ID NO: 155983 - DNA, 22 bp, Artificial Sequence
  chemically synthesized
gggcaggcctggtggtgacaaa

SEQ ID NO: 155984 - DNA, 22 bp, Artificial Sequence
  chemically synthesized
gtggtgacaaaatcagcaattg

SEQ ID NO: 155985 - DNA, 22 bp, Artificial Sequence
  chemically synthesized
cttgtctgtaaagtattttatt

SEQ ID NO: 155986 - DNA, 22 bp, Artificial Sequence
  chemically synthesized
gtctgtaaagtattttatttct

SEQ ID NO: 155987 - DNA, 22 bp, Artificial Sequence
  chemically synthesized
tctgtaaagtattttatttctc

SEQ ID NO: 155988 - DNA, 22 bp, Artificial Sequence
  chemically synthesized
taaagtattttatttctccttc

SEQ ID NO: 155989 - DNA, 22 bp, Artificial Sequence
  chemically synthesized
tatttctccttcacttatgaag

SEQ ID NO: 155990 - DNA, 22 bp, Artificial Sequence
  chemically synthesized
atttctccttcacttatgaagc

SEQ ID NO: 155991 - DNA, 22 bp, Artificial Sequence
  chemically synthesized
tttctccttcacttatgaagct

SEQ ID NO: 155992 - DNA, 22 bp, Artificial Sequence
  chemically synthesized
ctccttcacttatgaagcttac

SEQ ID NO: 155993 - DNA, 22 bp, Artificial Sequence
  chemically synthesized
tccttcacttatgaagcttacc

SEQ ID NO: 155994 - DNA, 22 bp, Artificial Sequence
  chemically synthesized
cttcacttatgaagcttaccaa

SEQ ID NO: 155995 - DNA, 22 bp, Artificial Sequence
  chemically synthesized
cacttatgaagcttaccaacca

SEQ ID NO: 155996 - DNA, 22 bp, Artificial Sequence
  chemically synthesized
acttatgaagcttaccaaccaa

SEQ ID NO: 155997 - DNA, 22 bp, Artificial Sequence
  chemically synthesized
atgaagcttaccaaccaaaaaa

SEQ ID NO: 155998 - DNA, 22 bp, Artificial Sequence
  chemically synthesized
tgaagcttaccaaccaaaaaaa

SEQ ID NO: 155999 - DNA, 22 bp, Artificial Sequence
  chemically synthesized
accaaccaaaaaaagtccagga

SEQ ID NO: 156000 - DNA, 22 bp, Artificial Sequence
  chemically synthesized
ccaaccaaaaaaagtccaggac

SEQ ID NO: 156001 - DNA, 22 bp, Artificial Sequence
  chemically synthesized
acagccgaattctaccagaggt

SEQ ID NO: 156002 - DNA, 22 bp, Artificial Sequence
  chemically synthesized
taccagaggtacaaggaggagc

SEQ ID NO: 156003 - DNA, 22 bp, Artificial Sequence
  chemically synthesized
ccagaggtacaaggaggagctg

SEQ ID NO: 156004 - DNA, 22 bp, Artificial Sequence
  chemically synthesized
gtaccattccttctgaaactat

SEQ ID NO: 156005 - DNA, 22 bp, Artificial Sequence
  chemically synthesized
cttctgaaactattccaatcaa

SEQ ID NO: 156006 - DNA, 22 bp, Artificial Sequence
  chemically synthesized
ctgaaactattccaatcaatag

SEQ ID NO: 156007 - DNA, 22 bp, Artificial Sequence
  chemically synthesized
tgaaactattccaatcaataga

SEQ ID NO: 156008 - DNA, 22 bp, Artificial Sequence
  chemically synthesized
aaactattccaatcaatagaaa

SEQ ID NO: 156009 - DNA, 22 bp, Artificial Sequence
  chemically synthesized
ttccaatcaatagaaaaagagg

SEQ ID NO: 156010 - DNA, 22 bp, Artificial Sequence
  chemically synthesized
caatcaatagaaaaagagggaa

SEQ ID NO: 156011 - DNA, 22 bp, Artificial Sequence
  chemically synthesized
cctaactcattttatgaggcca

SEQ ID NO: 156012 - DNA, 22 bp, Artificial Sequence
  chemically synthesized
actcattttatgaggccagcat

SEQ ID NO: 156013 - DNA, 22 bp, Artificial Sequence
  chemically synthesized
attttatgaggccagcatcatc

SEQ ID NO: 156014 - DNA, 22 bp, Artificial Sequence
  chemically synthesized
tatgaggccagcatcatcttga

SEQ ID NO: 156015 - DNA, 22 bp, Artificial Sequence
  chemically synthesized
atgaggccagcatcatcttgat

SEQ ID NO: 156016 - DNA, 22 bp, Artificial Sequence
  chemically synthesized
tgaggccagcatcatcttgata

SEQ ID NO: 156017 - DNA, 22 bp, Artificial Sequence
  chemically synthesized
gataccaaagcctagcagacac

SEQ ID NO: 156018 - DNA, 22 bp, Artificial Sequence
  chemically synthesized
ataccaaagcctagcagacaca

SEQ ID NO: 156019 - DNA, 22 bp, Artificial Sequence
  chemically synthesized
gcagacacacaacaaaaaaaga

SEQ ID NO: 156020 - DNA, 22 bp, Artificial Sequence
  chemically synthesized
tacaccaatatccctgatgaac

SEQ ID NO: 156021 - DNA, 22 bp, Artificial Sequence
  chemically synthesized
acaccaatatccctgatgaaca

SEQ ID NO: 156022 - DNA, 22 bp, Artificial Sequence
  chemically synthesized
caccaatatccctgatgaacat

SEQ ID NO: 156023 - DNA, 22 bp, Artificial Sequence
  chemically synthesized
atgaacatcgatgcaaaaatcc

SEQ ID NO: 156024 - DNA, 22 bp, Artificial Sequence
  chemically synthesized
agtaaaatactggcaaaccaaa

SEQ ID NO: 156025 - DNA, 22 bp, Artificial Sequence
  chemically synthesized
gcaaaccaaatccaggagcaca

SEQ ID NO: 156026 - DNA, 22 bp, Artificial Sequence
  chemically synthesized
atccaccatgatcaagtgggct

SEQ ID NO: 156027 - DNA, 22 bp, Artificial Sequence
  chemically synthesized
tccaccatgatcaagtgggctt

SEQ ID NO: 156028 - DNA, 22 bp, Artificial Sequence
  chemically synthesized
catccctgggatgcagggctgg

SEQ ID NO: 156029 - DNA, 22 bp, Artificial Sequence
  chemically synthesized
atccctgggatgcagggctggt

SEQ ID NO: 156030 - DNA, 22 bp, Artificial Sequence
  chemically synthesized
ggatgcagggctggttcaacat

SEQ ID NO: 156031 - DNA, 22 bp, Artificial Sequence
  chemically synthesized
gttcaacatatgcaaatcaata

SEQ ID NO: 156032 - DNA, 22 bp, Artificial Sequence
  chemically synthesized
aacatatgcaaatcaataaaca

SEQ ID NO: 156033 - DNA, 22 bp, Artificial Sequence
  chemically synthesized
tctcaatagatgcagaaaaggc

SEQ ID NO: 156034 - DNA, 22 bp, Artificial Sequence
  chemically synthesized
aatagatgcagaaaaggccttt

SEQ ID NO: 156035 - DNA, 22 bp, Artificial Sequence
  chemically synthesized
tgacaaaattcaacaatgcttc

SEQ ID NO: 156036 - DNA, 22 bp, Artificial Sequence
  chemically synthesized
gacaaaattcaacaatgcttca

SEQ ID NO: 156037 - DNA, 22 bp, Artificial Sequence
  chemically synthesized
acaaaattcaacaatgcttcat

SEQ ID NO: 156038 - DNA, 22 bp, Artificial Sequence
  chemically synthesized
aacaatgcttcatactaaaaac

SEQ ID NO: 156039 - DNA, 22 bp, Artificial Sequence
  chemically synthesized
catactaaaaactctcaataaa

SEQ ID NO: 156040 - DNA, 22 bp, Artificial Sequence
  chemically synthesized
atactaaaaactctcaataaat

SEQ ID NO: 156041 - DNA, 22 bp, Artificial Sequence
  chemically synthesized
aaaactctcaataaattaggta

SEQ ID NO: 156042 - DNA, 22 bp, Artificial Sequence
  chemically synthesized
tcaataaattaggtatcgatgg

SEQ ID NO: 156043 - DNA, 22 bp, Artificial Sequence
  chemically synthesized
aataaattaggtatcgatggga

SEQ ID NO: 156044 - DNA, 22 bp, Artificial Sequence
  chemically synthesized
ggtatcgatgggacatatctca

SEQ ID NO: 156045 - DNA, 22 bp, Artificial Sequence
  chemically synthesized
aaaataataagagctatctatg

SEQ ID NO: 156046 - DNA, 22 bp, Artificial Sequence
  chemically synthesized
tctatgacaaacccacagccaa

SEQ ID NO: 156047 - DNA, 22 bp, Artificial Sequence
  chemically synthesized
tgacaaacccacagccaatatc

SEQ ID NO: 156048 - DNA, 22 bp, Artificial Sequence
  chemically synthesized
aatggacaaaaactggaagcat

SEQ ID NO: 156049 - DNA, 22 bp, Artificial Sequence
  chemically synthesized
gaagcattccctttgaaaactg

SEQ ID NO: 156050 - DNA, 22 bp, Artificial Sequence
  chemically synthesized
cctttgaaaactggcacaagac

SEQ ID NO: 156051 - DNA, 22 bp, Artificial Sequence
  chemically synthesized
tgaaaactggcacaagacaggg

SEQ ID NO: 156052 - DNA, 22 bp, Artificial Sequence
  chemically synthesized
gaaaactggcacaagacaggga

SEQ ID NO: 156053 - DNA, 22 bp, Artificial Sequence
  chemically synthesized
aaaactggcacaagacagggat

SEQ ID NO: 156054 - DNA, 22 bp, Artificial Sequence
  chemically synthesized
gcacaagacagggatgccctct

SEQ ID NO: 156055 - DNA, 22 bp, Artificial Sequence
  chemically synthesized
tctcaccactcctattcaacat

SEQ ID NO: 156056 - DNA, 22 bp, Artificial Sequence
  chemically synthesized
tcaccactcctattcaacatag

SEQ ID NO: 156057 - DNA, 22 bp, Artificial Sequence
  chemically synthesized
accactcctattcaacatagtg

SEQ ID NO: 156058 - DNA, 22 bp, Artificial Sequence
  chemically synthesized
ctattcaacatagtgttggaag

SEQ ID NO: 156059 - DNA, 22 bp, Artificial Sequence
  chemically synthesized
ttcaacatagtgttggaagttc

SEQ ID NO: 156060 - DNA, 22 bp, Artificial Sequence
  chemically synthesized
aacatagtgttggaagttctgg

SEQ ID NO: 156061 - DNA, 22 bp, Artificial Sequence
  chemically synthesized
gaagttctggccagggcaatca

SEQ ID NO: 156062 - DNA, 22 bp, Artificial Sequence
  chemically synthesized
tggccagggcaatcaggcaaga

SEQ ID NO: 156063 - DNA, 22 bp, Artificial Sequence
  chemically synthesized
gccagggcaatcaggcaagaga

SEQ ID NO: 156064 - DNA, 22 bp, Artificial Sequence
  chemically synthesized
aattaggaaaagaggaagtgaa

SEQ ID NO: 156065 - DNA, 22 bp, Artificial Sequence
  chemically synthesized
ggaaaagaggaagtgaaattgt

SEQ ID NO: 156066 - DNA, 22 bp, Artificial Sequence
  chemically synthesized
tccctgtttgcagatgacgtga

SEQ ID NO: 156067 - DNA, 22 bp, Artificial Sequence
  chemically synthesized
tttgcagatgacgtgattgtat

SEQ ID NO: 156068 - DNA, 22 bp, Artificial Sequence
  chemically synthesized
gcagatgacgtgattgtatatc

SEQ ID NO: 156069 - DNA, 22 bp, Artificial Sequence
  chemically synthesized
cagatgacgtgattgtatatct

SEQ ID NO: 156070 - DNA, 22 bp, Artificial Sequence
  chemically synthesized
tatatctagaaaaccccatcgt

SEQ ID NO: 156071 - DNA, 22 bp, Artificial Sequence
  chemically synthesized
gaaaaccccatcgtctcagccc

SEQ ID NO: 156072 - DNA, 22 bp, Artificial Sequence
  chemically synthesized
agcccaaaatctccttaagctg

SEQ ID NO: 156073 - DNA, 22 bp, Artificial Sequence
  chemically synthesized
cttaagctgataagcaacttca

SEQ ID NO: 156074 - DNA, 22 bp, Artificial Sequence
  chemically synthesized
aagctgataagcaacttcagaa

SEQ ID NO: 156075 - DNA, 22 bp, Artificial Sequence
  chemically synthesized
agctgataagcaacttcagaaa

SEQ ID NO: 156076 - DNA, 22 bp, Artificial Sequence
  chemically synthesized
ataagcaacttcagaaaagtct

SEQ ID NO: 156077 - DNA, 22 bp, Artificial Sequence
  chemically synthesized
cagaaaagtctcagcatacaaa

SEQ ID NO: 156078 - DNA, 22 bp, Artificial Sequence
  chemically synthesized
agaaaagtctcagcatacaaaa

SEQ ID NO: 156079 - DNA, 22 bp, Artificial Sequence
  chemically synthesized
agcatacaaaatcaatgtgcaa

SEQ ID NO: 156080 - DNA, 22 bp, Artificial Sequence
  chemically synthesized
ctatacaccaataacagacaaa

SEQ ID NO: 156081 - DNA, 22 bp, Artificial Sequence
  chemically synthesized
tacaccaataacagacaaacag

SEQ ID NO: 156082 - DNA, 22 bp, Artificial Sequence
  chemically synthesized
ccattcacaattgcctcaaaga

SEQ ID NO: 156083 - DNA, 22 bp, Artificial Sequence
  chemically synthesized
acaattgcctcaaagagaataa

SEQ ID NO: 156084 - DNA, 22 bp, Artificial Sequence
  chemically synthesized
cctcaaagagaataaaatacct

SEQ ID NO: 156085 - DNA, 22 bp, Artificial Sequence
  chemically synthesized
aaagagaataaaatacctagga

SEQ ID NO: 156086 - DNA, 22 bp, Artificial Sequence
  chemically synthesized
ggaatccaacttacaagggatg

SEQ ID NO: 156087 - DNA, 22 bp, Artificial Sequence
  chemically synthesized
acaagggatgtgaaggacctct

SEQ ID NO: 156088 - DNA, 22 bp, Artificial Sequence
  chemically synthesized
caagggatgtgaaggacctctt

SEQ ID NO: 156089 - DNA, 22 bp, Artificial Sequence
  chemically synthesized
ttcaaggagaacaacaaaacac

SEQ ID NO: 156090 - DNA, 22 bp, Artificial Sequence
  chemically synthesized
caaggagaacaacaaaacactg

SEQ ID NO: 156091 - DNA, 22 bp, Artificial Sequence
  chemically synthesized
aaggagaacaacaaaacactgc

SEQ ID NO: 156092 - DNA, 22 bp, Artificial Sequence
  chemically synthesized
ctcaacgaaataaaagaggata

SEQ ID NO: 156093 - DNA, 22 bp, Artificial Sequence
  chemically synthesized
aacgaaataaaagaggatacaa

SEQ ID NO: 156094 - DNA, 22 bp, Artificial Sequence
  chemically synthesized
catgctcatggataggaagaat

SEQ ID NO: 156095 - DNA, 22 bp, Artificial Sequence
  chemically synthesized
atggataggaagaatcaatatc

SEQ ID NO: 156096 - DNA, 22 bp, Artificial Sequence
  chemically synthesized
actgcccaaggtaatttataga

SEQ ID NO: 156097 - DNA, 22 bp, Artificial Sequence
  chemically synthesized
ctgcccaaggtaatttatagat

SEQ ID NO: 156098 - DNA, 22 bp, Artificial Sequence
  chemically synthesized
cccaaggtaatttatagattca

SEQ ID NO: 156099 - DNA, 22 bp, Artificial Sequence
  chemically synthesized
atagattcaatgccatccccat

SEQ ID NO: 156100 - DNA, 22 bp, Artificial Sequence
  chemically synthesized
tagattcaatgccatccccatc

SEQ ID NO: 156101 - DNA, 22 bp, Artificial Sequence
  chemically synthesized
aatgccatccccatcaagctac

SEQ ID NO: 156102 - DNA, 22 bp, Artificial Sequence
  chemically synthesized
ccaatgactttcttcacagaat

SEQ ID NO: 156103 - DNA, 22 bp, Artificial Sequence
  chemically synthesized
tcttcacagaattggaaaaaac

SEQ ID NO: 156104 - DNA, 22 bp, Artificial Sequence
  chemically synthesized
cttcacagaattggaaaaaact

SEQ ID NO: 156105 - DNA, 22 bp, Artificial Sequence
  chemically synthesized
ttcacagaattggaaaaaacta

SEQ ID NO: 156106 - DNA, 22 bp, Artificial Sequence
  chemically synthesized
cacagaattggaaaaaactact

SEQ ID NO: 156107 - DNA, 22 bp, Artificial Sequence
  chemically synthesized
acagaattggaaaaaactactt

SEQ ID NO: 156108 - DNA, 22 bp, Artificial Sequence
  chemically synthesized
gaaaaaactactttaaagttca

SEQ ID NO: 156109 - DNA, 22 bp, Artificial Sequence
  chemically synthesized
ctttaaagttcatatggaacca

SEQ ID NO: 156110 - DNA, 22 bp, Artificial Sequence
  chemically synthesized
taaagttcatatggaaccaaaa

SEQ ID NO: 156111 - DNA, 22 bp, Artificial Sequence
  chemically synthesized
aaagttcatatggaaccaaaaa

SEQ ID NO: 156112 - DNA, 22 bp, Artificial Sequence
  chemically synthesized
aagttcatatggaaccaaaaaa

SEQ ID NO: 156113 - DNA, 22 bp, Artificial Sequence
  chemically synthesized
atatggaaccaaaaaagagccc

SEQ ID NO: 156114 - DNA, 22 bp, Artificial Sequence
  chemically synthesized
acaagtcaatcctaagccaaaa

SEQ ID NO: 156115 - DNA, 22 bp, Artificial Sequence
  chemically synthesized
agccaaaagaacaaagctagag

SEQ ID NO: 156116 - DNA, 22 bp, Artificial Sequence
  chemically synthesized
gaggcatcatgctacctgactt

SEQ ID NO: 156117 - DNA, 22 bp, Artificial Sequence
  chemically synthesized
cctgacttcaaactatactaca

SEQ ID NO: 156118 - DNA, 22 bp, Artificial Sequence
  chemically synthesized
acttcaaactatactacaaggt

SEQ ID NO: 156119 - DNA, 22 bp, Artificial Sequence
  chemically synthesized
caaactatactacaaggtacag

SEQ ID NO: 156120 - DNA, 22 bp, Artificial Sequence
  chemically synthesized
aaactatactacaaggtacagt

SEQ ID NO: 156121 - DNA, 22 bp, Artificial Sequence
  chemically synthesized
tactacaaggtacagtaaccaa

SEQ ID NO: 156122 - DNA, 22 bp, Artificial Sequence
  chemically synthesized
caaggtacagtaaccaaaacaa

SEQ ID NO: 156123 - DNA, 22 bp, Artificial Sequence
  chemically synthesized
gtaccaaaacagagatgtagac

SEQ ID NO: 156124 - DNA, 22 bp, Artificial Sequence
  chemically synthesized
tcagaaataataccacacatcc

SEQ ID NO: 156125 - DNA, 22 bp, Artificial Sequence
  chemically synthesized
agaaataataccacacatccac

SEQ ID NO: 156126 - DNA, 22 bp, Artificial Sequence
  chemically synthesized
tctgatctttgacaaacctgac

SEQ ID NO: 156127 - DNA, 22 bp, Artificial Sequence
  chemically synthesized
atctttgacaaacctgacaaaa

SEQ ID NO: 156128 - DNA, 22 bp, Artificial Sequence
  chemically synthesized
tgacaaacctgacaaaaacaag

SEQ ID NO: 156129 - DNA, 22 bp, Artificial Sequence
  chemically synthesized
gacaaacctgacaaaaacaagc

SEQ ID NO: 156130 - DNA, 22 bp, Artificial Sequence
  chemically synthesized
acaaacctgacaaaaacaagca

SEQ ID NO: 156131 - DNA, 22 bp, Artificial Sequence
  chemically synthesized
acaaaaacaagcaatggggaaa

SEQ ID NO: 156132 - DNA, 22 bp, Artificial Sequence
  chemically synthesized
cctatttaataaatgatgctgg

SEQ ID NO: 156133 - DNA, 22 bp, Artificial Sequence
  chemically synthesized
tttaataaatgatgctgggaaa

SEQ ID NO: 156134 - DNA, 22 bp, Artificial Sequence
  chemically synthesized
aataaatgatgctgggaaaact

SEQ ID NO: 156135 - DNA, 22 bp, Artificial Sequence
  chemically synthesized
ataaatgatgctgggaaaactg

SEQ ID NO: 156136 - DNA, 22 bp, Artificial Sequence
  chemically synthesized
ggaaaactggctagccatatgt

SEQ ID NO: 156137 - DNA, 22 bp, Artificial Sequence
  chemically synthesized
gctagccatatgtagaaagctg

SEQ ID NO: 156138 - DNA, 22 bp, Artificial Sequence
  chemically synthesized
gccatatgtagaaagctgaaac

SEQ ID NO: 156139 - DNA, 22 bp, Artificial Sequence
  chemically synthesized
aaactggatcccttccttacac

SEQ ID NO: 156140 - DNA, 22 bp, Artificial Sequence
  chemically synthesized
gatcccttccttacaccttata

SEQ ID NO: 156141 - DNA, 22 bp, Artificial Sequence
  chemically synthesized
ccttacaccttatacaaaaatt

SEQ ID NO: 156142 - DNA, 22 bp, Artificial Sequence
  chemically synthesized
cttacaccttatacaaaaatta

SEQ ID NO: 156143 - DNA, 22 bp, Artificial Sequence
  chemically synthesized
acaccttatacaaaaattattt

SEQ ID NO: 156144 - DNA, 22 bp, Artificial Sequence
  chemically synthesized
caccttatacaaaaattatttc

SEQ ID NO: 156145 - DNA, 22 bp, Artificial Sequence
  chemically synthesized
atacaaaaattatttcaagatg

SEQ ID NO: 156146 - DNA, 22 bp, Artificial Sequence
  chemically synthesized
tacaaaaattatttcaagatgg

SEQ ID NO: 156147 - DNA, 22 bp, Artificial Sequence
  chemically synthesized
tttcaagatggattaaagactt

SEQ ID NO: 156148 - DNA, 22 bp, Artificial Sequence
  chemically synthesized
caagatggattaaagacttaca

SEQ ID NO: 156149 - DNA, 22 bp, Artificial Sequence
  chemically synthesized
aagatggattaaagacttacat

SEQ ID NO: 156150 - DNA, 22 bp, Artificial Sequence
  chemically synthesized
aagacttacatgttagacctaa

SEQ ID NO: 156151 - DNA, 22 bp, Artificial Sequence
  chemically synthesized
acatgttagacctaaaaccata

SEQ ID NO: 156152 - DNA, 22 bp, Artificial Sequence
  chemically synthesized
catgttagacctaaaaccataa

SEQ ID NO: 156153 - DNA, 22 bp, Artificial Sequence
  chemically synthesized
gacctaaaaccataaaaacctt

SEQ ID NO: 156154 - DNA, 22 bp, Artificial Sequence
  chemically synthesized
aaaccataaaaaccttagaaga

SEQ ID NO: 156155 - DNA, 22 bp, Artificial Sequence
  chemically synthesized
agaagaaaacctaagcaatacc

SEQ ID NO: 156156 - DNA, 22 bp, Artificial Sequence
  chemically synthesized
gaagaaaacctaagcaatacca

SEQ ID NO: 156157 - DNA, 22 bp, Artificial Sequence
  chemically synthesized
agcaataccattcaggacatag

SEQ ID NO: 156158 - DNA, 22 bp, Artificial Sequence
  chemically synthesized
aggacataggcatgggcaagga

SEQ ID NO: 156159 - DNA, 22 bp, Artificial Sequence
  chemically synthesized
catgtctaaaacaccaaaagca

SEQ ID NO: 156160 - DNA, 22 bp, Artificial Sequence
  chemically synthesized
atgtctaaaacaccaaaagcaa

SEQ ID NO: 156161 - DNA, 22 bp, Artificial Sequence
  chemically synthesized
aaacaccaaaagcaatggcaac

SEQ ID NO: 156162 - DNA, 22 bp, Artificial Sequence
  chemically synthesized
attaaactaaagagcttctgca

SEQ ID NO: 156163 - DNA, 22 bp, Artificial Sequence
  chemically synthesized
aactaaagagcttctgcacagc

SEQ ID NO: 156164 - DNA, 22 bp, Artificial Sequence
  chemically synthesized
aagagcttctgcacagcaaaag

SEQ ID NO: 156165 - DNA, 22 bp, Artificial Sequence
  chemically synthesized
ctgcacagcaaaagaaactacc

SEQ ID NO: 156166 - DNA, 22 bp, Artificial Sequence
  chemically synthesized
tgcacagcaaaagaaactacca

SEQ ID NO: 156167 - DNA, 22 bp, Artificial Sequence
  chemically synthesized
cacagcaaaagaaactaccatc

SEQ ID NO: 156168 - DNA, 22 bp, Artificial Sequence
  chemically synthesized
ccatcagagtgaacaggcaacc

SEQ ID NO: 156169 - DNA, 22 bp, Artificial Sequence
  chemically synthesized
cacaatgggagaaaatttttgc

SEQ ID NO: 156170 - DNA, 22 bp, Artificial Sequence
  chemically synthesized
ttgcaatctactcatctgacaa

SEQ ID NO: 156171 - DNA, 22 bp, Artificial Sequence
  chemically synthesized
tgcaatctactcatctgacaaa

SEQ ID NO: 156172 - DNA, 22 bp, Artificial Sequence
  chemically synthesized
gcaatctactcatctgacaaag

SEQ ID NO: 156173 - DNA, 22 bp, Artificial Sequence
  chemically synthesized
caatctactcatctgacaaagg

SEQ ID NO: 156174 - DNA, 22 bp, Artificial Sequence
  chemically synthesized
ctcatctgacaaagggctaata

SEQ ID NO: 156175 - DNA, 22 bp, Artificial Sequence
  chemically synthesized
atctgacaaagggctaatatcc

SEQ ID NO: 156176 - DNA, 22 bp, Artificial Sequence
  chemically synthesized
acaaagggctaatatccagaat

SEQ ID NO: 156177 - DNA, 22 bp, Artificial Sequence
  chemically synthesized
atatccagaatctacaatgaac

SEQ ID NO: 156178 - DNA, 22 bp, Artificial Sequence
  chemically synthesized
caatgaactcaaacaaatttac

SEQ ID NO: 156179 - DNA, 22 bp, Artificial Sequence
  chemically synthesized
aaacaaatttacaagaaaaaaa

SEQ ID NO: 156180 - DNA, 22 bp, Artificial Sequence
  chemically synthesized
acaagaaaaaaacaaacaactg

SEQ ID NO: 156181 - DNA, 22 bp, Artificial Sequence
  chemically synthesized
caagaaaaaaacaaacaactgc

SEQ ID NO: 156182 - DNA, 22 bp, Artificial Sequence
  chemically synthesized
catcaacaagggggtgaaggat

SEQ ID NO: 156183 - DNA, 22 bp, Artificial Sequence
  chemically synthesized
ctcaaaagaagacatttatgca

SEQ ID NO: 156184 - DNA, 22 bp, Artificial Sequence
  chemically synthesized
tcaaaagaagacatttatgcag

SEQ ID NO: 156185 - DNA, 22 bp, Artificial Sequence
  chemically synthesized
aaaagaagacatttatgcagcc

SEQ ID NO: 156186 - DNA, 22 bp, Artificial Sequence
  chemically synthesized
atgcagccaaaaaacacatgaa

SEQ ID NO: 156187 - DNA, 22 bp, Artificial Sequence
  chemically synthesized
tgcagccaaaaaacacatgaaa

SEQ ID NO: 156188 - DNA, 22 bp, Artificial Sequence
  chemically synthesized
atcatcactggccatcagagaa

SEQ ID NO: 156189 - DNA, 22 bp, Artificial Sequence
  chemically synthesized
gccatcagagaaatgcaaatca

SEQ ID NO: 156190 - DNA, 22 bp, Artificial Sequence
  chemically synthesized
acaccagttagaatggtgatca

SEQ ID NO: 156191 - DNA, 22 bp, Artificial Sequence
  chemically synthesized
gaatggtgatcattaaaaagtc

SEQ ID NO: 156192 - DNA, 22 bp, Artificial Sequence
  chemically synthesized
aaaagtcaggaaaccacaggtg

SEQ ID NO: 156193 - DNA, 22 bp, Artificial Sequence
  chemically synthesized
gagaggatgtggagaaatagga

SEQ ID NO: 156194 - DNA, 22 bp, Artificial Sequence
  chemically synthesized
ttacactgttggtgggactata

SEQ ID NO: 156195 - DNA, 22 bp, Artificial Sequence
  chemically synthesized
tacactgttggtgggactataa

SEQ ID NO: 156196 - DNA, 22 bp, Artificial Sequence
  chemically synthesized
acactgttggtgggactataaa

SEQ ID NO: 156197 - DNA, 22 bp, Artificial Sequence
  chemically synthesized
cactgttggtgggactataaac

SEQ ID NO: 156198 - DNA, 22 bp, Artificial Sequence
  chemically synthesized
ttggtgggactataaactagtt

SEQ ID NO: 156199 - DNA, 22 bp, Artificial Sequence
  chemically synthesized
gtgggactataaactagttcaa

SEQ ID NO: 156200 - DNA, 22 bp, Artificial Sequence
  chemically synthesized
taaactagttcaaccattgtgg

SEQ ID NO: 156201 - DNA, 22 bp, Artificial Sequence
  chemically synthesized
gttcaaccattgtggaagtcag

SEQ ID NO: 156202 - DNA, 22 bp, Artificial Sequence
  chemically synthesized
aaccattgtggaagtcagtgtg

SEQ ID NO: 156203 - DNA, 22 bp, Artificial Sequence
  chemically synthesized
tggaagtcagtgtggcaattcc

SEQ ID NO: 156204 - DNA, 22 bp, Artificial Sequence
  chemically synthesized
ctcagggatctagaactagaaa

SEQ ID NO: 156205 - DNA, 22 bp, Artificial Sequence
  chemically synthesized
agggatctagaactagaaatac

SEQ ID NO: 156206 - DNA, 22 bp, Artificial Sequence
  chemically synthesized
gaactagaaataccatttgacc

SEQ ID NO: 156207 - DNA, 22 bp, Artificial Sequence
  chemically synthesized
gaaataccatttgacccagcca

SEQ ID NO: 156208 - DNA, 22 bp, Artificial Sequence
  chemically synthesized
gacccagccatcctattactgg

SEQ ID NO: 156209 - DNA, 22 bp, Artificial Sequence
  chemically synthesized
acccagccatcctattactggg

SEQ ID NO: 156210 - DNA, 22 bp, Artificial Sequence
  chemically synthesized
ttactgggtatatacccaaagg

SEQ ID NO: 156211 - DNA, 22 bp, Artificial Sequence
  chemically synthesized
ctgggtatatacccaaaggaat

SEQ ID NO: 156212 - DNA, 22 bp, Artificial Sequence
  chemically synthesized
ggtatatacccaaaggaatgta

SEQ ID NO: 156213 - DNA, 22 bp, Artificial Sequence
  chemically synthesized
ctataaagacacatgcacacgt

SEQ ID NO: 156214 - DNA, 22 bp, Artificial Sequence
  chemically synthesized
taaagacacatgcacacgtatg

SEQ ID NO: 156215 - DNA, 22 bp, Artificial Sequence
  chemically synthesized
attgtggcactattcacaatag

SEQ ID NO: 156216 - DNA, 22 bp, Artificial Sequence
  chemically synthesized
ttgtggcactattcacaatagc

SEQ ID NO: 156217 - DNA, 22 bp, Artificial Sequence
  chemically synthesized
tggcactattcacaatagcaaa

SEQ ID NO: 156218 - DNA, 22 bp, Artificial Sequence
  chemically synthesized
ttcacaatagcaaagacttgga

SEQ ID NO: 156219 - DNA, 22 bp, Artificial Sequence
  chemically synthesized
acaatagcaaagacttggaacc

SEQ ID NO: 156220 - DNA, 22 bp, Artificial Sequence
  chemically synthesized
ggaaccaacccaaatgtccaac

SEQ ID NO: 156221 - DNA, 22 bp, Artificial Sequence
  chemically synthesized
gaaccaacccaaatgtccaaca

SEQ ID NO: 156222 - DNA, 22 bp, Artificial Sequence
  chemically synthesized
gattaagaaaatgtggcacata

SEQ ID NO: 156223 - DNA, 22 bp, Artificial Sequence
  chemically synthesized
agaaaatgtggcacatatacat

SEQ ID NO: 156224 - DNA, 22 bp, Artificial Sequence
  chemically synthesized
tgcagccataaaaaatgatgag

SEQ ID NO: 156225 - DNA, 22 bp, Artificial Sequence
  chemically synthesized
atgtcctttgtagggacatgga

SEQ ID NO: 156226 - DNA, 22 bp, Artificial Sequence
  chemically synthesized
tgtagggacatggatgaaactg

SEQ ID NO: 156227 - DNA, 22 bp, Artificial Sequence
  chemically synthesized
gtagggacatggatgaaactgg

SEQ ID NO: 156228 - DNA, 22 bp, Artificial Sequence
  chemically synthesized
tagggacatggatgaaactgga

SEQ ID NO: 156229 - DNA, 22 bp, Artificial Sequence
  chemically synthesized
gaaaccatcattctgagcaaag

SEQ ID NO: 156230 - DNA, 22 bp, Artificial Sequence
  chemically synthesized
tgagcaaagtatcgcaaggacg

SEQ ID NO: 156231 - DNA, 22 bp, Artificial Sequence
  chemically synthesized
agcaaagtatcgcaaggacgaa

SEQ ID NO: 156232 - DNA, 22 bp, Artificial Sequence
  chemically synthesized
tcactcataggtgggagttgaa

SEQ ID NO: 156233 - DNA, 22 bp, Artificial Sequence
  chemically synthesized
actcataggtgggagttgaaca

SEQ ID NO: 156234 - DNA, 22 bp, Artificial Sequence
  chemically synthesized
ataggtgggagttgaacaatga

SEQ ID NO: 156235 - DNA, 22 bp, Artificial Sequence
  chemically synthesized
aacaatgagaacatttggacac

SEQ ID NO: 156236 - DNA, 22 bp, Artificial Sequence
  chemically synthesized
ggacacagtgaggggaacatca

SEQ ID NO: 156237 - DNA, 22 bp, Artificial Sequence
  chemically synthesized
gacacagtgaggggaacatcac

SEQ ID NO: 156238 - DNA, 22 bp, Artificial Sequence
  chemically synthesized
ttgtggggtgggggccgggggg

SEQ ID NO: 156239 - DNA, 22 bp, Artificial Sequence
  chemically synthesized
tggggtgggggccggggggagg

SEQ ID NO: 156240 - DNA, 22 bp, Artificial Sequence
  chemically synthesized
ggagatatacctaatgtaaatg

SEQ ID NO: 156241 - DNA, 22 bp, Artificial Sequence
  chemically synthesized
atgtaaatgacgagttaatggg

SEQ ID NO: 156242 - DNA, 22 bp, Artificial Sequence
  chemically synthesized
atgggtgcagcacaccaacatg

SEQ ID NO: 156243 - DNA, 22 bp, Artificial Sequence
  chemically synthesized
catgttgtgcacatgtacccta

SEQ ID NO: 156244 - DNA, 22 bp, Artificial Sequence
  chemically synthesized
tgcacatgtaccctagaactta

SEQ ID NO: 156245 - DNA, 22 bp, Artificial Sequence
  chemically synthesized
gaacttaaagtataataaacat

SEQ ID NO: 156246 - DNA, 22 bp, Artificial Sequence
  chemically synthesized
aaagtataataaacatatatat

SEQ ID NO: 156247 - DNA, 22 bp, Artificial Sequence
  chemically synthesized
aagtataataaacatatatata

SEQ ID NO: 156248 - DNA, 22 bp, Artificial Sequence
  chemically synthesized
tctcattttcaatcagtgactg

SEQ ID NO: 156249 - DNA, 22 bp, Artificial Sequence
  chemically synthesized
attttcaatcagtgactgaagt

SEQ ID NO: 156250 - DNA, 22 bp, Artificial Sequence
  chemically synthesized
tcaatcagtgactgaagtggaa

SEQ ID NO: 156251 - DNA, 22 bp, Artificial Sequence
  chemically synthesized
caatcagtgactgaagtggaaa

SEQ ID NO: 156252 - DNA, 22 bp, Artificial Sequence
  chemically synthesized
aatcagtgactgaagtggaaag

SEQ ID NO: 156253 - DNA, 22 bp, Artificial Sequence
  chemically synthesized
aagtggaaagaaacaaaatatt

SEQ ID NO: 156254 - DNA, 22 bp, Artificial Sequence
  chemically synthesized
tattctttaccacctatgaggc

SEQ ID NO: 156255 - DNA, 22 bp, Artificial Sequence
  chemically synthesized
attctttaccacctatgaggca

SEQ ID NO: 156256 - DNA, 22 bp, Artificial Sequence
  chemically synthesized
ttctttaccacctatgaggcat

SEQ ID NO: 156257 - DNA, 22 bp, Artificial Sequence
  chemically synthesized
tttaccacctatgaggcatata

SEQ ID NO: 156258 - DNA, 22 bp, Artificial Sequence
  chemically synthesized
taccacctatgaggcatatact

SEQ ID NO: 156259 - DNA, 22 bp, Artificial Sequence
  chemically synthesized
accacctatgaggcatatactt

SEQ ID NO: 156260 - DNA, 22 bp, Artificial Sequence
  chemically synthesized
ccacctatgaggcatatacttt

SEQ ID NO: 156261 - DNA, 22 bp, Artificial Sequence
  chemically synthesized
tgaggcatatactttttttttt

SEQ ID NO: 156262 - DNA, 22 bp, Artificial Sequence
  chemically synthesized
ttttttttgagagggagtctcg

SEQ ID NO: 156263 - DNA, 22 bp, Artificial Sequence
  chemically synthesized
tttttttgagagggagtctcgc

SEQ ID NO: 156264 - DNA, 22 bp, Artificial Sequence
  chemically synthesized
ttttttgagagggagtctcgct

SEQ ID NO: 156265 - DNA, 22 bp, Artificial Sequence
  chemically synthesized
tttttgagagggagtctcgctc

SEQ ID NO: 156266 - DNA, 22 bp, Artificial Sequence
  chemically synthesized
ttttgagagggagtctcgctct

SEQ ID NO: 156267 - DNA, 22 bp, Artificial Sequence
  chemically synthesized
tttgagagggagtctcgctctg

SEQ ID NO: 156268 - DNA, 22 bp, Artificial Sequence
  chemically synthesized
ttgagagggagtctcgctctgt

SEQ ID NO: 156269 - DNA, 22 bp, Artificial Sequence
  chemically synthesized
tgagagggagtctcgctctgtc

SEQ ID NO: 156270 - DNA, 22 bp, Artificial Sequence
  chemically synthesized
gagagggagtctcgctctgtca

SEQ ID NO: 156271 - DNA, 22 bp, Artificial Sequence
  chemically synthesized
agagggagtctcgctctgtcac

SEQ ID NO: 156272 - DNA, 22 bp, Artificial Sequence
  chemically synthesized
gctctgtcacctaggctggagt

SEQ ID NO: 156273 - DNA, 22 bp, Artificial Sequence
  chemically synthesized
tgtcacctaggctggagtgcag

SEQ ID NO: 156274 - DNA, 22 bp, Artificial Sequence
  chemically synthesized
tcacctaggctggagtgcagtt

SEQ ID NO: 156275 - DNA, 22 bp, Artificial Sequence
  chemically synthesized
ggctggagtgcagttgcgcgat

SEQ ID NO: 156276 - DNA, 22 bp, Artificial Sequence
  chemically synthesized
gagtgcagttgcgcgatctctg

SEQ ID NO: 156277 - DNA, 22 bp, Artificial Sequence
  chemically synthesized
cgcgatctctgctcactgaaac

SEQ ID NO: 156278 - DNA, 22 bp, Artificial Sequence
  chemically synthesized
tgctcactgaaacttctgcctc

SEQ ID NO: 156279 - DNA, 22 bp, Artificial Sequence
  chemically synthesized
ctcactgaaacttctgcctccc

SEQ ID NO: 156280 - DNA, 22 bp, Artificial Sequence
  chemically synthesized
actgaaacttctgcctcccagg

SEQ ID NO: 156281 - DNA, 22 bp, Artificial Sequence
  chemically synthesized
aaacttctgcctcccaggttca

SEQ ID NO: 156282 - DNA, 22 bp, Artificial Sequence
  chemically synthesized
ctgcctcccaggttcaagcgat

SEQ ID NO: 156283 - DNA, 22 bp, Artificial Sequence
  chemically synthesized
tgcctcccaggttcaagcgatt

SEQ ID NO: 156284 - DNA, 22 bp, Artificial Sequence
  chemically synthesized
cctcccaggttcaagcgattct

SEQ ID NO: 156285 - DNA, 22 bp, Artificial Sequence
  chemically synthesized
ccaggttcaagcgattctcctg

SEQ ID NO: 156286 - DNA, 22 bp, Artificial Sequence
  chemically synthesized
aagcgattctcctgcctcagcc

SEQ ID NO: 156287 - DNA, 22 bp, Artificial Sequence
  chemically synthesized
tcctgcctcagcctcttgagta

SEQ ID NO: 156288 - DNA, 22 bp, Artificial Sequence
  chemically synthesized
ctgcctcagcctcttgagtagc

SEQ ID NO: 156289 - DNA, 22 bp, Artificial Sequence
  chemically synthesized
cctcagcctcttgagtagctgg

SEQ ID NO: 156290 - DNA, 22 bp, Artificial Sequence
  chemically synthesized
agcctcttgagtagctgggatt

SEQ ID NO: 156291 - DNA, 22 bp, Artificial Sequence
  chemically synthesized
ttgagtagctgggattaaaggt

SEQ ID NO: 156292 - DNA, 22 bp, Artificial Sequence
  chemically synthesized
gagtagctgggattaaaggtgc

SEQ ID NO: 156293 - DNA, 22 bp, Artificial Sequence
  chemically synthesized
agtagctgggattaaaggtgca

SEQ ID NO: 156294 - DNA, 22 bp, Artificial Sequence
  chemically synthesized
ggattaaaggtgcacaccacta

SEQ ID NO: 156295 - DNA, 22 bp, Artificial Sequence
  chemically synthesized
aaggtgcacaccactatgccca

SEQ ID NO: 156296 - DNA, 22 bp, Artificial Sequence
  chemically synthesized
tgcccagctaatttttgtattt

SEQ ID NO: 156297 - DNA, 22 bp, Artificial Sequence
  chemically synthesized
atttttgtatttttagtagaga

SEQ ID NO: 156298 - DNA, 22 bp, Artificial Sequence
  chemically synthesized
ttgtatttttagtagagacggg

SEQ ID NO: 156299 - DNA, 22 bp, Artificial Sequence
  chemically synthesized
tgtatttttagtagagacgggg

SEQ ID NO: 156300 - DNA, 22 bp, Artificial Sequence
  chemically synthesized
gtatttttagtagagacggggt

SEQ ID NO: 156301 - DNA, 22 bp, Artificial Sequence
  chemically synthesized
tatttttagtagagacggggtt

SEQ ID NO: 156302 - DNA, 22 bp, Artificial Sequence
  chemically synthesized
ttagtagagacggggtttcatt

SEQ ID NO: 156303 - DNA, 22 bp, Artificial Sequence
  chemically synthesized
tagtagagacggggtttcattg

SEQ ID NO: 156304 - DNA, 22 bp, Artificial Sequence
  chemically synthesized
agtagagacggggtttcattgt

SEQ ID NO: 156305 - DNA, 22 bp, Artificial Sequence
  chemically synthesized
gtagagacggggtttcattgtt

SEQ ID NO: 156306 - DNA, 22 bp, Artificial Sequence
  chemically synthesized
cattgttttggtcaagctggtc

SEQ ID NO: 156307 - DNA, 22 bp, Artificial Sequence
  chemically synthesized
attgttttggtcaagctggtct

SEQ ID NO: 156308 - DNA, 22 bp, Artificial Sequence
  chemically synthesized
ttttggtcaagctggtctggaa

SEQ ID NO: 156309 - DNA, 22 bp, Artificial Sequence
  chemically synthesized
tggtcaagctggtctggaactc

SEQ ID NO: 156310 - DNA, 22 bp, Artificial Sequence
  chemically synthesized
ggtcaagctggtctggaactcc

SEQ ID NO: 156311 - DNA, 22 bp, Artificial Sequence
  chemically synthesized
gtcaagctggtctggaactcct

SEQ ID NO: 156312 - DNA, 22 bp, Artificial Sequence
  chemically synthesized
gtctggaactcctgaccttgtg

SEQ ID NO: 156313 - DNA, 22 bp, Artificial Sequence
  chemically synthesized
gaactcctgaccttgtgatcta

SEQ ID NO: 156314 - DNA, 22 bp, Artificial Sequence
  chemically synthesized
ctgaccttgtgatctacccgcc

SEQ ID NO: 156315 - DNA, 22 bp, Artificial Sequence
  chemically synthesized
accttgtgatctacccgcctca

SEQ ID NO: 156316 - DNA, 22 bp, Artificial Sequence
  chemically synthesized
gtgatctacccgcctcagcctc

SEQ ID NO: 156317 - DNA, 22 bp, Artificial Sequence
  chemically synthesized
tgatctacccgcctcagcctct

SEQ ID NO: 156318 - DNA, 22 bp, Artificial Sequence
  chemically synthesized
cccgcctcagcctctcaaagtg

SEQ ID NO: 156319 - DNA, 22 bp, Artificial Sequence
  chemically synthesized
agcctctcaaagtgctgggatt

SEQ ID NO: 156320 - DNA, 22 bp, Artificial Sequence
  chemically synthesized
tcaaagtgctgggattacaggt

SEQ ID NO: 156321 - DNA, 22 bp, Artificial Sequence
  chemically synthesized
aaagtgctgggattacaggtgt

SEQ ID NO: 156322 - DNA, 22 bp, Artificial Sequence
  chemically synthesized
ggattacaggtgtgagccaccg

SEQ ID NO: 156323 - DNA, 22 bp, Artificial Sequence
  chemically synthesized
caggtgtgagccaccgtgccag

SEQ ID NO: 156324 - DNA, 22 bp, Artificial Sequence
  chemically synthesized
gcatatagatttaaaaacccag

SEQ ID NO: 156325 - DNA, 22 bp, Artificial Sequence
  chemically synthesized
aaaaacccagctccgtctgcca

SEQ ID NO: 156326 - DNA, 22 bp, Artificial Sequence
  chemically synthesized
aaaacccagctccgtctgccat

SEQ ID NO: 156327 - DNA, 22 bp, Artificial Sequence
  chemically synthesized
cgtctgccattgcaaatatcta

SEQ ID NO: 156328 - DNA, 22 bp, Artificial Sequence
  chemically synthesized
ccattgcaaatatctaaagttt

SEQ ID NO: 156329 - DNA, 22 bp, Artificial Sequence
  chemically synthesized
caaatatctaaagtttataatg

SEQ ID NO: 156330 - DNA, 22 bp, Artificial Sequence
  chemically synthesized
aagtttataatgttttatccta

SEQ ID NO: 156331 - DNA, 22 bp, Artificial Sequence
  chemically synthesized
ataatgttttatcctatatttt

SEQ ID NO: 156332 - DNA, 22 bp, Artificial Sequence
  chemically synthesized
taatgttttatcctatattttt

SEQ ID NO: 156333 - DNA, 22 bp, Artificial Sequence
  chemically synthesized
tatcctatatttttgagaaata

SEQ ID NO: 156334 - DNA, 22 bp, Artificial Sequence
  chemically synthesized
atcctatatttttgagaaatag

SEQ ID NO: 156335 - DNA, 22 bp, Artificial Sequence
  chemically synthesized
tcctatatttttgagaaataga

SEQ ID NO: 156336 - DNA, 22 bp, Artificial Sequence
  chemically synthesized
tatttttgagaaatagattaat

SEQ ID NO: 156337 - DNA, 22 bp, Artificial Sequence
  chemically synthesized
ttgagaaatagattaattggca

SEQ ID NO: 156338 - DNA, 22 bp, Artificial Sequence
  chemically synthesized
tgagaaatagattaattggcag

SEQ ID NO: 156339 - DNA, 22 bp, Artificial Sequence
  chemically synthesized
gagaaatagattaattggcaga

SEQ ID NO: 156340 - DNA, 22 bp, Artificial Sequence
  chemically synthesized
agaaatagattaattggcagaa

SEQ ID NO: 156341 - DNA, 22 bp, Artificial Sequence
  chemically synthesized
attggcagaacaatttaatttg

SEQ ID NO: 156342 - DNA, 22 bp, Artificial Sequence
  chemically synthesized
gcagaacaatttaatttgctgt

SEQ ID NO: 156343 - DNA, 22 bp, Artificial Sequence
  chemically synthesized
aatttgctgtatgtcttcaatg

SEQ ID NO: 156344 - DNA, 22 bp, Artificial Sequence
  chemically synthesized
atttgctgtatgtcttcaatgg

SEQ ID NO: 156345 - DNA, 22 bp, Artificial Sequence
  chemically synthesized
gctgtatgtcttcaatggctag

SEQ ID NO: 156346 - DNA, 22 bp, Artificial Sequence
  chemically synthesized
ctgtatgtcttcaatggctagc

SEQ ID NO: 156347 - DNA, 22 bp, Artificial Sequence
  chemically synthesized
tatgtcttcaatggctagcata

SEQ ID NO: 156348 - DNA, 22 bp, Artificial Sequence
  chemically synthesized
caatggctagcatatggcttaa

SEQ ID NO: 156349 - DNA, 22 bp, Artificial Sequence
  chemically synthesized
aatggctagcatatggcttaac

SEQ ID NO: 156350 - DNA, 22 bp, Artificial Sequence
  chemically synthesized
gcatatggcttaacaataagtt

SEQ ID NO: 156351 - DNA, 22 bp, Artificial Sequence
  chemically synthesized
aacaataagttaaggccaatca

SEQ ID NO: 156352 - DNA, 22 bp, Artificial Sequence
  chemically synthesized
acaataagttaaggccaatcaa

SEQ ID NO: 156353 - DNA, 22 bp, Artificial Sequence
  chemically synthesized
aggccaatcaatgtggaagaag

SEQ ID NO: 156354 - DNA, 22 bp, Artificial Sequence
  chemically synthesized
tattgcttgaaatctattttgt

SEQ ID NO: 156355 - DNA, 22 bp, Artificial Sequence
  chemically synthesized
cttgaaatctattttgtcagac

SEQ ID NO: 156356 - DNA, 22 bp, Artificial Sequence
  chemically synthesized
gaaatctattttgtcagactta

SEQ ID NO: 156357 - DNA, 22 bp, Artificial Sequence
  chemically synthesized
aaatctattttgtcagacttaa

SEQ ID NO: 156358 - DNA, 22 bp, Artificial Sequence
  chemically synthesized
ttttgtcagacttaattccctc

SEQ ID NO: 156359 - DNA, 22 bp, Artificial Sequence
  chemically synthesized
tgtcagacttaattccctccca

SEQ ID NO: 156360 - DNA, 22 bp, Artificial Sequence
  chemically synthesized
gtcagacttaattccctcccat

SEQ ID NO: 156361 - DNA, 22 bp, Artificial Sequence
  chemically synthesized
tcagacttaattccctcccatt

SEQ ID NO: 156362 - DNA, 22 bp, Artificial Sequence
  chemically synthesized
aattccctcccatttctgtaag

SEQ ID NO: 156363 - DNA, 22 bp, Artificial Sequence
  chemically synthesized
attccctcccatttctgtaagc

SEQ ID NO: 156364 - DNA, 22 bp, Artificial Sequence
  chemically synthesized
cctcccatttctgtaagcagca

SEQ ID NO: 156365 - DNA, 22 bp, Artificial Sequence
  chemically synthesized
ccatttctgtaagcagcacaac

SEQ ID NO: 156366 - DNA, 22 bp, Artificial Sequence
  chemically synthesized
ctgtaagcagcacaactaaatt

SEQ ID NO: 156367 - DNA, 22 bp, Artificial Sequence
  chemically synthesized
tgtaagcagcacaactaaattt

SEQ ID NO: 156368 - DNA, 22 bp, Artificial Sequence
  chemically synthesized
taagcagcacaactaaatttca

SEQ ID NO: 156369 - DNA, 22 bp, Artificial Sequence
  chemically synthesized
aatttcataactctctattttc

SEQ ID NO: 156370 - DNA, 22 bp, Artificial Sequence
  chemically synthesized
cataactctctattttccttag

SEQ ID NO: 156371 - DNA, 22 bp, Artificial Sequence
  chemically synthesized
ataactctctattttccttagg

SEQ ID NO: 156372 - DNA, 22 bp, Artificial Sequence
  chemically synthesized
tctattttccttagggatatga

SEQ ID NO: 156373 - DNA, 22 bp, Artificial Sequence
  chemically synthesized
tattttccttagggatatgatc

SEQ ID NO: 156374 - DNA, 22 bp, Artificial Sequence
  chemically synthesized
ttttccttagggatatgatcag

SEQ ID NO: 156375 - DNA, 22 bp, Artificial Sequence
  chemically synthesized
tccttagggatatgatcagtaa

SEQ ID NO: 156376 - DNA, 22 bp, Artificial Sequence
  chemically synthesized
ccttagggatatgatcagtaaa

SEQ ID NO: 156377 - DNA, 22 bp, Artificial Sequence
  chemically synthesized
cttagggatatgatcagtaaaa

SEQ ID NO: 156378 - DNA, 22 bp, Artificial Sequence
  chemically synthesized
agggatatgatcagtaaaaaat

SEQ ID NO: 156379 - DNA, 22 bp, Artificial Sequence
  chemically synthesized
gggatatgatcagtaaaaaatt

SEQ ID NO: 156380 - DNA, 22 bp, Artificial Sequence
  chemically synthesized
gatgctgcgttttatatctagt

SEQ ID NO: 156381 - DNA, 22 bp, Artificial Sequence
  chemically synthesized
atgctgcgttttatatctagtt

SEQ ID NO: 156382 - DNA, 22 bp, Artificial Sequence
  chemically synthesized
cgttttatatctagttttacct

SEQ ID NO: 156383 - DNA, 22 bp, Artificial Sequence
  chemically synthesized
tatatctagttttaccttgata

SEQ ID NO: 156384 - DNA, 22 bp, Artificial Sequence
  chemically synthesized
atatctagttttaccttgatag

SEQ ID NO: 156385 - DNA, 22 bp, Artificial Sequence
  chemically synthesized
tatctagttttaccttgatagg

SEQ ID NO: 156386 - DNA, 22 bp, Artificial Sequence
  chemically synthesized
gttttaccttgataggcagcat

SEQ ID NO: 156387 - DNA, 22 bp, Artificial Sequence
  chemically synthesized
taccttgataggcagcattgga

SEQ ID NO: 156388 - DNA, 22 bp, Artificial Sequence
  chemically synthesized
accttgataggcagcattggat

SEQ ID NO: 156389 - DNA, 22 bp, Artificial Sequence
  chemically synthesized
ccttgataggcagcattggatg

SEQ ID NO: 156390 - DNA, 22 bp, Artificial Sequence
  chemically synthesized
gataggcagcattggatggtag

SEQ ID NO: 156391 - DNA, 22 bp, Artificial Sequence
  chemically synthesized
ataggcagcattggatggtagt

SEQ ID NO: 156392 - DNA, 22 bp, Artificial Sequence
  chemically synthesized
gatggtagtaaagatcaaagct

SEQ ID NO: 156393 - DNA, 22 bp, Artificial Sequence
  chemically synthesized
tcagatttatcctgccttactt

SEQ ID NO: 156394 - DNA, 22 bp, Artificial Sequence
  chemically synthesized
cagatttatcctgccttacttt

SEQ ID NO: 156395 - DNA, 22 bp, Artificial Sequence
  chemically synthesized
agatttatcctgccttacttta

SEQ ID NO: 156396 - DNA, 22 bp, Artificial Sequence
  chemically synthesized
atcctgccttactttaaatcca

SEQ ID NO: 156397 - DNA, 22 bp, Artificial Sequence
  chemically synthesized
tcctgccttactttaaatccag

SEQ ID NO: 156398 - DNA, 22 bp, Artificial Sequence
  chemically synthesized
ccttactttaaatccagtaggg

SEQ ID NO: 156399 - DNA, 22 bp, Artificial Sequence
  chemically synthesized
actttaaatccagtagggccta

SEQ ID NO: 156400 - DNA, 22 bp, Artificial Sequence
  chemically synthesized
ctttaaatccagtagggcctag

SEQ ID NO: 156401 - DNA, 22 bp, Artificial Sequence
  chemically synthesized
taaatccagtagggcctagggt

SEQ ID NO: 156402 - DNA, 22 bp, Artificial Sequence
  chemically synthesized
aaatccagtagggcctagggta

SEQ ID NO: 156403 - DNA, 22 bp, Artificial Sequence
  chemically synthesized
aatccagtagggcctagggtaa

SEQ ID NO: 156404 - DNA, 22 bp, Artificial Sequence
  chemically synthesized
gggtaagaggctgaaagtctgt

SEQ ID NO: 156405 - DNA, 22 bp, Artificial Sequence
  chemically synthesized
aaagtctgtgggttttttttac

SEQ ID NO: 156406 - DNA, 22 bp, Artificial Sequence
  chemically synthesized
tgggttttttttacatctgtag

SEQ ID NO: 156407 - DNA, 22 bp, Artificial Sequence
  chemically synthesized
tttttacatctgtagaaataat

SEQ ID NO: 156408 - DNA, 22 bp, Artificial Sequence
  chemically synthesized
ttttacatctgtagaaataata

SEQ ID NO: 156409 - DNA, 22 bp, Artificial Sequence
  chemically synthesized
tttacatctgtagaaataatag

SEQ ID NO: 156410 - DNA, 22 bp, Artificial Sequence
  chemically synthesized
ttacatctgtagaaataatagt

SEQ ID NO: 156411 - DNA, 22 bp, Artificial Sequence
  chemically synthesized
tacatctgtagaaataatagta

SEQ ID NO: 156412 - DNA, 22 bp, Artificial Sequence
  chemically synthesized
acatctgtagaaataatagtat

SEQ ID NO: 156413 - DNA, 22 bp, Artificial Sequence
  chemically synthesized
catctgtagaaataatagtatt

SEQ ID NO: 156414 - DNA, 22 bp, Artificial Sequence
  chemically synthesized
tagaaataatagtatttatata

SEQ ID NO: 156415 - DNA, 22 bp, Artificial Sequence
  chemically synthesized
atataatggttatttaaagggc

SEQ ID NO: 156416 - DNA, 22 bp, Artificial Sequence
  chemically synthesized
tataatggttatttaaagggct

SEQ ID NO: 156417 - DNA, 22 bp, Artificial Sequence
  chemically synthesized
tttaaagggcttttcaataggt

SEQ ID NO: 156418 - DNA, 22 bp, Artificial Sequence
  chemically synthesized
aaagggcttttcaataggttat

SEQ ID NO: 156419 - DNA, 22 bp, Artificial Sequence
  chemically synthesized
aagggcttttcaataggttatt

SEQ ID NO: 156420 - DNA, 22 bp, Artificial Sequence
  chemically synthesized
ttcaataggttattgtgaagat

SEQ ID NO: 156421 - DNA, 22 bp, Artificial Sequence
  chemically synthesized
tcaataggttattgtgaagatt

SEQ ID NO: 156422 - DNA, 22 bp, Artificial Sequence
  chemically synthesized
caataggttattgtgaagattt

SEQ ID NO: 156423 - DNA, 22 bp, Artificial Sequence
  chemically synthesized
aataggttattgtgaagattta

SEQ ID NO: 156424 - DNA, 22 bp, Artificial Sequence
  chemically synthesized
ttgtgaagatttaataagttaa

SEQ ID NO: 156425 - DNA, 22 bp, Artificial Sequence
  chemically synthesized
tgaagatttaataagttaatat

SEQ ID NO: 156426 - DNA, 22 bp, Artificial Sequence
  chemically synthesized
aataagttaatatttgtaaagt

SEQ ID NO: 156427 - DNA, 22 bp, Artificial Sequence
  chemically synthesized
ataagttaatatttgtaaagta

SEQ ID NO: 156428 - DNA, 22 bp, Artificial Sequence
  chemically synthesized
atatttgtaaagtagtatgaca

SEQ ID NO: 156429 - DNA, 22 bp, Artificial Sequence
  chemically synthesized
gtaaagtagtatgacacatatt

SEQ ID NO: 156430 - DNA, 22 bp, Artificial Sequence
  chemically synthesized
taaagtagtatgacacatatta

SEQ ID NO: 156431 - DNA, 22 bp, Artificial Sequence
  chemically synthesized
agcagttattaaataatatcta

SEQ ID NO: 156432 - DNA, 22 bp, Artificial Sequence
  chemically synthesized
ttaaataatatctactaatttt

SEQ ID NO: 156433 - DNA, 22 bp, Artificial Sequence
  chemically synthesized
aataatatctactaatttttta

SEQ ID NO: 156434 - DNA, 22 bp, Artificial Sequence
  chemically synthesized
ctaattttttaaggtacaaaaa

SEQ ID NO: 156435 - DNA, 22 bp, Artificial Sequence
  chemically synthesized
attttttaaggtacaaaaaatt

SEQ ID NO: 156436 - DNA, 22 bp, Artificial Sequence
  chemically synthesized
tttaaggtacaaaaaattaatt

SEQ ID NO: 156437 - DNA, 22 bp, Artificial Sequence
  chemically synthesized
ttaaggtacaaaaaattaatta

SEQ ID NO: 156438 - DNA, 22 bp, Artificial Sequence
  chemically synthesized
taaggtacaaaaaattaattat

SEQ ID NO: 156439 - DNA, 22 bp, Artificial Sequence
  chemically synthesized
aaggtacaaaaaattaattatt

SEQ ID NO: 156440 - DNA, 22 bp, Artificial Sequence
  chemically synthesized
aggtacaaaaaattaattattt

SEQ ID NO: 156441 - DNA, 22 bp, Artificial Sequence
  chemically synthesized
attatttggtaggacttatata

SEQ ID NO: 156442 - DNA, 22 bp, Artificial Sequence
  chemically synthesized
tttggtaggacttatatattcg

SEQ ID NO: 156443 - DNA, 22 bp, Artificial Sequence
  chemically synthesized
ggtaggacttatatattcggtc

SEQ ID NO: 156444 - DNA, 22 bp, Artificial Sequence
  chemically synthesized
gtaggacttatatattcggtct

SEQ ID NO: 156445 - DNA, 22 bp, Artificial Sequence
  chemically synthesized
atatattcggtctattaaccca

SEQ ID NO: 156446 - DNA, 22 bp, Artificial Sequence
  chemically synthesized
tatattcggtctattaacccat

SEQ ID NO: 156447 - DNA, 22 bp, Artificial Sequence
  chemically synthesized
ggtctattaacccattttactc

SEQ ID NO: 156448 - DNA, 22 bp, Artificial Sequence
  chemically synthesized
ttaacccattttactctccttt

SEQ ID NO: 156449 - DNA, 22 bp, Artificial Sequence
  chemically synthesized
acccattttactctcctttccc

SEQ ID NO: 156450 - DNA, 22 bp, Artificial Sequence
  chemically synthesized
tactctcctttcccagagaaga

SEQ ID NO: 156451 - DNA, 22 bp, Artificial Sequence
  chemically synthesized
actctcctttcccagagaagaa

SEQ ID NO: 156452 - DNA, 22 bp, Artificial Sequence
  chemically synthesized
ctctcctttcccagagaagaaa

SEQ ID NO: 156453 - DNA, 22 bp, Artificial Sequence
  chemically synthesized
tcctttcccagagaagaaaaca

SEQ ID NO: 156454 - DNA, 22 bp, Artificial Sequence
  chemically synthesized
ctttcccagagaagaaaacatt

SEQ ID NO: 156455 - DNA, 22 bp, Artificial Sequence
  chemically synthesized
tcccagagaagaaaacattgga

SEQ ID NO: 156456 - DNA, 22 bp, Artificial Sequence
  chemically synthesized
cccagagaagaaaacattggaa

SEQ ID NO: 156457 - DNA, 22 bp, Artificial Sequence
  chemically synthesized
ccagagaagaaaacattggaaa

SEQ ID NO: 156458 - DNA, 22 bp, Artificial Sequence
  chemically synthesized
gaaagaaaacaaatctgatgag

SEQ ID NO: 156459 - DNA, 22 bp, Artificial Sequence
  chemically synthesized
atgagacctcattcagcctaag

SEQ ID NO: 156460 - DNA, 22 bp, Artificial Sequence
  chemically synthesized
attcagcctaaggtagtgtttc

SEQ ID NO: 156461 - DNA, 22 bp, Artificial Sequence
  chemically synthesized
agcctaaggtagtgtttctaaa

SEQ ID NO: 156462 - DNA, 22 bp, Artificial Sequence
  chemically synthesized
aggtagtgtttctaaatcctca

SEQ ID NO: 156463 - DNA, 22 bp, Artificial Sequence
  chemically synthesized
ctaaatcctcaactttgtagtc

SEQ ID NO: 156464 - DNA, 22 bp, Artificial Sequence
  chemically synthesized
taaatcctcaactttgtagtct

SEQ ID NO: 156465 - DNA, 22 bp, Artificial Sequence
  chemically synthesized
aatcctcaactttgtagtcttt

SEQ ID NO: 156466 - DNA, 22 bp, Artificial Sequence
  chemically synthesized
aactttgtagtctttcactaat

SEQ ID NO: 156467 - DNA, 22 bp, Artificial Sequence
  chemically synthesized
tgtagtctttcactaatggcac

SEQ ID NO: 156468 - DNA, 22 bp, Artificial Sequence
  chemically synthesized
gtagtctttcactaatggcact

SEQ ID NO: 156469 - DNA, 22 bp, Artificial Sequence
  chemically synthesized
tagtctttcactaatggcacta

SEQ ID NO: 156470 - DNA, 22 bp, Artificial Sequence
  chemically synthesized
tcactaatggcactaggcctgg

SEQ ID NO: 156471 - DNA, 22 bp, Artificial Sequence
  chemically synthesized
cactaatggcactaggcctgga

SEQ ID NO: 156472 - DNA, 22 bp, Artificial Sequence
  chemically synthesized
actaatggcactaggcctggaa

SEQ ID NO: 156473 - DNA, 22 bp, Artificial Sequence
  chemically synthesized
atggcactaggcctggaataaa

SEQ ID NO: 156474 - DNA, 22 bp, Artificial Sequence
  chemically synthesized
ggcctggaataaactgtacata

SEQ ID NO: 156475 - DNA, 22 bp, Artificial Sequence
  chemically synthesized
gaataaactgtacatacggctc

SEQ ID NO: 156476 - DNA, 22 bp, Artificial Sequence
  chemically synthesized
tacatacggctcctttctttcg

SEQ ID NO: 156477 - DNA, 22 bp, Artificial Sequence
  chemically synthesized
ctttctttcgcaatcacactaa

SEQ ID NO: 156478 - DNA, 22 bp, Artificial Sequence
  chemically synthesized
tctttcgcaatcacactaattc

SEQ ID NO: 156479 - DNA, 22 bp, Artificial Sequence
  chemically synthesized
ctttcgcaatcacactaattcc

SEQ ID NO: 156480 - DNA, 22 bp, Artificial Sequence
  chemically synthesized
tttcgcaatcacactaattccc

SEQ ID NO: 156481 - DNA, 22 bp, Artificial Sequence
  chemically synthesized
tcgcaatcacactaattcccag

SEQ ID NO: 156482 - DNA, 22 bp, Artificial Sequence
  chemically synthesized
cgcaatcacactaattcccagg

SEQ ID NO: 156483 - DNA, 22 bp, Artificial Sequence
  chemically synthesized
gcaatcacactaattcccagga

SEQ ID NO: 156484 - DNA, 22 bp, Artificial Sequence
  chemically synthesized
attcccaggatgtgtggtatgt

SEQ ID NO: 156485 - DNA, 22 bp, Artificial Sequence
  chemically synthesized
ccaggatgtgtggtatgtcctg

SEQ ID NO: 156486 - DNA, 22 bp, Artificial Sequence
  chemically synthesized
atgggaatcccagggctggaag

SEQ ID NO: 156487 - DNA, 22 bp, Artificial Sequence
  chemically synthesized
gaaggcttgcatacctggatct

SEQ ID NO: 156488 - DNA, 22 bp, Artificial Sequence
  chemically synthesized
gcatacctggatctccatccct

SEQ ID NO: 156489 - DNA, 22 bp, Artificial Sequence
  chemically synthesized
catacctggatctccatccctt

SEQ ID NO: 156490 - DNA, 22 bp, Artificial Sequence
  chemically synthesized
gatctccatccctttttctttt

SEQ ID NO: 156491 - DNA, 22 bp, Artificial Sequence
  chemically synthesized
catccctttttcttttatgtac

SEQ ID NO: 156492 - DNA, 22 bp, Artificial Sequence
  chemically synthesized
tttcttttatgtacattgtggc

SEQ ID NO: 156493 - DNA, 22 bp, Artificial Sequence
  chemically synthesized
ttcttttatgtacattgtggct

SEQ ID NO: 156494 - DNA, 22 bp, Artificial Sequence
  chemically synthesized
tcttttatgtacattgtggctg

SEQ ID NO: 156495 - DNA, 22 bp, Artificial Sequence
  chemically synthesized
cttttatgtacattgtggctgt

SEQ ID NO: 156496 - DNA, 22 bp, Artificial Sequence
  chemically synthesized
ttttatgtacattgtggctgtt

SEQ ID NO: 156497 - DNA, 22 bp, Artificial Sequence
  chemically synthesized
ttatgtacattgtggctgttgc

SEQ ID NO: 156498 - DNA, 22 bp, Artificial Sequence
  chemically synthesized
tatgtacattgtggctgttgca

SEQ ID NO: 156499 - DNA, 22 bp, Artificial Sequence
  chemically synthesized
atgtacattgtggctgttgcag

SEQ ID NO: 156500 - DNA, 22 bp, Artificial Sequence
  chemically synthesized
tgtacattgtggctgttgcagg

SEQ ID NO: 156501 - DNA, 22 bp, Artificial Sequence
  chemically synthesized
tggctgttgcaggcaatatctt

SEQ ID NO: 156502 - DNA, 22 bp, Artificial Sequence
  chemically synthesized
ttgcaggcaatatcttcttgat

SEQ ID NO: 156503 - DNA, 22 bp, Artificial Sequence
  chemically synthesized
caggcaatatcttcttgatctt

SEQ ID NO: 156504 - DNA, 22 bp, Artificial Sequence
  chemically synthesized
cttgatcttcctgatcatgact

SEQ ID NO: 156505 - DNA, 22 bp, Artificial Sequence
  chemically synthesized
ttgatcttcctgatcatgactg

SEQ ID NO: 156506 - DNA, 22 bp, Artificial Sequence
  chemically synthesized
gatcttcctgatcatgactgag

SEQ ID NO: 156507 - DNA, 22 bp, Artificial Sequence
  chemically synthesized
atcttcctgatcatgactgagc

SEQ ID NO: 156508 - DNA, 22 bp, Artificial Sequence
  chemically synthesized
cctgatcatgactgagcgcagt

SEQ ID NO: 156509 - DNA, 22 bp, Artificial Sequence
  chemically synthesized
ctgatcatgactgagcgcagtc

SEQ ID NO: 156510 - DNA, 22 bp, Artificial Sequence
  chemically synthesized
atcatgactgagcgcagtctcc

SEQ ID NO: 156511 - DNA, 22 bp, Artificial Sequence
  chemically synthesized
agcgcagtctccatgagcccat

SEQ ID NO: 156512 - DNA, 22 bp, Artificial Sequence
  chemically synthesized
catgagcccatgtatctcttcc

SEQ ID NO: 156513 - DNA, 22 bp, Artificial Sequence
  chemically synthesized
ttcctatccatgctggcctcag

SEQ ID NO: 156514 - DNA, 22 bp, Artificial Sequence
  chemically synthesized
cctatccatgctggcctcagcc

SEQ ID NO: 156515 - DNA, 22 bp, Artificial Sequence
  chemically synthesized
ctatccatgctggcctcagccg

SEQ ID NO: 156516 - DNA, 22 bp, Artificial Sequence
  chemically synthesized
tccatgctggcctcagccgact

SEQ ID NO: 156517 - DNA, 22 bp, Artificial Sequence
  chemically synthesized
gcctcagccgacttcctgctcg

SEQ ID NO: 156518 - DNA, 22 bp, Artificial Sequence
  chemically synthesized
agccgacttcctgctcgccact

SEQ ID NO: 156519 - DNA, 22 bp, Artificial Sequence
  chemically synthesized
cctgctcgccactgctgcagcc

SEQ ID NO: 156520 - DNA, 22 bp, Artificial Sequence
  chemically synthesized
ctgctcgccactgctgcagccc

SEQ ID NO: 156521 - DNA, 22 bp, Artificial Sequence
  chemically synthesized
ctcgccactgctgcagccccta

SEQ ID NO: 156522 - DNA, 22 bp, Artificial Sequence
  chemically synthesized
gccactgctgcagcccctaagg

SEQ ID NO: 156523 - DNA, 22 bp, Artificial Sequence
  chemically synthesized
ctgcagcccctaaggtgctggc

SEQ ID NO: 156524 - DNA, 22 bp, Artificial Sequence
  chemically synthesized
cagcccctaaggtgctggctat

SEQ ID NO: 156525 - DNA, 22 bp, Artificial Sequence
  chemically synthesized
aggtgctggctatcctctggtt

SEQ ID NO: 156526 - DNA, 22 bp, Artificial Sequence
  chemically synthesized
gctatcctctggttccactcca

SEQ ID NO: 156527 - DNA, 22 bp, Artificial Sequence
  chemically synthesized
tcctctggttccactccatgga

SEQ ID NO: 156528 - DNA, 22 bp, Artificial Sequence
  chemically synthesized
tggttccactccatggacatat

SEQ ID NO: 156529 - DNA, 22 bp, Artificial Sequence
  chemically synthesized
gttccactccatggacatatcc

SEQ ID NO: 156530 - DNA, 22 bp, Artificial Sequence
  chemically synthesized
cactccatggacatatcctttg

SEQ ID NO: 156531 - DNA, 22 bp, Artificial Sequence
  chemically synthesized
catggacatatcctttggtagt

SEQ ID NO: 156532 - DNA, 22 bp, Artificial Sequence
  chemically synthesized
tggtagttgtgtgtctcagatg

SEQ ID NO: 156533 - DNA, 22 bp, Artificial Sequence
  chemically synthesized
ggtagttgtgtgtctcagatgt

SEQ ID NO: 156534 - DNA, 22 bp, Artificial Sequence
  chemically synthesized
gtagttgtgtgtctcagatgtt

SEQ ID NO: 156535 - DNA, 22 bp, Artificial Sequence
  chemically synthesized
tgtgtctcagatgttcttcata

SEQ ID NO: 156536 - DNA, 22 bp, Artificial Sequence
  chemically synthesized
agatgttcttcatacatttcat

SEQ ID NO: 156537 - DNA, 22 bp, Artificial Sequence
  chemically synthesized
ttcatacatttcatctttgtgg

SEQ ID NO: 156538 - DNA, 22 bp, Artificial Sequence
  chemically synthesized
catacatttcatctttgtggca

SEQ ID NO: 156539 - DNA, 22 bp, Artificial Sequence
  chemically synthesized
atacatttcatctttgtggcag

SEQ ID NO: 156540 - DNA, 22 bp, Artificial Sequence
  chemically synthesized
catctttgtggcagaatctgct

SEQ ID NO: 156541 - DNA, 22 bp, Artificial Sequence
  chemically synthesized
atctttgtggcagaatctgcta

SEQ ID NO: 156542 - DNA, 22 bp, Artificial Sequence
  chemically synthesized
tgtggcagaatctgctattctc

SEQ ID NO: 156543 - DNA, 22 bp, Artificial Sequence
  chemically synthesized
gtggcagaatctgctattctcc

SEQ ID NO: 156544 - DNA, 22 bp, Artificial Sequence
  chemically synthesized
tggcagaatctgctattctcct

SEQ ID NO: 156545 - DNA, 22 bp, Artificial Sequence
  chemically synthesized
ctattctcctggcaatggcatt

SEQ ID NO: 156546 - DNA, 22 bp, Artificial Sequence
  chemically synthesized
ttctcctggcaatggcatttga

SEQ ID NO: 156547 - DNA, 22 bp, Artificial Sequence
  chemically synthesized
tcctggcaatggcatttgaccg

SEQ ID NO: 156548 - DNA, 22 bp, Artificial Sequence
  chemically synthesized
ctggcaatggcatttgaccgct

SEQ ID NO: 156549 - DNA, 22 bp, Artificial Sequence
  chemically synthesized
gcaatggcatttgaccgctatg

SEQ ID NO: 156550 - DNA, 22 bp, Artificial Sequence
  chemically synthesized
gaccgctatgtggccatctgtt

SEQ ID NO: 156551 - DNA, 22 bp, Artificial Sequence
  chemically synthesized
accgctatgtggccatctgtta

SEQ ID NO: 156552 - DNA, 22 bp, Artificial Sequence
  chemically synthesized
tgtggccatctgttacccactg

SEQ ID NO: 156553 - DNA, 22 bp, Artificial Sequence
  chemically synthesized
ttacccactgagatacaccatt

SEQ ID NO: 156554 - DNA, 22 bp, Artificial Sequence
  chemically synthesized
cccactgagatacaccatttta

SEQ ID NO: 156555 - DNA, 22 bp, Artificial Sequence
  chemically synthesized
agatacaccattttaacctcat

SEQ ID NO: 156556 - DNA, 22 bp, Artificial Sequence
  chemically synthesized
taacctcatcagccgtcaggaa

SEQ ID NO: 156557 - DNA, 22 bp, Artificial Sequence
  chemically synthesized
aacctcatcagccgtcaggaag

SEQ ID NO: 156558 - DNA, 22 bp, Artificial Sequence
  chemically synthesized
acctcatcagccgtcaggaaga

SEQ ID NO: 156559 - DNA, 22 bp, Artificial Sequence
  chemically synthesized
atcagccgtcaggaagattggc

SEQ ID NO: 156560 - DNA, 22 bp, Artificial Sequence
  chemically synthesized
gcatagcagctgtggtcaggag

SEQ ID NO: 156561 - DNA, 22 bp, Artificial Sequence
  chemically synthesized
tggtcaggagctttttcatctg

SEQ ID NO: 156562 - DNA, 22 bp, Artificial Sequence
  chemically synthesized
tttcatctgctgtccgttcatc

SEQ ID NO: 156563 - DNA, 22 bp, Artificial Sequence
  chemically synthesized
ttcatctgctgtccgttcatct

SEQ ID NO: 156564 - DNA, 22 bp, Artificial Sequence
  chemically synthesized
tcatctgctgtccgttcatctt

SEQ ID NO: 156565 - DNA, 22 bp, Artificial Sequence
  chemically synthesized
catctgctgtccgttcatcttc

SEQ ID NO: 156566 - DNA, 22 bp, Artificial Sequence
  chemically synthesized
atctgctgtccgttcatcttcc

SEQ ID NO: 156567 - DNA, 22 bp, Artificial Sequence
  chemically synthesized
ctgtccgttcatcttcctggta

SEQ ID NO: 156568 - DNA, 22 bp, Artificial Sequence
  chemically synthesized
tccgttcatcttcctggtatac

SEQ ID NO: 156569 - DNA, 22 bp, Artificial Sequence
  chemically synthesized
atcttcctggtataccgactta

SEQ ID NO: 156570 - DNA, 22 bp, Artificial Sequence
  chemically synthesized
cctggtataccgacttacatat

SEQ ID NO: 156571 - DNA, 22 bp, Artificial Sequence
  chemically synthesized
ctggtataccgacttacatatt

SEQ ID NO: 156572 - DNA, 22 bp, Artificial Sequence
  chemically synthesized
gtataccgacttacatattgtg

SEQ ID NO: 156573 - DNA, 22 bp, Artificial Sequence
  chemically synthesized
acatattgtgggagaaacatca

SEQ ID NO: 156574 - DNA, 22 bp, Artificial Sequence
  chemically synthesized
catattgtgggagaaacatcat

SEQ ID NO: 156575 - DNA, 22 bp, Artificial Sequence
  chemically synthesized
tgggagaaacatcattcctcat

SEQ ID NO: 156576 - DNA, 22 bp, Artificial Sequence
  chemically synthesized
ctcattcctactgtgagcacat

SEQ ID NO: 156577 - DNA, 22 bp, Artificial Sequence
  chemically synthesized
attcctactgtgagcacattgc

SEQ ID NO: 156578 - DNA, 22 bp, Artificial Sequence
  chemically synthesized
ctactgtgagcacattgccaga

SEQ ID NO: 156579 - DNA, 22 bp, Artificial Sequence
  chemically synthesized
ctgtgagcacattgccagattg

SEQ ID NO: 156580 - DNA, 22 bp, Artificial Sequence
  chemically synthesized
tgagcacattgccagattggct

SEQ ID NO: 156581 - DNA, 22 bp, Artificial Sequence
  chemically synthesized
ccagattggcttgtggcaatat

SEQ ID NO: 156582 - DNA, 22 bp, Artificial Sequence
  chemically synthesized
gcttgtggcaatatcaatgtca

SEQ ID NO: 156583 - DNA, 22 bp, Artificial Sequence
  chemically synthesized
gtggcaatatcaatgtcaatat

SEQ ID NO: 156584 - DNA, 22 bp, Artificial Sequence
  chemically synthesized
tggcaatatcaatgtcaatatc

SEQ ID NO: 156585 - DNA, 22 bp, Artificial Sequence
  chemically synthesized
atggcctcactgtggccctact

SEQ ID NO: 156586 - DNA, 22 bp, Artificial Sequence
  chemically synthesized
tggcctcactgtggccctactc

SEQ ID NO: 156587 - DNA, 22 bp, Artificial Sequence
  chemically synthesized
actgtggccctactctctacag

SEQ ID NO: 156588 - DNA, 22 bp, Artificial Sequence
  chemically synthesized
tggccctactctctacaggact

SEQ ID NO: 156589 - DNA, 22 bp, Artificial Sequence
  chemically synthesized
ctctctacaggactggatatag

SEQ ID NO: 156590 - DNA, 22 bp, Artificial Sequence
  chemically synthesized
tctacaggactggatatagtgc

SEQ ID NO: 156591 - DNA, 22 bp, Artificial Sequence
  chemically synthesized
tacaggactggatatagtgctt

SEQ ID NO: 156592 - DNA, 22 bp, Artificial Sequence
  chemically synthesized
caggactggatatagtgcttat

SEQ ID NO: 156593 - DNA, 22 bp, Artificial Sequence
  chemically synthesized
gatatagtgcttatcattatat

SEQ ID NO: 156594 - DNA, 22 bp, Artificial Sequence
  chemically synthesized
atcattatatcctacacaatga

SEQ ID NO: 156595 - DNA, 22 bp, Artificial Sequence
  chemically synthesized
tcattatatcctacacaatgat

SEQ ID NO: 156596 - DNA, 22 bp, Artificial Sequence
  chemically synthesized
tatcctacacaatgatccttca

SEQ ID NO: 156597 - DNA, 22 bp, Artificial Sequence
  chemically synthesized
cacaatgatccttcactcagtg

SEQ ID NO: 156598 - DNA, 22 bp, Artificial Sequence
  chemically synthesized
cactcagtgtttcagatatctt

SEQ ID NO: 156599 - DNA, 22 bp, Artificial Sequence
  chemically synthesized
actcagtgtttcagatatcttc

SEQ ID NO: 156600 - DNA, 22 bp, Artificial Sequence
  chemically synthesized
agtgtttcagatatcttcctgg

SEQ ID NO: 156601 - DNA, 22 bp, Artificial Sequence
  chemically synthesized
cagatatcttcctgggctgcca

SEQ ID NO: 156602 - DNA, 22 bp, Artificial Sequence
  chemically synthesized
agatatcttcctgggctgccag

SEQ ID NO: 156603 - DNA, 22 bp, Artificial Sequence
  chemically synthesized
cctgggctgccaggttcaaggc

SEQ ID NO: 156604 - DNA, 22 bp, Artificial Sequence
  chemically synthesized
ctgggctgccaggttcaaggcc

SEQ ID NO: 156605 - DNA, 22 bp, Artificial Sequence
  chemically synthesized
ggctgccaggttcaaggccctt

SEQ ID NO: 156606 - DNA, 22 bp, Artificial Sequence
  chemically synthesized
ccaggttcaaggcccttagtac

SEQ ID NO: 156607 - DNA, 22 bp, Artificial Sequence
  chemically synthesized
aaggcccttagtacgtgcggct

SEQ ID NO: 156608 - DNA, 22 bp, Artificial Sequence
  chemically synthesized
agtacgtgcggctctcatatct

SEQ ID NO: 156609 - DNA, 22 bp, Artificial Sequence
  chemically synthesized
gtacgtgcggctctcatatctg

SEQ ID NO: 156610 - DNA, 22 bp, Artificial Sequence
  chemically synthesized
tcatatctgtgtcatatttatg

SEQ ID NO: 156611 - DNA, 22 bp, Artificial Sequence
  chemically synthesized
atatctgtgtcatatttatgtt

SEQ ID NO: 156612 - DNA, 22 bp, Artificial Sequence
  chemically synthesized
tgtcatatttatgttctatacc

SEQ ID NO: 156613 - DNA, 22 bp, Artificial Sequence
  chemically synthesized
atgttctataccccagcattct

SEQ ID NO: 156614 - DNA, 22 bp, Artificial Sequence
  chemically synthesized
tgttctataccccagcattctt

SEQ ID NO: 156615 - DNA, 22 bp, Artificial Sequence
  chemically synthesized
tataccccagcattcttttcat

SEQ ID NO: 156616 - DNA, 22 bp, Artificial Sequence
  chemically synthesized
taccccagcattcttttcattt

SEQ ID NO: 156617 - DNA, 22 bp, Artificial Sequence
  chemically synthesized
ttttcatttcttgcccatcgct

SEQ ID NO: 156618 - DNA, 22 bp, Artificial Sequence
  chemically synthesized
ttcatttcttgcccatcgcttt

SEQ ID NO: 156619 - DNA, 22 bp, Artificial Sequence
  chemically synthesized
tcatttcttgcccatcgctttg

SEQ ID NO: 156620 - DNA, 22 bp, Artificial Sequence
  chemically synthesized
catttcttgcccatcgctttgg

SEQ ID NO: 156621 - DNA, 22 bp, Artificial Sequence
  chemically synthesized
atttcttgcccatcgctttgga

SEQ ID NO: 156622 - DNA, 22 bp, Artificial Sequence
  chemically synthesized
cttgcccatcgctttggaggta

SEQ ID NO: 156623 - DNA, 22 bp, Artificial Sequence
  chemically synthesized
ttgcccatcgctttggaggtaa

SEQ ID NO: 156624 - DNA, 22 bp, Artificial Sequence
  chemically synthesized
gcccatcgctttggaggtaaaa

SEQ ID NO: 156625 - DNA, 22 bp, Artificial Sequence
  chemically synthesized
cccatcgctttggaggtaaaac

SEQ ID NO: 156626 - DNA, 22 bp, Artificial Sequence
  chemically synthesized
tggaggtaaaaccatccctcac

SEQ ID NO: 156627 - DNA, 22 bp, Artificial Sequence
  chemically synthesized
ggaggtaaaaccatccctcacc

SEQ ID NO: 156628 - DNA, 22 bp, Artificial Sequence
  chemically synthesized
gaggtaaaaccatccctcacca

SEQ ID NO: 156629 - DNA, 22 bp, Artificial Sequence
  chemically synthesized
accacattcacatcctagtggg

SEQ ID NO: 156630 - DNA, 22 bp, Artificial Sequence
  chemically synthesized
acatcctagtgggcagtctcta

SEQ ID NO: 156631 - DNA, 22 bp, Artificial Sequence
  chemically synthesized
gtgggcagtctctatgtgttag

SEQ ID NO: 156632 - DNA, 22 bp, Artificial Sequence
  chemically synthesized
tatgtgttagtgccccctatgc

SEQ ID NO: 156633 - DNA, 22 bp, Artificial Sequence
  chemically synthesized
tgtgttagtgccccctatgcta

SEQ ID NO: 156634 - DNA, 22 bp, Artificial Sequence
  chemically synthesized
gtgccccctatgctaaacccca

SEQ ID NO: 156635 - DNA, 22 bp, Artificial Sequence
  chemically synthesized
tgctaaaccccatcatttatgg

SEQ ID NO: 156636 - DNA, 22 bp, Artificial Sequence
  chemically synthesized
aaccccatcatttatggggtga

SEQ ID NO: 156637 - DNA, 22 bp, Artificial Sequence
  chemically synthesized
atggggtgaagaccaaacaaat

SEQ ID NO: 156638 - DNA, 22 bp, Artificial Sequence
  chemically synthesized
tggggtgaagaccaaacaaatt

SEQ ID NO: 156639 - DNA, 22 bp, Artificial Sequence
  chemically synthesized
aagatcgagtgattttgctttt

SEQ ID NO: 156640 - DNA, 22 bp, Artificial Sequence
  chemically synthesized
tgcttttctctcctatcagtgt

SEQ ID NO: 156641 - DNA, 22 bp, Artificial Sequence
  chemically synthesized
gcttttctctcctatcagtgta

SEQ ID NO: 156642 - DNA, 22 bp, Artificial Sequence
  chemically synthesized
cttttctctcctatcagtgtat

SEQ ID NO: 156643 - DNA, 22 bp, Artificial Sequence
  chemically synthesized
ttctctcctatcagtgtatgct

SEQ ID NO: 156644 - DNA, 22 bp, Artificial Sequence
  chemically synthesized
tctctcctatcagtgtatgctg

SEQ ID NO: 156645 - DNA, 22 bp, Artificial Sequence
  chemically synthesized
ctctcctatcagtgtatgctgt

SEQ ID NO: 156646 - DNA, 22 bp, Artificial Sequence
  chemically synthesized
tctcctatcagtgtatgctgtt

SEQ ID NO: 156647 - DNA, 22 bp, Artificial Sequence
  chemically synthesized
tcctatcagtgtatgctgttaa

SEQ ID NO: 156648 - DNA, 22 bp, Artificial Sequence
  chemically synthesized
ctatcagtgtatgctgttaaga

SEQ ID NO: 156649 - DNA, 22 bp, Artificial Sequence
  chemically synthesized
tcagtgtatgctgttaagatta

SEQ ID NO: 156650 - DNA, 22 bp, Artificial Sequence
  chemically synthesized
ttaagattaaaaagtctgtttt

SEQ ID NO: 156651 - DNA, 22 bp, Artificial Sequence
  chemically synthesized
agattaaaaagtctgttttagg

SEQ ID NO: 156652 - DNA, 22 bp, Artificial Sequence
  chemically synthesized
aaaagtctgttttagggaatag

SEQ ID NO: 156653 - DNA, 22 bp, Artificial Sequence
  chemically synthesized
ttttagggaatagaataaatac

SEQ ID NO: 156654 - DNA, 22 bp, Artificial Sequence
  chemically synthesized
tagggaatagaataaatacaat

SEQ ID NO: 156655 - DNA, 22 bp, Artificial Sequence
  chemically synthesized
agggaatagaataaatacaatc

SEQ ID NO: 156656 - DNA, 22 bp, Artificial Sequence
  chemically synthesized
gggaatagaataaatacaatcc

SEQ ID NO: 156657 - DNA, 22 bp, Artificial Sequence
  chemically synthesized
aaacacacttaaaatgatggtg

SEQ ID NO: 156658 - DNA, 22 bp, Artificial Sequence
  chemically synthesized
aaaatgatggtgtctatcaaag

SEQ ID NO: 156659 - DNA, 22 bp, Artificial Sequence
  chemically synthesized
aaatgatggtgtctatcaaagt

SEQ ID NO: 156660 - DNA, 22 bp, Artificial Sequence
  chemically synthesized
tcaaagtgtccacggaattttg

SEQ ID NO: 156661 - DNA, 22 bp, Artificial Sequence
  chemically synthesized
tgctaaggcactcaaagatcaa

SEQ ID NO: 156662 - DNA, 22 bp, Artificial Sequence
  chemically synthesized
gctaaggcactcaaagatcaaa

SEQ ID NO: 156663 - DNA, 22 bp, Artificial Sequence
  chemically synthesized
ctaaggcactcaaagatcaaag

SEQ ID NO: 156664 - DNA, 22 bp, Artificial Sequence
  chemically synthesized
aggcactcaaagatcaaaggtt

SEQ ID NO: 156665 - DNA, 22 bp, Artificial Sequence
  chemically synthesized
aaagatcaaaggttttgaaaaa

SEQ ID NO: 156666 - DNA, 22 bp, Artificial Sequence
  chemically synthesized
tgaaaaaaaaaatactttaatg

SEQ ID NO: 156667 - DNA, 22 bp, Artificial Sequence
  chemically synthesized
gaaaaaaaaaatactttaatga

SEQ ID NO: 156668 - DNA, 22 bp, Artificial Sequence
  chemically synthesized
aaaaaaaaaatactttaatgaa

SEQ ID NO: 156669 - DNA, 22 bp, Artificial Sequence
  chemically synthesized
taatgaaattctccattttttc

SEQ ID NO: 156670 - DNA, 22 bp, Artificial Sequence
  chemically synthesized
aatgaaattctccattttttca

SEQ ID NO: 156671 - DNA, 22 bp, Artificial Sequence
  chemically synthesized
atgaaattctccattttttcag

SEQ ID NO: 156672 - DNA, 22 bp, Artificial Sequence
  chemically synthesized
tccattttttcagaaatactat

SEQ ID NO: 156673 - DNA, 22 bp, Artificial Sequence
  chemically synthesized
cattttttcagaaatactattt

SEQ ID NO: 156674 - DNA, 22 bp, Artificial Sequence
  chemically synthesized
tttcagaaatactattttcatg

SEQ ID NO: 156675 - DNA, 22 bp, Artificial Sequence
  chemically synthesized
ttcagaaatactattttcatga

SEQ ID NO: 156676 - DNA, 22 bp, Artificial Sequence
  chemically synthesized
tcagaaatactattttcatgaa

SEQ ID NO: 156677 - DNA, 22 bp, Artificial Sequence
  chemically synthesized
cagaaatactattttcatgaat

SEQ ID NO: 156678 - DNA, 22 bp, Artificial Sequence
  chemically synthesized
agaaatactattttcatgaatt

SEQ ID NO: 156679 - DNA, 22 bp, Artificial Sequence
  chemically synthesized
ttttcatgaattttaacttaaa

SEQ ID NO: 156680 - DNA, 22 bp, Artificial Sequence
  chemically synthesized
tcatgaattttaacttaaaaat

SEQ ID NO: 156681 - DNA, 22 bp, Artificial Sequence
  chemically synthesized
catgaattttaacttaaaaata

SEQ ID NO: 156682 - DNA, 22 bp, Artificial Sequence
  chemically synthesized
atgaattttaacttaaaaatat

SEQ ID NO: 156683 - DNA, 22 bp, Artificial Sequence
  chemically synthesized
taacttaaaaatatataaagat

SEQ ID NO: 156684 - DNA, 22 bp, Artificial Sequence
  chemically synthesized
aacttaaaaatatataaagata

SEQ ID NO: 156685 - DNA, 22 bp, Artificial Sequence
  chemically synthesized
acttaaaaatatataaagataa

SEQ ID NO: 156686 - DNA, 22 bp, Artificial Sequence
  chemically synthesized
aaaaatatataaagataatcga

SEQ ID NO: 156687 - DNA, 22 bp, Artificial Sequence
  chemically synthesized
aaaatatataaagataatcgag

SEQ ID NO: 156688 - DNA, 22 bp, Artificial Sequence
  chemically synthesized
tagggtttaatccagattgact

SEQ ID NO: 156689 - DNA, 22 bp, Artificial Sequence
  chemically synthesized
agggtttaatccagattgactt

SEQ ID NO: 156690 - DNA, 22 bp, Artificial Sequence
  chemically synthesized
gggtttaatccagattgacttt

SEQ ID NO: 156691 - DNA, 22 bp, Artificial Sequence
  chemically synthesized
aatccagattgacttttcctac

SEQ ID NO: 156692 - DNA, 22 bp, Artificial Sequence
  chemically synthesized
atccagattgacttttcctacg

SEQ ID NO: 156693 - DNA, 22 bp, Artificial Sequence
  chemically synthesized
acttttcctacgtagagctagg

SEQ ID NO: 156694 - DNA, 22 bp, Artificial Sequence
  chemically synthesized
ttcctacgtagagctaggaagt

SEQ ID NO: 156695 - DNA, 22 bp, Artificial Sequence
  chemically synthesized
tcctacgtagagctaggaagtg

SEQ ID NO: 156696 - DNA, 22 bp, Artificial Sequence
  chemically synthesized
cctacgtagagctaggaagtgg

SEQ ID NO: 156697 - DNA, 22 bp, Artificial Sequence
  chemically synthesized
ctacgtagagctaggaagtggg

SEQ ID NO: 156698 - DNA, 22 bp, Artificial Sequence
  chemically synthesized
cgtagagctaggaagtggggtt

SEQ ID NO: 156699 - DNA, 22 bp, Artificial Sequence
  chemically synthesized
ggaagtggggttttgagtcagt

SEQ ID NO: 156700 - DNA, 22 bp, Artificial Sequence
  chemically synthesized
tgagtcagtcactgggcttttt

SEQ ID NO: 156701 - DNA, 22 bp, Artificial Sequence
  chemically synthesized
gagtcagtcactgggcttttta

SEQ ID NO: 156702 - DNA, 22 bp, Artificial Sequence
  chemically synthesized
agtcagtcactgggctttttat

SEQ ID NO: 156703 - DNA, 22 bp, Artificial Sequence
  chemically synthesized
ggctttttatagtcagtctgaa

SEQ ID NO: 156704 - DNA, 22 bp, Artificial Sequence
  chemically synthesized
tttatagtcagtctgaaattct

SEQ ID NO: 156705 - DNA, 22 bp, Artificial Sequence
  chemically synthesized
ttatagtcagtctgaaattctg

SEQ ID NO: 156706 - DNA, 22 bp, Artificial Sequence
  chemically synthesized
tatagtcagtctgaaattctgc

SEQ ID NO: 156707 - DNA, 22 bp, Artificial Sequence
  chemically synthesized
atagtcagtctgaaattctgct

SEQ ID NO: 156708 - DNA, 22 bp, Artificial Sequence
  chemically synthesized
tagtcagtctgaaattctgctg

SEQ ID NO: 156709 - DNA, 22 bp, Artificial Sequence
  chemically synthesized
aaattctgctgaaatgtacaac

SEQ ID NO: 156710 - DNA, 22 bp, Artificial Sequence
  chemically synthesized
tgctgaaatgtacaacactccc

SEQ ID NO: 156711 - DNA, 22 bp, Artificial Sequence
  chemically synthesized
ctgaaatgtacaacactcccgc

SEQ ID NO: 156712 - DNA, 22 bp, Artificial Sequence
  chemically synthesized
aaatgtacaacactcccgctgt

SEQ ID NO: 156713 - DNA, 22 bp, Artificial Sequence
  chemically synthesized
ccgctgtactctgcagagactt

SEQ ID NO: 156714 - DNA, 22 bp, Artificial Sequence
  chemically synthesized
tactctgcagagacttgaacca

SEQ ID NO: 156715 - DNA, 22 bp, Artificial Sequence
  chemically synthesized
tgcagagacttgaaccaataac

SEQ ID NO: 156716 - DNA, 22 bp, Artificial Sequence
  chemically synthesized
cagagacttgaaccaataacat

SEQ ID NO: 156717 - DNA, 22 bp, Artificial Sequence
  chemically synthesized
gaaccaataacatgaagccata

SEQ ID NO: 156718 - DNA, 22 bp, Artificial Sequence
  chemically synthesized
aaccaataacatgaagccataa

SEQ ID NO: 156719 - DNA, 22 bp, Artificial Sequence
  chemically synthesized
tttttgtcaacacctgttactt

SEQ ID NO: 156720 - DNA, 22 bp, Artificial Sequence
  chemically synthesized
ttgtcaacacctgttacttaag

SEQ ID NO: 156721 - DNA, 22 bp, Artificial Sequence
  chemically synthesized
tgtcaacacctgttacttaagt

SEQ ID NO: 156722 - DNA, 22 bp, Artificial Sequence
  chemically synthesized
gtcaacacctgttacttaagtt

SEQ ID NO: 156723 - DNA, 22 bp, Artificial Sequence
  chemically synthesized
tcaacacctgttacttaagtta

SEQ ID NO: 156724 - DNA, 22 bp, Artificial Sequence
  chemically synthesized
ttacttaagttaaaatgttatc

SEQ ID NO: 156725 - DNA, 22 bp, Artificial Sequence
  chemically synthesized
cttaagttaaaatgttatccct

SEQ ID NO: 156726 - DNA, 22 bp, Artificial Sequence
  chemically synthesized
aagttaaaatgttatccctaga

SEQ ID NO: 156727 - DNA, 22 bp, Artificial Sequence
  chemically synthesized
agttaaaatgttatccctagaa

SEQ ID NO: 156728 - DNA, 22 bp, Artificial Sequence
  chemically synthesized
aaatgttatccctagaatattt

SEQ ID NO: 156729 - DNA, 22 bp, Artificial Sequence
  chemically synthesized
tccctagaatattttctaactc

SEQ ID NO: 156730 - DNA, 22 bp, Artificial Sequence
  chemically synthesized
gaatattttctaactcactgac

SEQ ID NO: 156731 - DNA, 22 bp, Artificial Sequence
  chemically synthesized
tctaactcactgacatctcaca

SEQ ID NO: 156732 - DNA, 22 bp, Artificial Sequence
  chemically synthesized
ctaactcactgacatctcacaa

SEQ ID NO: 156733 - DNA, 22 bp, Artificial Sequence
  chemically synthesized
taactcactgacatctcacaaa

SEQ ID NO: 156734 - DNA, 22 bp, Artificial Sequence
  chemically synthesized
actcactgacatctcacaaagt

SEQ ID NO: 156735 - DNA, 22 bp, Artificial Sequence
  chemically synthesized
actgacatctcacaaagtctct

SEQ ID NO: 156736 - DNA, 22 bp, Artificial Sequence
  chemically synthesized
acatctcacaaagtctcttgta

SEQ ID NO: 156737 - DNA, 22 bp, Artificial Sequence
  chemically synthesized
acaaagtctcttgtatggaata

SEQ ID NO: 156738 - DNA, 22 bp, Artificial Sequence
  chemically synthesized
ttgtatggaatagacacataat

SEQ ID NO: 156739 - DNA, 22 bp, Artificial Sequence
  chemically synthesized
gtatggaatagacacataatac

SEQ ID NO: 156740 - DNA, 22 bp, Artificial Sequence
  chemically synthesized
tatggaatagacacataataca

SEQ ID NO: 156741 - DNA, 22 bp, Artificial Sequence
  chemically synthesized
aacaagtgaataatagtgaatt

SEQ ID NO: 156742 - DNA, 22 bp, Artificial Sequence
  chemically synthesized
aagcaaataataaccaatatta

SEQ ID NO: 156743 - DNA, 22 bp, Artificial Sequence
  chemically synthesized
aattaacaaatatgagattgcc

SEQ ID NO: 156744 - DNA, 22 bp, Artificial Sequence
  chemically synthesized
acaaatatgagattgcctggat

SEQ ID NO: 156745 - DNA, 22 bp, Artificial Sequence
  chemically synthesized
cctggatgatgtaaaatctgat

SEQ ID NO: 156746 - DNA, 22 bp, Artificial Sequence
  chemically synthesized
gatgatgtaaaatctgatacac

SEQ ID NO: 156747 - DNA, 22 bp, Artificial Sequence
  chemically synthesized
atacacatttccccctatagtg

SEQ ID NO: 156748 - DNA, 22 bp, Artificial Sequence
  chemically synthesized
ccccctatagtggagattttag

SEQ ID NO: 156749 - DNA, 22 bp, Artificial Sequence
  chemically synthesized
cccctatagtggagattttaga

SEQ ID NO: 156750 - DNA, 22 bp, Artificial Sequence
  chemically synthesized
tagtggagattttagacccaag

SEQ ID NO: 156751 - DNA, 22 bp, Artificial Sequence
  chemically synthesized
tagacccaagtcatcaatggag

SEQ ID NO: 156752 - DNA, 22 bp, Artificial Sequence
  chemically synthesized
agacccaagtcatcaatggagc

SEQ ID NO: 156753 - DNA, 22 bp, Artificial Sequence
  chemically synthesized
gacccaagtcatcaatggagca

SEQ ID NO: 156754 - DNA, 22 bp, Artificial Sequence
  chemically synthesized
aagaagtaaaatgattgaaaat

SEQ ID NO: 156755 - DNA, 22 bp, Artificial Sequence
  chemically synthesized
aaaatttctatacctgggtgat

SEQ ID NO: 156756 - DNA, 22 bp, Artificial Sequence
  chemically synthesized
ctatacctgggtgataaataaa

SEQ ID NO: 156757 - DNA, 22 bp, Artificial Sequence
  chemically synthesized
tatacctgggtgataaataaat

SEQ ID NO: 156758 - DNA, 22 bp, Artificial Sequence
  chemically synthesized
tacctgggtgataaataaattt

SEQ ID NO: 156759 - DNA, 22 bp, Artificial Sequence
  chemically synthesized
ggtgataaataaatttttaaaa

SEQ ID NO: 156760 - DNA, 22 bp, Artificial Sequence
  chemically synthesized
ttaaaataaacattttttaaaa

SEQ ID NO: 156761 - DNA, 22 bp, Artificial Sequence
  chemically synthesized
taaaataaacattttttaaaaa

SEQ ID NO: 156762 - DNA, 22 bp, Artificial Sequence
  chemically synthesized
aaaataaacattttttaaaaag

SEQ ID NO: 156763 - DNA, 22 bp, Artificial Sequence
  chemically synthesized
aaataaacattttttaaaaagc

SEQ ID NO: 156764 - DNA, 22 bp, Artificial Sequence
  chemically synthesized
tttaaaaagctagagaagatta

SEQ ID NO: 156765 - DNA, 22 bp, Artificial Sequence
  chemically synthesized
ttaaaaagctagagaagattaa

SEQ ID NO: 156766 - DNA, 22 bp, Artificial Sequence
  chemically synthesized
taaaaagctagagaagattaag

SEQ ID NO: 156767 - DNA, 22 bp, Artificial Sequence
  chemically synthesized
aaaaagctagagaagattaagg

SEQ ID NO: 156768 - DNA, 22 bp, Artificial Sequence
  chemically synthesized
aaaagctagagaagattaagga

SEQ ID NO: 156769 - DNA, 22 bp, Artificial Sequence
  chemically synthesized
gagaagattaaggagaatattt

SEQ ID NO: 156770 - DNA, 22 bp, Artificial Sequence
  chemically synthesized
aggagaatattttccaagaaac

SEQ ID NO: 156771 - DNA, 22 bp, Artificial Sequence
  chemically synthesized
tccaagaaacttaaataaaaaa

SEQ ID NO: 156772 - DNA, 22 bp, Artificial Sequence
  chemically synthesized
ccaagaaacttaaataaaaaag

SEQ ID NO: 156773 - DNA, 22 bp, Artificial Sequence
  chemically synthesized
caagaaacttaaataaaaaaga

SEQ ID NO: 156774 - DNA, 22 bp, Artificial Sequence
  chemically synthesized
aaataaaaaagaatgtaatccc

SEQ ID NO: 156775 - DNA, 22 bp, Artificial Sequence
  chemically synthesized
aataaaaaagaatgtaatccca

SEQ ID NO: 156776 - DNA, 22 bp, Artificial Sequence
  chemically synthesized
tctatgatattatctacagact

SEQ ID NO: 156777 - DNA, 22 bp, Artificial Sequence
  chemically synthesized
tgatattatctacagactatac

SEQ ID NO: 156778 - DNA, 22 bp, Artificial Sequence
  chemically synthesized
tctacagactataccttaatcc

SEQ ID NO: 156779 - DNA, 22 bp, Artificial Sequence
  chemically synthesized
cagactataccttaatcccttc

SEQ ID NO: 156780 - DNA, 22 bp, Artificial Sequence
  chemically synthesized
taccttaatcccttcacatcaa

SEQ ID NO: 156781 - DNA, 22 bp, Artificial Sequence
  chemically synthesized
aatcccttcacatcaatacaaa

SEQ ID NO: 156782 - DNA, 22 bp, Artificial Sequence
  chemically synthesized
atcccttcacatcaatacaaat

SEQ ID NO: 156783 - DNA, 22 bp, Artificial Sequence
  chemically synthesized
cacatcaatacaaatttttaca

SEQ ID NO: 156784 - DNA, 22 bp, Artificial Sequence
  chemically synthesized
acatcaatacaaatttttacaa

SEQ ID NO: 156785 - DNA, 22 bp, Artificial Sequence
  chemically synthesized
ttacaatctctccttcttaaaa

SEQ ID NO: 156786 - DNA, 22 bp, Artificial Sequence
  chemically synthesized
tacaatctctccttcttaaaag

SEQ ID NO: 156787 - DNA, 22 bp, Artificial Sequence
  chemically synthesized
acaatctctccttcttaaaagc

SEQ ID NO: 156788 - DNA, 22 bp, Artificial Sequence
  chemically synthesized
caatctctccttcttaaaagcc

SEQ ID NO: 156789 - DNA, 22 bp, Artificial Sequence
  chemically synthesized
tccttcttaaaagcctagaaca

SEQ ID NO: 156790 - DNA, 22 bp, Artificial Sequence
  chemically synthesized
cttcttaaaagcctagaacaat

SEQ ID NO: 156791 - DNA, 22 bp, Artificial Sequence
  chemically synthesized
cttaaaagcctagaacaatgcc

SEQ ID NO: 156792 - DNA, 22 bp, Artificial Sequence
  chemically synthesized
ttaaaagcctagaacaatgcca

SEQ ID NO: 156793 - DNA, 22 bp, Artificial Sequence
  chemically synthesized
aaaagcctagaacaatgccatg

SEQ ID NO: 156794 - DNA, 22 bp, Artificial Sequence
  chemically synthesized
aaagcctagaacaatgccatga

SEQ ID NO: 156795 - DNA, 22 bp, Artificial Sequence
  chemically synthesized
gaacaatgccatgagaatgttt

SEQ ID NO: 156796 - DNA, 22 bp, Artificial Sequence
  chemically synthesized
aaaaaatgaccttatttacacc

SEQ ID NO: 156797 - DNA, 22 bp, Artificial Sequence
  chemically synthesized
aaaaatgaccttatttacacct

SEQ ID NO: 156798 - DNA, 22 bp, Artificial Sequence
  chemically synthesized
atttacacctaaagaaagacaa

SEQ ID NO: 156799 - DNA, 22 bp, Artificial Sequence
  chemically synthesized
tttacacctaaagaaagacaaa

SEQ ID NO: 156800 - DNA, 22 bp, Artificial Sequence
  chemically synthesized
acacctaaagaaagacaaaaaa

SEQ ID NO: 156801 - DNA, 22 bp, Artificial Sequence
  chemically synthesized
cacctaaagaaagacaaaaaaa

SEQ ID NO: 156802 - DNA, 22 bp, Artificial Sequence
  chemically synthesized
aagaaagacaaaaaaaaaactt

SEQ ID NO: 156803 - DNA, 22 bp, Artificial Sequence
  chemically synthesized
tgagaaatctgaggtactatct

SEQ ID NO: 156804 - DNA, 22 bp, Artificial Sequence
  chemically synthesized
gagaaatctgaggtactatctt

SEQ ID NO: 156805 - DNA, 22 bp, Artificial Sequence
  chemically synthesized
agaaatctgaggtactatctta

SEQ ID NO: 156806 - DNA, 22 bp, Artificial Sequence
  chemically synthesized
aggtactatcttaaacacttga

SEQ ID NO: 156807 - DNA, 22 bp, Artificial Sequence
  chemically synthesized
tcttaaacacttgaaatctact

SEQ ID NO: 156808 - DNA, 22 bp, Artificial Sequence
  chemically synthesized
aaacacttgaaatctactcatg

SEQ ID NO: 156809 - DNA, 22 bp, Artificial Sequence
  chemically synthesized
aacacttgaaatctactcatgc

SEQ ID NO: 156810 - DNA, 22 bp, Artificial Sequence
  chemically synthesized
gaaatctactcatgcttggctt

SEQ ID NO: 156811 - DNA, 22 bp, Artificial Sequence
  chemically synthesized
aaatctactcatgcttggctta

SEQ ID NO: 156812 - DNA, 22 bp, Artificial Sequence
  chemically synthesized
ctcatgcttggcttatgcttag

SEQ ID NO: 156813 - DNA, 22 bp, Artificial Sequence
  chemically synthesized
atgcttggcttatgcttagctt

SEQ ID NO: 156814 - DNA, 22 bp, Artificial Sequence
  chemically synthesized
ggcttatgcttagctttttctg

SEQ ID NO: 156815 - DNA, 22 bp, Artificial Sequence
  chemically synthesized
gcttatgcttagctttttctgt

SEQ ID NO: 156816 - DNA, 22 bp, Artificial Sequence
  chemically synthesized
atgcttagctttttctgtgatt

SEQ ID NO: 156817 - DNA, 22 bp, Artificial Sequence
  chemically synthesized
tgcttagctttttctgtgattt

SEQ ID NO: 156818 - DNA, 22 bp, Artificial Sequence
  chemically synthesized
agctttttctgtgatttttata

SEQ ID NO: 156819 - DNA, 22 bp, Artificial Sequence
  chemically synthesized
gctttttctgtgatttttatag

SEQ ID NO: 156820 - DNA, 22 bp, Artificial Sequence
  chemically synthesized
tttctgtgatttttatagaaat

SEQ ID NO: 156821 - DNA, 22 bp, Artificial Sequence
  chemically synthesized
ttctgtgatttttatagaaatt

SEQ ID NO: 156822 - DNA, 22 bp, Artificial Sequence
  chemically synthesized
tctgtgatttttatagaaattt

SEQ ID NO: 156823 - DNA, 22 bp, Artificial Sequence
  chemically synthesized
ctgtgatttttatagaaattta

SEQ ID NO: 156824 - DNA, 22 bp, Artificial Sequence
  chemically synthesized
tgtgatttttatagaaatttat

SEQ ID NO: 156825 - DNA, 22 bp, Artificial Sequence
  chemically synthesized
tgatttttatagaaatttatac

SEQ ID NO: 156826 - DNA, 22 bp, Artificial Sequence
  chemically synthesized
ttatagaaatttatacatgtat

SEQ ID NO: 156827 - DNA, 22 bp, Artificial Sequence
  chemically synthesized
tatagaaatttatacatgtatt

SEQ ID NO: 156828 - DNA, 22 bp, Artificial Sequence
  chemically synthesized
atagaaatttatacatgtatta

SEQ ID NO: 156829 - DNA, 22 bp, Artificial Sequence
  chemically synthesized
tagaaatttatacatgtattaa

SEQ ID NO: 156830 - DNA, 22 bp, Artificial Sequence
  chemically synthesized
atacatgtattaacacttagat

SEQ ID NO: 156831 - DNA, 22 bp, Artificial Sequence
  chemically synthesized
tacatgtattaacacttagatt

SEQ ID NO: 156832 - DNA, 22 bp, Artificial Sequence
  chemically synthesized
acacttagatttacatatacac

SEQ ID NO: 156833 - DNA, 22 bp, Artificial Sequence
  chemically synthesized
agatttacatatacacacactt

SEQ ID NO: 156834 - DNA, 22 bp, Artificial Sequence
  chemically synthesized
gatttacatatacacacactta

SEQ ID NO: 156835 - DNA, 22 bp, Artificial Sequence
  chemically synthesized
acatatacacacacttaattta

SEQ ID NO: 156836 - DNA, 22 bp, Artificial Sequence
  chemically synthesized
catatacacacacttaatttat

SEQ ID NO: 156837 - DNA, 22 bp, Artificial Sequence
  chemically synthesized
aatttatctacatttatatgtg

SEQ ID NO: 156838 - DNA, 22 bp, Artificial Sequence
  chemically synthesized
atttatctacatttatatgtgg

SEQ ID NO: 156839 - DNA, 22 bp, Artificial Sequence
  chemically synthesized
atctacatttatatgtggatgt

SEQ ID NO: 156840 - DNA, 22 bp, Artificial Sequence
  chemically synthesized
tctacatttatatgtggatgta

SEQ ID NO: 156841 - DNA, 22 bp, Artificial Sequence
  chemically synthesized
catttatatgtggatgtacctt

SEQ ID NO: 156842 - DNA, 22 bp, Artificial Sequence
  chemically synthesized
atatgtggatgtaccttcatat

SEQ ID NO: 156843 - DNA, 22 bp, Artificial Sequence
  chemically synthesized
tatgtggatgtaccttcatata

SEQ ID NO: 156844 - DNA, 22 bp, Artificial Sequence
  chemically synthesized
catatatatgtacacacacaca

SEQ ID NO: 156845 - DNA, 22 bp, Artificial Sequence
  chemically synthesized
atatatatgtacacacacacac

SEQ ID NO: 156846 - DNA, 22 bp, Artificial Sequence
  chemically synthesized
gtgcaccaaagaataagaaagt

SEQ ID NO: 156847 - DNA, 22 bp, Artificial Sequence
  chemically synthesized
tgcaccaaagaataagaaagtt

SEQ ID NO: 156848 - DNA, 22 bp, Artificial Sequence
  chemically synthesized
gaaatagacttcctacagtatt

SEQ ID NO: 156849 - DNA, 22 bp, Artificial Sequence
  chemically synthesized
cctacagtatttccattattgg

SEQ ID NO: 156850 - DNA, 22 bp, Artificial Sequence
  chemically synthesized
ctacagtatttccattattggg

SEQ ID NO: 156851 - DNA, 22 bp, Artificial Sequence
  chemically synthesized
cagtatttccattattgggaag

SEQ ID NO: 156852 - DNA, 22 bp, Artificial Sequence
  chemically synthesized
ccattattgggaagggagaata

SEQ ID NO: 156853 - DNA, 22 bp, Artificial Sequence
  chemically synthesized
cattattgggaagggagaatac

SEQ ID NO: 156854 - DNA, 22 bp, Artificial Sequence
  chemically synthesized
ttgggaagggagaatacataaa

SEQ ID NO: 156855 - DNA, 22 bp, Artificial Sequence
  chemically synthesized
ggaagggagaatacataaaaca

SEQ ID NO: 156856 - DNA, 22 bp, Artificial Sequence
  chemically synthesized
taaaaaatctaattaatttgtt

SEQ ID NO: 156857 - DNA, 22 bp, Artificial Sequence
  chemically synthesized
aaaaatctaattaatttgtttc

SEQ ID NO: 156858 - DNA, 22 bp, Artificial Sequence
  chemically synthesized
attaatttgtttctgctagtac

SEQ ID NO: 156859 - DNA, 22 bp, Artificial Sequence
  chemically synthesized
atttgtttctgctagtactaca

SEQ ID NO: 156860 - DNA, 22 bp, Artificial Sequence
  chemically synthesized
gtttctgctagtactacactaa

SEQ ID NO: 156861 - DNA, 22 bp, Artificial Sequence
  chemically synthesized
tttctgctagtactacactaaa

SEQ ID NO: 156862 - DNA, 22 bp, Artificial Sequence
  chemically synthesized
ctgctagtactacactaaatat

SEQ ID NO: 156863 - DNA, 22 bp, Artificial Sequence
  chemically synthesized
tgctagtactacactaaatatt

SEQ ID NO: 156864 - DNA, 22 bp, Artificial Sequence
  chemically synthesized
ctagtactacactaaatattta

SEQ ID NO: 156865 - DNA, 22 bp, Artificial Sequence
  chemically synthesized
gtactacactaaatatttaagt

SEQ ID NO: 156866 - DNA, 22 bp, Artificial Sequence
  chemically synthesized
cactaaatatttaagtgctatt

SEQ ID NO: 156867 - DNA, 22 bp, Artificial Sequence
  chemically synthesized
aatatttaagtgctattttgaa

SEQ ID NO: 156868 - DNA, 22 bp, Artificial Sequence
  chemically synthesized
aagtgctattttgaattgtctt

SEQ ID NO: 156869 - DNA, 22 bp, Artificial Sequence
  chemically synthesized
agtgctattttgaattgtcttc

SEQ ID NO: 156870 - DNA, 22 bp, Artificial Sequence
  chemically synthesized
ttttgaattgtcttcaaaatat

SEQ ID NO: 156871 - DNA, 22 bp, Artificial Sequence
  chemically synthesized
tgaattgtcttcaaaatatttg

SEQ ID NO: 156872 - DNA, 22 bp, Artificial Sequence
  chemically synthesized
gaattgtcttcaaaatatttgc

SEQ ID NO: 156873 - DNA, 22 bp, Artificial Sequence
  chemically synthesized
aattgtcttcaaaatatttgca

SEQ ID NO: 156874 - DNA, 22 bp, Artificial Sequence
  chemically synthesized
tcttcaaaatatttgcatttct

SEQ ID NO: 156875 - DNA, 22 bp, Artificial Sequence
  chemically synthesized
caaaatatttgcatttctcagt

SEQ ID NO: 156876 - DNA, 22 bp, Artificial Sequence
  chemically synthesized
aaaatatttgcatttctcagta

SEQ ID NO: 156877 - DNA, 22 bp, Artificial Sequence
  chemically synthesized
gcatttctcagtacatctgtta

SEQ ID NO: 156878 - DNA, 22 bp, Artificial Sequence
  chemically synthesized
catttctcagtacatctgttaa

SEQ ID NO: 156879 - DNA, 22 bp, Artificial Sequence
  chemically synthesized
ctcagtacatctgttaaacttc

SEQ ID NO: 156880 - DNA, 22 bp, Artificial Sequence
  chemically synthesized
tcagtacatctgttaaacttca

SEQ ID NO: 156881 - DNA, 22 bp, Artificial Sequence
  chemically synthesized
agtacatctgttaaacttcata

SEQ ID NO: 156882 - DNA, 22 bp, Artificial Sequence
  chemically synthesized
ttaaacttcatatagttttttt

SEQ ID NO: 156883 - DNA, 22 bp, Artificial Sequence
  chemically synthesized
aacttcatatagtttttttttc

SEQ ID NO: 156884 - DNA, 22 bp, Artificial Sequence
  chemically synthesized
catatagtttttttttctactc

SEQ ID NO: 156885 - DNA, 22 bp, Artificial Sequence
  chemically synthesized
atatagtttttttttctactct

SEQ ID NO: 156886 - DNA, 22 bp, Artificial Sequence
  chemically synthesized
ttttttctactctacacaatgt

SEQ ID NO: 156887 - DNA, 22 bp, Artificial Sequence
  chemically synthesized
tttttctactctacacaatgtt

SEQ ID NO: 156888 - DNA, 22 bp, Artificial Sequence
  chemically synthesized
ttttctactctacacaatgttt

SEQ ID NO: 156889 - DNA, 22 bp, Artificial Sequence
  chemically synthesized
tttctactctacacaatgtttt

SEQ ID NO: 156890 - DNA, 22 bp, Artificial Sequence
  chemically synthesized
ttctactctacacaatgttttg

SEQ ID NO: 156891 - DNA, 22 bp, Artificial Sequence
  chemically synthesized
tctactctacacaatgttttgg

SEQ ID NO: 156892 - DNA, 22 bp, Artificial Sequence
  chemically synthesized
ctactctacacaatgttttgga

SEQ ID NO: 156893 - DNA, 22 bp, Artificial Sequence
  chemically synthesized
tactctacacaatgttttggac

SEQ ID NO: 156894 - DNA, 22 bp, Artificial Sequence
  chemically synthesized
ctctacacaatgttttggacat

SEQ ID NO: 156895 - DNA, 22 bp, Artificial Sequence
  chemically synthesized
tacacaatgttttggacattct

SEQ ID NO: 156896 - DNA, 22 bp, Artificial Sequence
  chemically synthesized
cacaatgttttggacattctaa

SEQ ID NO: 156897 - DNA, 22 bp, Artificial Sequence
  chemically synthesized
tggacattctaatgtgaaattt

SEQ ID NO: 156898 - DNA, 22 bp, Artificial Sequence
  chemically synthesized
ggacattctaatgtgaaattta

SEQ ID NO: 156899 - DNA, 22 bp, Artificial Sequence
  chemically synthesized
gacattctaatgtgaaatttac

SEQ ID NO: 156900 - DNA, 22 bp, Artificial Sequence
  chemically synthesized
taatgtgaaatttacactcagc

SEQ ID NO: 156901 - DNA, 22 bp, Artificial Sequence
  chemically synthesized
atgtgaaatttacactcagcgt

SEQ ID NO: 156902 - DNA, 22 bp, Artificial Sequence
  chemically synthesized
acactcagcgttgcatttctcc

SEQ ID NO: 156903 - DNA, 22 bp, Artificial Sequence
  chemically synthesized
cactcagcgttgcatttctcca

SEQ ID NO: 156904 - DNA, 22 bp, Artificial Sequence
  chemically synthesized
agcgttgcatttctccataaaa

SEQ ID NO: 156905 - DNA, 22 bp, Artificial Sequence
  chemically synthesized
catttctccataaaagtaataa

SEQ ID NO: 156906 - DNA, 22 bp, Artificial Sequence
  chemically synthesized
ctccataaaagtaataatatga

SEQ ID NO: 156907 - DNA, 22 bp, Artificial Sequence
  chemically synthesized
tccataaaagtaataatatgat

SEQ ID NO: 156908 - DNA, 22 bp, Artificial Sequence
  chemically synthesized
cataaaagtaataatatgatgg

SEQ ID NO: 156909 - DNA, 22 bp, Artificial Sequence
  chemically synthesized
cagtatgatgacagaggatttg

SEQ ID NO: 156910 - DNA, 22 bp, Artificial Sequence
  chemically synthesized
gactgaaaggtaggaagatttt

SEQ ID NO: 156911 - DNA, 22 bp, Artificial Sequence
  chemically synthesized
actgaaaggtaggaagattttg

SEQ ID NO: 156912 - DNA, 22 bp, Artificial Sequence
  chemically synthesized
aaaggtaggaagattttgtata

SEQ ID NO: 156913 - DNA, 22 bp, Artificial Sequence
  chemically synthesized
tgtatacttgattttagcagtg

SEQ ID NO: 156914 - DNA, 22 bp, Artificial Sequence
  chemically synthesized
gtatacttgattttagcagtgg

SEQ ID NO: 156915 - DNA, 22 bp, Artificial Sequence
  chemically synthesized
tatacttgattttagcagtggg

SEQ ID NO: 156916 - DNA, 22 bp, Artificial Sequence
  chemically synthesized
gattttagcagtggggagctaa

SEQ ID NO: 156917 - DNA, 22 bp, Artificial Sequence
  chemically synthesized
attttagcagtggggagctaag

SEQ ID NO: 156918 - DNA, 22 bp, Artificial Sequence
  chemically synthesized
tagcagtggggagctaagaaaa

SEQ ID NO: 156919 - DNA, 22 bp, Artificial Sequence
  chemically synthesized
agcagtggggagctaagaaaat

SEQ ID NO: 156920 - DNA, 22 bp, Artificial Sequence
  chemically synthesized
gcagtggggagctaagaaaatg

SEQ ID NO: 156921 - DNA, 22 bp, Artificial Sequence
  chemically synthesized
agaaaatgccaatttcacatcc

SEQ ID NO: 156922 - DNA, 22 bp, Artificial Sequence
  chemically synthesized
cacatccaaaatgcatgcaaca

SEQ ID NO: 156923 - DNA, 22 bp, Artificial Sequence
  chemically synthesized
acatccaaaatgcatgcaacat

SEQ ID NO: 156924 - DNA, 22 bp, Artificial Sequence
  chemically synthesized
aaataggtatatgaatatatat

SEQ ID NO: 156925 - DNA, 22 bp, Artificial Sequence
  chemically synthesized
aataggtatatgaatatatata

SEQ ID NO: 156926 - DNA, 22 bp, Artificial Sequence
  chemically synthesized
cacagtaacatatacatgtcat

SEQ ID NO: 156927 - DNA, 22 bp, Artificial Sequence
  chemically synthesized
tgacagttaaaatggtagaagt

SEQ ID NO: 156928 - DNA, 22 bp, Artificial Sequence
  chemically synthesized
gacagttaaaatggtagaagta

SEQ ID NO: 156929 - DNA, 22 bp, Artificial Sequence
  chemically synthesized
acagttaaaatggtagaagtaa

SEQ ID NO: 156930 - DNA, 22 bp, Artificial Sequence
  chemically synthesized
aaatggtagaagtaaaaatgat

SEQ ID NO: 156931 - DNA, 22 bp, Artificial Sequence
  chemically synthesized
aatttacaatctctaaataaac

SEQ ID NO: 156932 - DNA, 22 bp, Artificial Sequence
  chemically synthesized
acaatctctaaataaactttca

SEQ ID NO: 156933 - DNA, 22 bp, Artificial Sequence
  chemically synthesized
caatctctaaataaactttcag

SEQ ID NO: 156934 - DNA, 22 bp, Artificial Sequence
  chemically synthesized
taaataaactttcagttgagca

SEQ ID NO: 156935 - DNA, 22 bp, Artificial Sequence
  chemically synthesized
aataaactttcagttgagcact

SEQ ID NO: 156936 - DNA, 22 bp, Artificial Sequence
  chemically synthesized
tcagttgagcactcagattctg

SEQ ID NO: 156937 - DNA, 22 bp, Artificial Sequence
  chemically synthesized
cagttgagcactcagattctga

SEQ ID NO: 156938 - DNA, 22 bp, Artificial Sequence
  chemically synthesized
agttgagcactcagattctgaa

SEQ ID NO: 156939 - DNA, 22 bp, Artificial Sequence
  chemically synthesized
agcactcagattctgaaaggat

SEQ ID NO: 156940 - DNA, 22 bp, Artificial Sequence
  chemically synthesized
agattctgaaaggatttaggaa

SEQ ID NO: 156941 - DNA, 22 bp, Artificial Sequence
  chemically synthesized
tgaaaggatttaggaaatggct

SEQ ID NO: 156942 - DNA, 22 bp, Artificial Sequence
  chemically synthesized
aaaggatttaggaaatggctgt

SEQ ID NO: 156943 - DNA, 22 bp, Artificial Sequence
  chemically synthesized
aggaaatggctgttgctatgca

SEQ ID NO: 156944 - DNA, 22 bp, Artificial Sequence
  chemically synthesized
ggaaatggctgttgctatgcag

SEQ ID NO: 156945 - DNA, 22 bp, Artificial Sequence
  chemically synthesized
ttgctatgcagctgctgaattt

SEQ ID NO: 156946 - DNA, 22 bp, Artificial Sequence
  chemically synthesized
ctatgcagctgctgaatttaac

SEQ ID NO: 156947 - DNA, 22 bp, Artificial Sequence
  chemically synthesized
tgcagctgctgaatttaacatt

SEQ ID NO: 156948 - DNA, 22 bp, Artificial Sequence
  chemically synthesized
ctgaatttaacattactgagcc

SEQ ID NO: 156949 - DNA, 22 bp, Artificial Sequence
  chemically synthesized
aatttaacattactgagccatt

SEQ ID NO: 156950 - DNA, 22 bp, Artificial Sequence
  chemically synthesized
aacattactgagccattgccct

SEQ ID NO: 156951 - DNA, 22 bp, Artificial Sequence
  chemically synthesized
acattactgagccattgccctg

SEQ ID NO: 156952 - DNA, 22 bp, Artificial Sequence
  chemically synthesized
ctgagccattgccctggacatg

SEQ ID NO: 156953 - DNA, 22 bp, Artificial Sequence
  chemically synthesized
agccattgccctggacatgaga

SEQ ID NO: 156954 - DNA, 22 bp, Artificial Sequence
  chemically synthesized
ccctggacatgagaagaagttt

SEQ ID NO: 156955 - DNA, 22 bp, Artificial Sequence
  chemically synthesized
gacatgagaagaagttttcatg

SEQ ID NO: 156956 - DNA, 22 bp, Artificial Sequence
  chemically synthesized
tcatgttctactgtctccttaa

SEQ ID NO: 156957 - DNA, 22 bp, Artificial Sequence
  chemically synthesized
catgttctactgtctccttaac

SEQ ID NO: 156958 - DNA, 22 bp, Artificial Sequence
  chemically synthesized
atgttctactgtctccttaacc

SEQ ID NO: 156959 - DNA, 22 bp, Artificial Sequence
  chemically synthesized
tactgtctccttaaccagtaat

SEQ ID NO: 156960 - DNA, 22 bp, Artificial Sequence
  chemically synthesized
ctgtctccttaaccagtaatcc

SEQ ID NO: 156961 - DNA, 22 bp, Artificial Sequence
  chemically synthesized
tctccttaaccagtaatccttc

SEQ ID NO: 156962 - DNA, 22 bp, Artificial Sequence
  chemically synthesized
cttaaccagtaatccttcagca

SEQ ID NO: 156963 - DNA, 22 bp, Artificial Sequence
  chemically synthesized
aaccagtaatccttcagcagga

SEQ ID NO: 156964 - DNA, 22 bp, Artificial Sequence
  chemically synthesized
accagtaatccttcagcaggaa

SEQ ID NO: 156965 - DNA, 22 bp, Artificial Sequence
  chemically synthesized
cagcaggaagggaaagggaaag

SEQ ID NO: 156966 - DNA, 22 bp, Artificial Sequence
  chemically synthesized
agcaggaagggaaagggaaagg

SEQ ID NO: 156967 - DNA, 22 bp, Artificial Sequence
  chemically synthesized
taaagcagggagttttggaagc

SEQ ID NO: 156968 - DNA, 22 bp, Artificial Sequence
  chemically synthesized
aaagcagggagttttggaagca

SEQ ID NO: 156969 - DNA, 22 bp, Artificial Sequence
  chemically synthesized
aagcagggagttttggaagcac

SEQ ID NO: 156970 - DNA, 22 bp, Artificial Sequence
  chemically synthesized
tggaagcacttagctaaaactg

SEQ ID NO: 156971 - DNA, 22 bp, Artificial Sequence
  chemically synthesized
ggaagcacttagctaaaactga

SEQ ID NO: 156972 - DNA, 22 bp, Artificial Sequence
  chemically synthesized
gaagcacttagctaaaactgat

SEQ ID NO: 156973 - DNA, 22 bp, Artificial Sequence
  chemically synthesized
agctaaaactgatatggtgttc

SEQ ID NO: 156974 - DNA, 22 bp, Artificial Sequence
  chemically synthesized
gctaaaactgatatggtgttct

SEQ ID NO: 156975 - DNA, 22 bp, Artificial Sequence
  chemically synthesized
aaactgatatggtgttctagac

SEQ ID NO: 156976 - DNA, 22 bp, Artificial Sequence
  chemically synthesized
atatggtgttctagacagaatt

SEQ ID NO: 156977 - DNA, 22 bp, Artificial Sequence
  chemically synthesized
tagacagaattagcaaaaacaa

SEQ ID NO: 156978 - DNA, 22 bp, Artificial Sequence
  chemically synthesized
gacagaattagcaaaaacaaaa

SEQ ID NO: 156979 - DNA, 22 bp, Artificial Sequence
  chemically synthesized
gcaaaaacaaaaaacaaaaggt

SEQ ID NO: 156980 - DNA, 22 bp, Artificial Sequence
  chemically synthesized
agtgattgataaggtgagaata

SEQ ID NO: 156981 - DNA, 22 bp, Artificial Sequence
  chemically synthesized
ataaggtgagaatagtatttca

SEQ ID NO: 156982 - DNA, 22 bp, Artificial Sequence
  chemically synthesized
caaatgagcaagagatccaaga

SEQ ID NO: 156983 - DNA, 22 bp, Artificial Sequence
  chemically synthesized
aaatgagcaagagatccaagac

SEQ ID NO: 156984 - DNA, 22 bp, Artificial Sequence
  chemically synthesized
cagactattgttttataactga

SEQ ID NO: 156985 - DNA, 22 bp, Artificial Sequence
  chemically synthesized
ttgttttataactgaggtctta

SEQ ID NO: 156986 - DNA, 22 bp, Artificial Sequence
  chemically synthesized
ttttataactgaggtcttagtt

SEQ ID NO: 156987 - DNA, 22 bp, Artificial Sequence
  chemically synthesized
tataactgaggtcttagttaat

SEQ ID NO: 156988 - DNA, 22 bp, Artificial Sequence
  chemically synthesized
ataactgaggtcttagttaata

SEQ ID NO: 156989 - DNA, 22 bp, Artificial Sequence
  chemically synthesized
taactgaggtcttagttaatat

SEQ ID NO: 156990 - DNA, 22 bp, Artificial Sequence
  chemically synthesized
aggtcttagttaatatcaatca

SEQ ID NO: 156991 - DNA, 22 bp, Artificial Sequence
  chemically synthesized
agttaatatcaatcaagcaaaa

SEQ ID NO: 156992 - DNA, 22 bp, Artificial Sequence
  chemically synthesized
gttaatatcaatcaagcaaaat

SEQ ID NO: 156993 - DNA, 22 bp, Artificial Sequence
  chemically synthesized
atatcaatcaagcaaaattttg

SEQ ID NO: 156994 - DNA, 22 bp, Artificial Sequence
  chemically synthesized
tgatttcggggggagaaaaaag

SEQ ID NO: 156995 - DNA, 22 bp, Artificial Sequence
  chemically synthesized
gatttcggggggagaaaaaaga

SEQ ID NO: 156996 - DNA, 22 bp, Artificial Sequence
  chemically synthesized
atttcggggggagaaaaaagac

SEQ ID NO: 156997 - DNA, 22 bp, Artificial Sequence
  chemically synthesized
cggggggagaaaaaagaccaaa

SEQ ID NO: 156998 - DNA, 22 bp, Artificial Sequence
  chemically synthesized
ggggggagaaaaaagaccaaat

SEQ ID NO: 156999 - DNA, 22 bp, Artificial Sequence
  chemically synthesized
taatctggggtgtatttcttta

SEQ ID NO: 157000 - DNA, 22 bp, Artificial Sequence
  chemically synthesized
gggtgtatttctttatttacat

SEQ ID NO: 157001 - DNA, 22 bp, Artificial Sequence
  chemically synthesized
ctttatttacatctttgccttt

SEQ ID NO: 157002 - DNA, 22 bp, Artificial Sequence
  chemically synthesized
tttatttacatctttgccttta

SEQ ID NO: 157003 - DNA, 22 bp, Artificial Sequence
  chemically synthesized
tatttacatctttgcctttatt

SEQ ID NO: 157004 - DNA, 22 bp, Artificial Sequence
  chemically synthesized
atttacatctttgcctttattt

SEQ ID NO: 157005 - DNA, 22 bp, Artificial Sequence
  chemically synthesized
tttacatctttgcctttatttt

SEQ ID NO: 157006 - DNA, 22 bp, Artificial Sequence
  chemically synthesized
acatctttgcctttatttttta

SEQ ID NO: 157007 - DNA, 22 bp, Artificial Sequence
  chemically synthesized
catctttgcctttattttttaa

SEQ ID NO: 157008 - DNA, 22 bp, Artificial Sequence
  chemically synthesized
tgcctttattttttaactttct

SEQ ID NO: 157009 - DNA, 22 bp, Artificial Sequence
  chemically synthesized
gcctttattttttaactttctt

SEQ ID NO: 157010 - DNA, 22 bp, Artificial Sequence
  chemically synthesized
cctttattttttaactttcttt

SEQ ID NO: 157011 - DNA, 22 bp, Artificial Sequence
  chemically synthesized
tattttttaactttcttttgta

SEQ ID NO: 157012 - DNA, 22 bp, Artificial Sequence
  chemically synthesized
attttttaactttcttttgtat

SEQ ID NO: 157013 - DNA, 22 bp, Artificial Sequence
  chemically synthesized
ttttttaactttcttttgtata

SEQ ID NO: 157014 - DNA, 22 bp, Artificial Sequence
  chemically synthesized
tttaactttcttttgtatatga

SEQ ID NO: 157015 - DNA, 22 bp, Artificial Sequence
  chemically synthesized
ttaactttcttttgtatatgat

SEQ ID NO: 157016 - DNA, 22 bp, Artificial Sequence
  chemically synthesized
taactttcttttgtatatgata

SEQ ID NO: 157017 - DNA, 22 bp, Artificial Sequence
  chemically synthesized
aactttcttttgtatatgatat

SEQ ID NO: 157018 - DNA, 22 bp, Artificial Sequence
  chemically synthesized
actttcttttgtatatgatatg

SEQ ID NO: 157019 - DNA, 22 bp, Artificial Sequence
  chemically synthesized
tcttttgtatatgatatgatca

SEQ ID NO: 157020 - DNA, 22 bp, Artificial Sequence
  chemically synthesized
cttttgtatatgatatgatcat

SEQ ID NO: 157021 - DNA, 22 bp, Artificial Sequence
  chemically synthesized
ttttgtatatgatatgatcatt

SEQ ID NO: 157022 - DNA, 22 bp, Artificial Sequence
  chemically synthesized
ttgtatatgatatgatcattta

SEQ ID NO: 157023 - DNA, 22 bp, Artificial Sequence
  chemically synthesized
tgtatatgatatgatcatttaa

SEQ ID NO: 157024 - DNA, 22 bp, Artificial Sequence
  chemically synthesized
gtatatgatatgatcatttaag

SEQ ID NO: 157025 - DNA, 22 bp, Artificial Sequence
  chemically synthesized
tatatgatatgatcatttaagt

SEQ ID NO: 157026 - DNA, 22 bp, Artificial Sequence
  chemically synthesized
aagtataagtcacctgaaagta

SEQ ID NO: 157027 - DNA, 22 bp, Artificial Sequence
  chemically synthesized
agtataagtcacctgaaagtaa

SEQ ID NO: 157028 - DNA, 22 bp, Artificial Sequence
  chemically synthesized
aaagtaaaaagagttatataag

SEQ ID NO: 157029 - DNA, 22 bp, Artificial Sequence
  chemically synthesized
tataaggacaacataaaaatca

SEQ ID NO: 157030 - DNA, 22 bp, Artificial Sequence
  chemically synthesized
tatgcaactgcaagaaccaata

SEQ ID NO: 157031 - DNA, 22 bp, Artificial Sequence
  chemically synthesized
atgcaactgcaagaaccaatag

SEQ ID NO: 157032 - DNA, 22 bp, Artificial Sequence
  chemically synthesized
tgcaactgcaagaaccaatagg

SEQ ID NO: 157033 - DNA, 22 bp, Artificial Sequence
  chemically synthesized
caagaaccaataggaaaataga

SEQ ID NO: 157034 - DNA, 22 bp, Artificial Sequence
  chemically synthesized
aaaatgatgatagaggccagac

SEQ ID NO: 157035 - DNA, 22 bp, Artificial Sequence
  chemically synthesized
taatcccagctacatgggaggc

SEQ ID NO: 157036 - DNA, 22 bp, Artificial Sequence
  chemically synthesized
catgggaggctgaggcaggaga

SEQ ID NO: 157037 - DNA, 22 bp, Artificial Sequence
  chemically synthesized
aggcaggagaatgatttgaatt

SEQ ID NO: 157038 - DNA, 22 bp, Artificial Sequence
  chemically synthesized
gaattctggaggcggaggttgc

SEQ ID NO: 157039 - DNA, 22 bp, Artificial Sequence
  chemically synthesized
aattctggaggcggaggttgca

SEQ ID NO: 157040 - DNA, 22 bp, Artificial Sequence
  chemically synthesized
tggaggcggaggttgcagtgag

SEQ ID NO: 157041 - DNA, 22 bp, Artificial Sequence
  chemically synthesized
gaggcggaggttgcagtgagcc

SEQ ID NO: 157042 - DNA, 22 bp, Artificial Sequence
  chemically synthesized
cagtgagccgagatcgcgtcac

SEQ ID NO: 157043 - DNA, 22 bp, Artificial Sequence
  chemically synthesized
actctagcctggaccacagaga

SEQ ID NO: 157044 - DNA, 22 bp, Artificial Sequence
  chemically synthesized
tagcctggaccacagagagaga

SEQ ID NO: 157045 - DNA, 22 bp, Artificial Sequence
  chemically synthesized
gcctggaccacagagagagact

SEQ ID NO: 157046 - DNA, 22 bp, Artificial Sequence
  chemically synthesized
gaccacagagagagactccatc

SEQ ID NO: 157047 - DNA, 22 bp, Artificial Sequence
  chemically synthesized
catctcaaaaaaaccaaaaata

SEQ ID NO: 157048 - DNA, 22 bp, Artificial Sequence
  chemically synthesized
aaaaaaaccaaaaatacgtaaa

SEQ ID NO: 157049 - DNA, 22 bp, Artificial Sequence
  chemically synthesized
tatatgtgcctaaaataaatga

SEQ ID NO: 157050 - DNA, 22 bp, Artificial Sequence
  chemically synthesized
aaataaatgaaataattgttta

SEQ ID NO: 157051 - DNA, 22 bp, Artificial Sequence
  chemically synthesized
tttattatacattgtttattgt

SEQ ID NO: 157052 - DNA, 22 bp, Artificial Sequence
  chemically synthesized
attatacattgtttattgtaac

SEQ ID NO: 157053 - DNA, 22 bp, Artificial Sequence
  chemically synthesized
ttatacattgtttattgtaaca

SEQ ID NO: 157054 - DNA, 22 bp, Artificial Sequence
  chemically synthesized
tacattgtttattgtaacaatt

SEQ ID NO: 157055 - DNA, 22 bp, Artificial Sequence
  chemically synthesized
tttattgtaacaattctctcag

SEQ ID NO: 157056 - DNA, 22 bp, Artificial Sequence
  chemically synthesized
attgtaacaattctctcagaaa

SEQ ID NO: 157057 - DNA, 22 bp, Artificial Sequence
  chemically synthesized
ttgtaacaattctctcagaaac

SEQ ID NO: 157058 - DNA, 22 bp, Artificial Sequence
  chemically synthesized
taacaattctctcagaaacaac

SEQ ID NO: 157059 - DNA, 22 bp, Artificial Sequence
  chemically synthesized
tctcagaaacaactcataataa

SEQ ID NO: 157060 - DNA, 22 bp, Artificial Sequence
  chemically synthesized
tcagaaacaactcataataaat

SEQ ID NO: 157061 - DNA, 22 bp, Artificial Sequence
  chemically synthesized
agaaacaactcataataaattc

SEQ ID NO: 157062 - DNA, 22 bp, Artificial Sequence
  chemically synthesized
ataataaattcaattcaaccct

SEQ ID NO: 157063 - DNA, 22 bp, Artificial Sequence
  chemically synthesized
aattcaaccctaatcaaaataa

SEQ ID NO: 157064 - DNA, 22 bp, Artificial Sequence
  chemically synthesized
aaccctaatcaaaataaaaatt

SEQ ID NO: 157065 - DNA, 22 bp, Artificial Sequence
  chemically synthesized
atcaaaataaaaatttgtcttg

SEQ ID NO: 157066 - DNA, 22 bp, Artificial Sequence
  chemically synthesized
gtcttgttttaaatttctttcc

SEQ ID NO: 157067 - DNA, 22 bp, Artificial Sequence
  chemically synthesized
tcttgttttaaatttctttcca

SEQ ID NO: 157068 - DNA, 22 bp, Artificial Sequence
  chemically synthesized
gttttaaatttctttccatttt

SEQ ID NO: 157069 - DNA, 22 bp, Artificial Sequence
  chemically synthesized
ttttaaatttctttccattttt

SEQ ID NO: 157070 - DNA, 22 bp, Artificial Sequence
  chemically synthesized
taaatttctttccatttttatt

SEQ ID NO: 157071 - DNA, 22 bp, Artificial Sequence
  chemically synthesized
aaatttctttccatttttattg

SEQ ID NO: 157072 - DNA, 22 bp, Artificial Sequence
  chemically synthesized
aatttctttccatttttattgt

SEQ ID NO: 157073 - DNA, 22 bp, Artificial Sequence
  chemically synthesized
ctttccatttttattgtgataa

SEQ ID NO: 157074 - DNA, 22 bp, Artificial Sequence
  chemically synthesized
tttccatttttattgtgataaa

SEQ ID NO: 157075 - DNA, 22 bp, Artificial Sequence
  chemically synthesized
tccatttttattgtgataaagt

SEQ ID NO: 157076 - DNA, 22 bp, Artificial Sequence
  chemically synthesized
ccatttttattgtgataaagtt

SEQ ID NO: 157077 - DNA, 22 bp, Artificial Sequence
  chemically synthesized
catttttattgtgataaagttt

SEQ ID NO: 157078 - DNA, 22 bp, Artificial Sequence
  chemically synthesized
ttattgtgataaagtttataaa

SEQ ID NO: 157079 - DNA, 22 bp, Artificial Sequence
  chemically synthesized
tattgtgataaagtttataaat

SEQ ID NO: 157080 - DNA, 22 bp, Artificial Sequence
  chemically synthesized
attgtgataaagtttataaata

SEQ ID NO: 157081 - DNA, 22 bp, Artificial Sequence
  chemically synthesized
ttgtgataaagtttataaatat

SEQ ID NO: 157082 - DNA, 22 bp, Artificial Sequence
  chemically synthesized
tgataaagtttataaatatgct

SEQ ID NO: 157083 - DNA, 22 bp, Artificial Sequence
  chemically synthesized
ataaatatgctacatataatac

SEQ ID NO: 157084 - DNA, 22 bp, Artificial Sequence
  chemically synthesized
taaatatgctacatataatacc

SEQ ID NO: 157085 - DNA, 22 bp, Artificial Sequence
  chemically synthesized
catataataccgtatatcatat

SEQ ID NO: 157086 - DNA, 22 bp, Artificial Sequence
  chemically synthesized
accatattaaccatttttaagt

SEQ ID NO: 157087 - DNA, 22 bp, Artificial Sequence
  chemically synthesized
accatttttaagtataattatg

SEQ ID NO: 157088 - DNA, 22 bp, Artificial Sequence
  chemically synthesized
ttaagtataattatgtggcatt

SEQ ID NO: 157089 - DNA, 22 bp, Artificial Sequence
  chemically synthesized
taagtataattatgtggcatta

SEQ ID NO: 157090 - DNA, 22 bp, Artificial Sequence
  chemically synthesized
aagtataattatgtggcattaa

SEQ ID NO: 157091 - DNA, 22 bp, Artificial Sequence
  chemically synthesized
agtataattatgtggcattaat

SEQ ID NO: 157092 - DNA, 22 bp, Artificial Sequence
  chemically synthesized
tgtggcattaattatattaaca

SEQ ID NO: 157093 - DNA, 22 bp, Artificial Sequence
  chemically synthesized
attatattaacaatattgtgcc

SEQ ID NO: 157094 - DNA, 22 bp, Artificial Sequence
  chemically synthesized
tattaacaatattgtgccgcta

SEQ ID NO: 157095 - DNA, 22 bp, Artificial Sequence
  chemically synthesized
acaatattgtgccgctatcacc

SEQ ID NO: 157096 - DNA, 22 bp, Artificial Sequence
  chemically synthesized
tgccgctatcaccatgatctca

SEQ ID NO: 157097 - DNA, 22 bp, Artificial Sequence
  chemically synthesized
tcaccatgatctcatgccaaaa

SEQ ID NO: 157098 - DNA, 22 bp, Artificial Sequence
  chemically synthesized
atgccaaaactttttcatcatc

SEQ ID NO: 157099 - DNA, 22 bp, Artificial Sequence
  chemically synthesized
tttcatcatccaagcagaaatg

SEQ ID NO: 157100 - DNA, 22 bp, Artificial Sequence
  chemically synthesized
ttcatcatccaagcagaaatgc

SEQ ID NO: 157101 - DNA, 22 bp, Artificial Sequence
  chemically synthesized
tcatcatccaagcagaaatgct

SEQ ID NO: 157102 - DNA, 22 bp, Artificial Sequence
  chemically synthesized
catcatccaagcagaaatgcta

SEQ ID NO: 157103 - DNA, 22 bp, Artificial Sequence
  chemically synthesized
atcatccaagcagaaatgctat

SEQ ID NO: 157104 - DNA, 22 bp, Artificial Sequence
  chemically synthesized
tacttgttaggcagtaactccc

SEQ ID NO: 157105 - DNA, 22 bp, Artificial Sequence
  chemically synthesized
gttaggcagtaactccccagtc

SEQ ID NO: 157106 - DNA, 22 bp, Artificial Sequence
  chemically synthesized
ttaggcagtaactccccagtcc

SEQ ID NO: 157107 - DNA, 22 bp, Artificial Sequence
  chemically synthesized
ggcagtaactccccagtcccat

SEQ ID NO: 157108 - DNA, 22 bp, Artificial Sequence
  chemically synthesized
cccagtcccatagtaacctcta

SEQ ID NO: 157109 - DNA, 22 bp, Artificial Sequence
  chemically synthesized
taatctactatatgtttctcta

SEQ ID NO: 157110 - DNA, 22 bp, Artificial Sequence
  chemically synthesized
atctactatatgtttctctaaa

SEQ ID NO: 157111 - DNA, 22 bp, Artificial Sequence
  chemically synthesized
ctatatgtttctctaaatcagt

SEQ ID NO: 157112 - DNA, 22 bp, Artificial Sequence
  chemically synthesized
tatgtttctctaaatcagtcta

SEQ ID NO: 157113 - DNA, 22 bp, Artificial Sequence
  chemically synthesized
ctctaaatcagtctattttaga

SEQ ID NO: 157114 - DNA, 22 bp, Artificial Sequence
  chemically synthesized
tctaaatcagtctattttagat

SEQ ID NO: 157115 - DNA, 22 bp, Artificial Sequence
  chemically synthesized
taaatcagtctattttagataa

SEQ ID NO: 157116 - DNA, 22 bp, Artificial Sequence
  chemically synthesized
aatcagtctattttagataatt

SEQ ID NO: 157117 - DNA, 22 bp, Artificial Sequence
  chemically synthesized
ttttagataattcatataaata

SEQ ID NO: 157118 - DNA, 22 bp, Artificial Sequence
  chemically synthesized
tagataattcatataaatagat

SEQ ID NO: 157119 - DNA, 22 bp, Artificial Sequence
  chemically synthesized
agataattcatataaatagatt

SEQ ID NO: 157120 - DNA, 22 bp, Artificial Sequence
  chemically synthesized
gataattcatataaatagattc

SEQ ID NO: 157121 - DNA, 22 bp, Artificial Sequence
  chemically synthesized
atataaatagattcatacaata

SEQ ID NO: 157122 - DNA, 22 bp, Artificial Sequence
  chemically synthesized
atacaatatttgttgttttgtg

SEQ ID NO: 157123 - DNA, 22 bp, Artificial Sequence
  chemically synthesized
gttgttttgtgtctggcttatt

SEQ ID NO: 157124 - DNA, 22 bp, Artificial Sequence
  chemically synthesized
ttgttttgtgtctggcttattt

SEQ ID NO: 157125 - DNA, 22 bp, Artificial Sequence
  chemically synthesized
ttttgtgtctggcttattttac

SEQ ID NO: 157126 - DNA, 22 bp, Artificial Sequence
  chemically synthesized
tgtgtctggcttattttaccca

SEQ ID NO: 157127 - DNA, 22 bp, Artificial Sequence
  chemically synthesized
gtgtctggcttattttacccaa

SEQ ID NO: 157128 - DNA, 22 bp, Artificial Sequence
  chemically synthesized
tgtctggcttattttacccaac

SEQ ID NO: 157129 - DNA, 22 bp, Artificial Sequence
  chemically synthesized
gcttattttacccaacataagg

SEQ ID NO: 157130 - DNA, 22 bp, Artificial Sequence
  chemically synthesized
attttacccaacataaggtttc

SEQ ID NO: 157131 - DNA, 22 bp, Artificial Sequence
  chemically synthesized
ttttacccaacataaggtttca

SEQ ID NO: 157132 - DNA, 22 bp, Artificial Sequence
  chemically synthesized
tacccaacataaggtttcaaag

SEQ ID NO: 157133 - DNA, 22 bp, Artificial Sequence
  chemically synthesized
acccaacataaggtttcaaagt

SEQ ID NO: 157134 - DNA, 22 bp, Artificial Sequence
  chemically synthesized
cccaacataaggtttcaaagtc

SEQ ID NO: 157135 - DNA, 22 bp, Artificial Sequence
  chemically synthesized
caaagtccatccatgccataac

SEQ ID NO: 157136 - DNA, 22 bp, Artificial Sequence
  chemically synthesized
aaagtccatccatgccataaca

SEQ ID NO: 157137 - DNA, 22 bp, Artificial Sequence
  chemically synthesized
tgcttaatgttgtccattcata

SEQ ID NO: 157138 - DNA, 22 bp, Artificial Sequence
  chemically synthesized
gcttaatgttgtccattcatag

SEQ ID NO: 157139 - DNA, 22 bp, Artificial Sequence
  chemically synthesized
cttaatgttgtccattcataga

SEQ ID NO: 157140 - DNA, 22 bp, Artificial Sequence
  chemically synthesized
aatgttgtccattcatagattc

SEQ ID NO: 157141 - DNA, 22 bp, Artificial Sequence
  chemically synthesized
atgttgtccattcatagattct

SEQ ID NO: 157142 - DNA, 22 bp, Artificial Sequence
  chemically synthesized
tccattcatagattcttggaaa

SEQ ID NO: 157143 - DNA, 22 bp, Artificial Sequence
  chemically synthesized
atagattcttggaaactgaaac

SEQ ID NO: 157144 - DNA, 22 bp, Artificial Sequence
  chemically synthesized
ttggaaactgaaactttaagcc

SEQ ID NO: 157145 - DNA, 22 bp, Artificial Sequence
  chemically synthesized
ggaaactgaaactttaagccaa

SEQ ID NO: 157146 - DNA, 22 bp, Artificial Sequence
  chemically synthesized
gaaactgaaactttaagccaag

SEQ ID NO: 157147 - DNA, 22 bp, Artificial Sequence
  chemically synthesized
aaactttaagccaagtgacata

SEQ ID NO: 157148 - DNA, 22 bp, Artificial Sequence
  chemically synthesized
taagccaagtgacatataatga

SEQ ID NO: 157149 - DNA, 22 bp, Artificial Sequence
  chemically synthesized
aagccaagtgacatataatgat

SEQ ID NO: 157150 - DNA, 22 bp, Artificial Sequence
  chemically synthesized
agccaagtgacatataatgata

SEQ ID NO: 157151 - DNA, 22 bp, Artificial Sequence
  chemically synthesized
tttttctcatctaacagtgttg

SEQ ID NO: 157152 - DNA, 22 bp, Artificial Sequence
  chemically synthesized
ttttctcatctaacagtgttgg

SEQ ID NO: 157153 - DNA, 22 bp, Artificial Sequence
  chemically synthesized
tttctcatctaacagtgttggc

SEQ ID NO: 157154 - DNA, 22 bp, Artificial Sequence
  chemically synthesized
ttctcatctaacagtgttggct

SEQ ID NO: 157155 - DNA, 22 bp, Artificial Sequence
  chemically synthesized
tctcatctaacagtgttggcta

SEQ ID NO: 157156 - DNA, 22 bp, Artificial Sequence
  chemically synthesized
ctcatctaacagtgttggctaa

SEQ ID NO: 157157 - DNA, 22 bp, Artificial Sequence
  chemically synthesized
tcatctaacagtgttggctaaa

SEQ ID NO: 157158 - DNA, 22 bp, Artificial Sequence
  chemically synthesized
atctaacagtgttggctaaaac

SEQ ID NO: 157159 - DNA, 22 bp, Artificial Sequence
  chemically synthesized
acagtgttggctaaaacagtgt

SEQ ID NO: 157160 - DNA, 22 bp, Artificial Sequence
  chemically synthesized
gctaaaacagtgttatttgagg

SEQ ID NO: 157161 - DNA, 22 bp, Artificial Sequence
  chemically synthesized
aaacagtgttatttgaggatct

SEQ ID NO: 157162 - DNA, 22 bp, Artificial Sequence
  chemically synthesized
tttgaggatctgttttacatca

SEQ ID NO: 157163 - DNA, 22 bp, Artificial Sequence
  chemically synthesized
gaggatctgttttacatcattt

SEQ ID NO: 157164 - DNA, 22 bp, Artificial Sequence
  chemically synthesized
aggatctgttttacatcatttc

SEQ ID NO: 157165 - DNA, 22 bp, Artificial Sequence
  chemically synthesized
ttttacatcatttcacttaaag

SEQ ID NO: 157166 - DNA, 22 bp, Artificial Sequence
  chemically synthesized
tacatcatttcacttaaagttg

SEQ ID NO: 157167 - DNA, 22 bp, Artificial Sequence
  chemically synthesized
acatcatttcacttaaagttgc

SEQ ID NO: 157168 - DNA, 22 bp, Artificial Sequence
  chemically synthesized
catcatttcacttaaagttgcc

SEQ ID NO: 157169 - DNA, 22 bp, Artificial Sequence
  chemically synthesized
cacttaaagttgccatttccaa

SEQ ID NO: 157170 - DNA, 22 bp, Artificial Sequence
  chemically synthesized
acttaaagttgccatttccaaa

SEQ ID NO: 157171 - DNA, 22 bp, Artificial Sequence
  chemically synthesized
aaagttgccatttccaaaaacc

SEQ ID NO: 157172 - DNA, 22 bp, Artificial Sequence
  chemically synthesized
aagttgccatttccaaaaacct

SEQ ID NO: 157173 - DNA, 22 bp, Artificial Sequence
  chemically synthesized
ccatttccaaaaacctattcat

SEQ ID NO: 157174 - DNA, 22 bp, Artificial Sequence
  chemically synthesized
ccaaaaacctattcatgacatt

SEQ ID NO: 157175 - DNA, 22 bp, Artificial Sequence
  chemically synthesized
caaaaacctattcatgacatta

SEQ ID NO: 157176 - DNA, 22 bp, Artificial Sequence
  chemically synthesized
ttcatgacattaaataaggact

SEQ ID NO: 157177 - DNA, 22 bp, Artificial Sequence
  chemically synthesized
atgacattaaataaggacttac

SEQ ID NO: 157178 - DNA, 22 bp, Artificial Sequence
  chemically synthesized
aataaggacttactgcatctgt

SEQ ID NO: 157179 - DNA, 22 bp, Artificial Sequence
  chemically synthesized
actgcatctgtacttcattctt

SEQ ID NO: 157180 - DNA, 22 bp, Artificial Sequence
  chemically synthesized
ctgcatctgtacttcattcttt

SEQ ID NO: 157181 - DNA, 22 bp, Artificial Sequence
  chemically synthesized
catctgtacttcattctttttt

SEQ ID NO: 157182 - DNA, 22 bp, Artificial Sequence
  chemically synthesized
tacttcattcttttttattgct

SEQ ID NO: 157183 - DNA, 22 bp, Artificial Sequence
  chemically synthesized
cattcttttttattgctacata

SEQ ID NO: 157184 - DNA, 22 bp, Artificial Sequence
  chemically synthesized
attcttttttattgctacataa

SEQ ID NO: 157185 - DNA, 22 bp, Artificial Sequence
  chemically synthesized
ttttttattgctacataatatt

SEQ ID NO: 157186 - DNA, 22 bp, Artificial Sequence
  chemically synthesized
ttttattgctacataatattcc

SEQ ID NO: 157187 - DNA, 22 bp, Artificial Sequence
  chemically synthesized
tttattgctacataatattcca

SEQ ID NO: 157188 - DNA, 22 bp, Artificial Sequence
  chemically synthesized
ttattgctacataatattccat

SEQ ID NO: 157189 - DNA, 22 bp, Artificial Sequence
  chemically synthesized
tattgctacataatattccatt

SEQ ID NO: 157190 - DNA, 22 bp, Artificial Sequence
  chemically synthesized
attgctacataatattccattg

SEQ ID NO: 157191 - DNA, 22 bp, Artificial Sequence
  chemically synthesized
ttgctacataatattccattgt

SEQ ID NO: 157192 - DNA, 22 bp, Artificial Sequence
  chemically synthesized
ctacataatattccattgtgtg

SEQ ID NO: 157193 - DNA, 22 bp, Artificial Sequence
  chemically synthesized
cataatattccattgtgtgtat

SEQ ID NO: 157194 - DNA, 22 bp, Artificial Sequence
  chemically synthesized
cattgtgtgtatatatcacatt

SEQ ID NO: 157195 - DNA, 22 bp, Artificial Sequence
  chemically synthesized
tgtgtatatatcacatttgttt

SEQ ID NO: 157196 - DNA, 22 bp, Artificial Sequence
  chemically synthesized
gtttattcattcatctgtttat

SEQ ID NO: 157197 - DNA, 22 bp, Artificial Sequence
  chemically synthesized
tttattcattcatctgtttatg

SEQ ID NO: 157198 - DNA, 22 bp, Artificial Sequence
  chemically synthesized
attcattcatctgtttatgtac

SEQ ID NO: 157199 - DNA, 22 bp, Artificial Sequence
  chemically synthesized
ttcattcatctgtttatgtaca

SEQ ID NO: 157200 - DNA, 22 bp, Artificial Sequence
  chemically synthesized
attcatctgtttatgtacattc

SEQ ID NO: 157201 - DNA, 22 bp, Artificial Sequence
  chemically synthesized
atctgtttatgtacattctggt

SEQ ID NO: 157202 - DNA, 22 bp, Artificial Sequence
  chemically synthesized
tttatgtacattctggttgttt

SEQ ID NO: 157203 - DNA, 22 bp, Artificial Sequence
  chemically synthesized
atgtacattctggttgtttcca

SEQ ID NO: 157204 - DNA, 22 bp, Artificial Sequence
  chemically synthesized
tgtacattctggttgtttccac

SEQ ID NO: 157205 - DNA, 22 bp, Artificial Sequence
  chemically synthesized
tggttgtttccaccttttggct

SEQ ID NO: 157206 - DNA, 22 bp, Artificial Sequence
  chemically synthesized
gttgtttccaccttttggctat

SEQ ID NO: 157207 - DNA, 22 bp, Artificial Sequence
  chemically synthesized
tttccaccttttggctattgtg

SEQ ID NO: 157208 - DNA, 22 bp, Artificial Sequence
  chemically synthesized
ccaccttttggctattgtgaat

SEQ ID NO: 157209 - DNA, 22 bp, Artificial Sequence
  chemically synthesized
caccttttggctattgtgaata

SEQ ID NO: 157210 - DNA, 22 bp, Artificial Sequence
  chemically synthesized
ttggctattgtgaataatgcta

SEQ ID NO: 157211 - DNA, 22 bp, Artificial Sequence
  chemically synthesized
tggctattgtgaataatgctac

SEQ ID NO: 157212 - DNA, 22 bp, Artificial Sequence
  chemically synthesized
ggctattgtgaataatgctaca

SEQ ID NO: 157213 - DNA, 22 bp, Artificial Sequence
  chemically synthesized
gctattgtgaataatgctacaa

SEQ ID NO: 157214 - DNA, 22 bp, Artificial Sequence
  chemically synthesized
ttgtgaataatgctacaatgaa

SEQ ID NO: 157215 - DNA, 22 bp, Artificial Sequence
  chemically synthesized
tgaataatgctacaatgaacat

SEQ ID NO: 157216 - DNA, 22 bp, Artificial Sequence
  chemically synthesized
caatgaacatttcagtacaagt

SEQ ID NO: 157217 - DNA, 22 bp, Artificial Sequence
  chemically synthesized
cagtacaagtacctgtttaaat

SEQ ID NO: 157218 - DNA, 22 bp, Artificial Sequence
  chemically synthesized
agtacaagtacctgtttaaatc

SEQ ID NO: 157219 - DNA, 22 bp, Artificial Sequence
  chemically synthesized
tttaaatctttatatatatttt

SEQ ID NO: 157220 - DNA, 22 bp, Artificial Sequence
  chemically synthesized
aaatctttatatatatttttaa

SEQ ID NO: 157221 - DNA, 22 bp, Artificial Sequence
  chemically synthesized
aatctttatatatatttttaat

SEQ ID NO: 157222 - DNA, 22 bp, Artificial Sequence
  chemically synthesized
tatatatatttttaatatatac

SEQ ID NO: 157223 - DNA, 22 bp, Artificial Sequence
  chemically synthesized
atatatatttttaatatatacc

SEQ ID NO: 157224 - DNA, 22 bp, Artificial Sequence
  chemically synthesized
tatatatttttaatatatacct

SEQ ID NO: 157225 - DNA, 22 bp, Artificial Sequence
  chemically synthesized
ttaatatatacctaggagagga

SEQ ID NO: 157226 - DNA, 22 bp, Artificial Sequence
  chemically synthesized
taatatatacctaggagaggaa

SEQ ID NO: 157227 - DNA, 22 bp, Artificial Sequence
  chemically synthesized
aatatatacctaggagaggaat

SEQ ID NO: 157228 - DNA, 22 bp, Artificial Sequence
  chemically synthesized
atatatacctaggagaggaatt

SEQ ID NO: 157229 - DNA, 22 bp, Artificial Sequence
  chemically synthesized
ggagaggaattttggggtcata

SEQ ID NO: 157230 - DNA, 22 bp, Artificial Sequence
  chemically synthesized
tggggtcatatgttattcagtg

SEQ ID NO: 157231 - DNA, 22 bp, Artificial Sequence
  chemically synthesized
ggggtcatatgttattcagtgc

SEQ ID NO: 157232 - DNA, 22 bp, Artificial Sequence
  chemically synthesized
gggtcatatgttattcagtgcc

SEQ ID NO: 157233 - DNA, 22 bp, Artificial Sequence
  chemically synthesized
ttcagtgcctaagtttttgaag

SEQ ID NO: 157234 - DNA, 22 bp, Artificial Sequence
  chemically synthesized
agtgcctaagtttttgaagaac

SEQ ID NO: 157235 - DNA, 22 bp, Artificial Sequence
  chemically synthesized
agtttttgaagaactgtcaaaa

SEQ ID NO: 157236 - DNA, 22 bp, Artificial Sequence
  chemically synthesized
ttgaagaactgtcaaaatattt

SEQ ID NO: 157237 - DNA, 22 bp, Artificial Sequence
  chemically synthesized
tgaagaactgtcaaaatatttt

SEQ ID NO: 157238 - DNA, 22 bp, Artificial Sequence
  chemically synthesized
gaagaactgtcaaaatattttc

SEQ ID NO: 157239 - DNA, 22 bp, Artificial Sequence
  chemically synthesized
aagaactgtcaaaatattttct

SEQ ID NO: 157240 - DNA, 22 bp, Artificial Sequence
  chemically synthesized
tcaaaatattttctacagaagt

SEQ ID NO: 157241 - DNA, 22 bp, Artificial Sequence
  chemically synthesized
tctacagaagttgcaccactta

SEQ ID NO: 157242 - DNA, 22 bp, Artificial Sequence
  chemically synthesized
ctacagaagttgcaccacttaa

SEQ ID NO: 157243 - DNA, 22 bp, Artificial Sequence
  chemically synthesized
tacagaagttgcaccacttaac

SEQ ID NO: 157244 - DNA, 22 bp, Artificial Sequence
  chemically synthesized
cagaagttgcaccacttaacat

SEQ ID NO: 157245 - DNA, 22 bp, Artificial Sequence
  chemically synthesized
caccacttaacatttttagcag

SEQ ID NO: 157246 - DNA, 22 bp, Artificial Sequence
  chemically synthesized
aacatttttagcagcaatatat

SEQ ID NO: 157247 - DNA, 22 bp, Artificial Sequence
  chemically synthesized
acatttttagcagcaatatatg

SEQ ID NO: 157248 - DNA, 22 bp, Artificial Sequence
  chemically synthesized
ttagcagcaatatatgaggatt

SEQ ID NO: 157249 - DNA, 22 bp, Artificial Sequence
  chemically synthesized
tagcagcaatatatgaggattc

SEQ ID NO: 157250 - DNA, 22 bp, Artificial Sequence
  chemically synthesized
agcagcaatatatgaggattcc

SEQ ID NO: 157251 - DNA, 22 bp, Artificial Sequence
  chemically synthesized
gcagcaatatatgaggattcca

SEQ ID NO: 157252 - DNA, 22 bp, Artificial Sequence
  chemically synthesized
caattttcttatatctttgtca

SEQ ID NO: 157253 - DNA, 22 bp, Artificial Sequence
  chemically synthesized
tcttatatctttgtcaacactt

SEQ ID NO: 157254 - DNA, 22 bp, Artificial Sequence
  chemically synthesized
cttatatctttgtcaacacttg

SEQ ID NO: 157255 - DNA, 22 bp, Artificial Sequence
  chemically synthesized
ttatatctttgtcaacacttgt

SEQ ID NO: 157256 - DNA, 22 bp, Artificial Sequence
  chemically synthesized
atatctttgtcaacacttgtta

SEQ ID NO: 157257 - DNA, 22 bp, Artificial Sequence
  chemically synthesized
tatctttgtcaacacttgttac

SEQ ID NO: 157258 - DNA, 22 bp, Artificial Sequence
  chemically synthesized
tgtcaacacttgttacttttca

SEQ ID NO: 157259 - DNA, 22 bp, Artificial Sequence
  chemically synthesized
gtcaacacttgttacttttcat

SEQ ID NO: 157260 - DNA, 22 bp, Artificial Sequence
  chemically synthesized
tcaacacttgttacttttcatt

SEQ ID NO: 157261 - DNA, 22 bp, Artificial Sequence
  chemically synthesized
gttacttttcatttgttttgtt

SEQ ID NO: 157262 - DNA, 22 bp, Artificial Sequence
  chemically synthesized
ttacttttcatttgttttgttt

SEQ ID NO: 157263 - DNA, 22 bp, Artificial Sequence
  chemically synthesized
cttttcatttgttttgtttctc

SEQ ID NO: 157264 - DNA, 22 bp, Artificial Sequence
  chemically synthesized
ttcatttgttttgtttctctta

SEQ ID NO: 157265 - DNA, 22 bp, Artificial Sequence
  chemically synthesized
tcatttgttttgtttctcttaa

SEQ ID NO: 157266 - DNA, 22 bp, Artificial Sequence
  chemically synthesized
catttgttttgtttctcttaaa

SEQ ID NO: 157267 - DNA, 22 bp, Artificial Sequence
  chemically synthesized
atttgttttgtttctcttaaag

SEQ ID NO: 157268 - DNA, 22 bp, Artificial Sequence
  chemically synthesized
gttttgtttctcttaaagtata

SEQ ID NO: 157269 - DNA, 22 bp, Artificial Sequence
  chemically synthesized
ttttgtttctcttaaagtatag

SEQ ID NO: 157270 - DNA, 22 bp, Artificial Sequence
  chemically synthesized
tgtttctcttaaagtatagaca

SEQ ID NO: 157271 - DNA, 22 bp, Artificial Sequence
  chemically synthesized
gtttctcttaaagtatagacat

SEQ ID NO: 157272 - DNA, 22 bp, Artificial Sequence
  chemically synthesized
tttctcttaaagtatagacatt

SEQ ID NO: 157273 - DNA, 22 bp, Artificial Sequence
  chemically synthesized
ctcttaaagtatagacattcta

SEQ ID NO: 157274 - DNA, 22 bp, Artificial Sequence
  chemically synthesized
tcttaaagtatagacattctag

SEQ ID NO: 157275 - DNA, 22 bp, Artificial Sequence
  chemically synthesized
ttaaagtatagacattctagta

SEQ ID NO: 157276 - DNA, 22 bp, Artificial Sequence
  chemically synthesized
aaagtatagacattctagtaag

SEQ ID NO: 157277 - DNA, 22 bp, Artificial Sequence
  chemically synthesized
aagtatagacattctagtaagt

SEQ ID NO: 157278 - DNA, 22 bp, Artificial Sequence
  chemically synthesized
tagtaagtttgaagtagtgtct

SEQ ID NO: 157279 - DNA, 22 bp, Artificial Sequence
  chemically synthesized
gtaagtttgaagtagtgtctta

SEQ ID NO: 157280 - DNA, 22 bp, Artificial Sequence
  chemically synthesized
gaagtagtgtcttattgtggtt

SEQ ID NO: 157281 - DNA, 22 bp, Artificial Sequence
  chemically synthesized
aagtagtgtcttattgtggttt

SEQ ID NO: 157282 - DNA, 22 bp, Artificial Sequence
  chemically synthesized
attgtggttttggtttgcattt

SEQ ID NO: 157283 - DNA, 22 bp, Artificial Sequence
  chemically synthesized
ttgtggttttggtttgcatttt

SEQ ID NO: 157284 - DNA, 22 bp, Artificial Sequence
  chemically synthesized
tggttttggtttgcattttatg

SEQ ID NO: 157285 - DNA, 22 bp, Artificial Sequence
  chemically synthesized
tggtttgcattttatgtgccaa

SEQ ID NO: 157286 - DNA, 22 bp, Artificial Sequence
  chemically synthesized
ggtttgcattttatgtgccaat

SEQ ID NO: 157287 - DNA, 22 bp, Artificial Sequence
  chemically synthesized
gtttgcattttatgtgccaatg

SEQ ID NO: 157288 - DNA, 22 bp, Artificial Sequence
  chemically synthesized
gcattttatgtgccaatgttca

SEQ ID NO: 157289 - DNA, 22 bp, Artificial Sequence
  chemically synthesized
cattttatgtgccaatgttcat

SEQ ID NO: 157290 - DNA, 22 bp, Artificial Sequence
  chemically synthesized
tatgtgccaatgttcatttgta

SEQ ID NO: 157291 - DNA, 22 bp, Artificial Sequence
  chemically synthesized
atgtgccaatgttcatttgtat

SEQ ID NO: 157292 - DNA, 22 bp, Artificial Sequence
  chemically synthesized
tgtgccaatgttcatttgtata

SEQ ID NO: 157293 - DNA, 22 bp, Artificial Sequence
  chemically synthesized
atttgtatatcttctttctaga

SEQ ID NO: 157294 - DNA, 22 bp, Artificial Sequence
  chemically synthesized
gtatatcttctttctagaaatt

SEQ ID NO: 157295 - DNA, 22 bp, Artificial Sequence
  chemically synthesized
tatatcttctttctagaaatta

SEQ ID NO: 157296 - DNA, 22 bp, Artificial Sequence
  chemically synthesized
ctttctagaaattactcattcc

SEQ ID NO: 157297 - DNA, 22 bp, Artificial Sequence
  chemically synthesized
tttctagaaattactcattccc

SEQ ID NO: 157298 - DNA, 22 bp, Artificial Sequence
  chemically synthesized
tctagaaattactcattcccat

SEQ ID NO: 157299 - DNA, 22 bp, Artificial Sequence
  chemically synthesized
ctagaaattactcattcccatc

SEQ ID NO: 157300 - DNA, 22 bp, Artificial Sequence
  chemically synthesized
tagaaattactcattcccatca

SEQ ID NO: 157301 - DNA, 22 bp, Artificial Sequence
  chemically synthesized
gaaattactcattcccatcatt

SEQ ID NO: 157302 - DNA, 22 bp, Artificial Sequence
  chemically synthesized
ctcattcccatcatttgcatat

SEQ ID NO: 157303 - DNA, 22 bp, Artificial Sequence
  chemically synthesized
attcccatcatttgcatatttt

SEQ ID NO: 157304 - DNA, 22 bp, Artificial Sequence
  chemically synthesized
ccatcatttgcatatttttaaa

SEQ ID NO: 157305 - DNA, 22 bp, Artificial Sequence
  chemically synthesized
gcatatttttaaattgagttgt

SEQ ID NO: 157306 - DNA, 22 bp, Artificial Sequence
  chemically synthesized
catatttttaaattgagttgtt

SEQ ID NO: 157307 - DNA, 22 bp, Artificial Sequence
  chemically synthesized
ttaaattgagttgtttgtcttt

SEQ ID NO: 157308 - DNA, 22 bp, Artificial Sequence
  chemically synthesized
taaattgagttgtttgtctttt

SEQ ID NO: 157309 - DNA, 22 bp, Artificial Sequence
  chemically synthesized
aaattgagttgtttgtcttttt

SEQ ID NO: 157310 - DNA, 22 bp, Artificial Sequence
  chemically synthesized
aattgagttgtttgtctttttg

SEQ ID NO: 157311 - DNA, 22 bp, Artificial Sequence
  chemically synthesized
agttgtttgtctttttgttttt

SEQ ID NO: 157312 - DNA, 22 bp, Artificial Sequence
  chemically synthesized
tttgtctttttgtttttgagtt

SEQ ID NO: 157313 - DNA, 22 bp, Artificial Sequence
  chemically synthesized
gtctttttgtttttgagttgta

SEQ ID NO: 157314 - DNA, 22 bp, Artificial Sequence
  chemically synthesized
tctttttgtttttgagttgtag

SEQ ID NO: 157315 - DNA, 22 bp, Artificial Sequence
  chemically synthesized
tttgtttttgagttgtaggact

SEQ ID NO: 157316 - DNA, 22 bp, Artificial Sequence
  chemically synthesized
ttgtttttgagttgtaggactt

SEQ ID NO: 157317 - DNA, 22 bp, Artificial Sequence
  chemically synthesized
tgtttttgagttgtaggacttt

SEQ ID NO: 157318 - DNA, 22 bp, Artificial Sequence
  chemically synthesized
gtttttgagttgtaggactttt

SEQ ID NO: 157319 - DNA, 22 bp, Artificial Sequence
  chemically synthesized
tttttgagttgtaggacttttt

SEQ ID NO: 157320 - DNA, 22 bp, Artificial Sequence
  chemically synthesized
ttgagttgtaggactttttcat

SEQ ID NO: 157321 - DNA, 22 bp, Artificial Sequence
  chemically synthesized
tgagttgtaggactttttcata

SEQ ID NO: 157322 - DNA, 22 bp, Artificial Sequence
  chemically synthesized
gagttgtaggactttttcatac

SEQ ID NO: 157323 - DNA, 22 bp, Artificial Sequence
  chemically synthesized
agttgtaggactttttcataca

SEQ ID NO: 157324 - DNA, 22 bp, Artificial Sequence
  chemically synthesized
taggactttttcatacattctg

SEQ ID NO: 157325 - DNA, 22 bp, Artificial Sequence
  chemically synthesized
tttcatacattctggatattaa

SEQ ID NO: 157326 - DNA, 22 bp, Artificial Sequence
  chemically synthesized
ttcatacattctggatattaaa

SEQ ID NO: 157327 - DNA, 22 bp, Artificial Sequence
  chemically synthesized
tcatacattctggatattaaac

SEQ ID NO: 157328 - DNA, 22 bp, Artificial Sequence
  chemically synthesized
catacattctggatattaaact

SEQ ID NO: 157329 - DNA, 22 bp, Artificial Sequence
  chemically synthesized
atacattctggatattaaactt

SEQ ID NO: 157330 - DNA, 22 bp, Artificial Sequence
  chemically synthesized
tggatattaaacttatgaaata

SEQ ID NO: 157331 - DNA, 22 bp, Artificial Sequence
  chemically synthesized
gatattaaacttatgaaataca

SEQ ID NO: 157332 - DNA, 22 bp, Artificial Sequence
  chemically synthesized
aacttatgaaatacataatttg

SEQ ID NO: 157333 - DNA, 22 bp, Artificial Sequence
  chemically synthesized
atgaaatacataatttgcaaag

SEQ ID NO: 157334 - DNA, 22 bp, Artificial Sequence
  chemically synthesized
tgaaatacataatttgcaaaga

SEQ ID NO: 157335 - DNA, 22 bp, Artificial Sequence
  chemically synthesized
gcaaagatgttctctcatctta

SEQ ID NO: 157336 - DNA, 22 bp, Artificial Sequence
  chemically synthesized
caaagatgttctctcatcttat

SEQ ID NO: 157337 - DNA, 22 bp, Artificial Sequence
  chemically synthesized
tctcatcttataggttgtcttt

SEQ ID NO: 157338 - DNA, 22 bp, Artificial Sequence
  chemically synthesized
tcatcttataggttgtcttttt

SEQ ID NO: 157339 - DNA, 22 bp, Artificial Sequence
  chemically synthesized
atcttataggttgtctttttac

SEQ ID NO: 157340 - DNA, 22 bp, Artificial Sequence
  chemically synthesized
ataggttgtctttttactttct

SEQ ID NO: 157341 - DNA, 22 bp, Artificial Sequence
  chemically synthesized
taggttgtctttttactttctt

SEQ ID NO: 157342 - DNA, 22 bp, Artificial Sequence
  chemically synthesized
tctttttactttcttaaagtcg

SEQ ID NO: 157343 - DNA, 22 bp, Artificial Sequence
  chemically synthesized
tttactttcttaaagtcgtttg

SEQ ID NO: 157344 - DNA, 22 bp, Artificial Sequence
  chemically synthesized
ttactttcttaaagtcgtttgt

SEQ ID NO: 157345 - DNA, 22 bp, Artificial Sequence
  chemically synthesized
tactttcttaaagtcgtttgtt

SEQ ID NO: 157346 - DNA, 22 bp, Artificial Sequence
  chemically synthesized
actttcttaaagtcgtttgttg

SEQ ID NO: 157347 - DNA, 22 bp, Artificial Sequence
  chemically synthesized
ctttcttaaagtcgtttgttgc

SEQ ID NO: 157348 - DNA, 22 bp, Artificial Sequence
  chemically synthesized
tcttaaagtcgtttgttgcatg

SEQ ID NO: 157349 - DNA, 22 bp, Artificial Sequence
  chemically synthesized
cttaaagtcgtttgttgcatga

SEQ ID NO: 157350 - DNA, 22 bp, Artificial Sequence
  chemically synthesized
ttaaagtcgtttgttgcatgaa

SEQ ID NO: 157351 - DNA, 22 bp, Artificial Sequence
  chemically synthesized
aaagtcgtttgttgcatgaact

SEQ ID NO: 157352 - DNA, 22 bp, Artificial Sequence
  chemically synthesized
aagtcgtttgttgcatgaactt

SEQ ID NO: 157353 - DNA, 22 bp, Artificial Sequence
  chemically synthesized
gttgcatgaactttttaaatga

SEQ ID NO: 157354 - DNA, 22 bp, Artificial Sequence
  chemically synthesized
ttgcatgaactttttaaatgaa

SEQ ID NO: 157355 - DNA, 22 bp, Artificial Sequence
  chemically synthesized
catgaactttttaaatgaaatc

SEQ ID NO: 157356 - DNA, 22 bp, Artificial Sequence
  chemically synthesized
tttaaatgaaatccaatttatg

SEQ ID NO: 157357 - DNA, 22 bp, Artificial Sequence
  chemically synthesized
ttaaatgaaatccaatttatgt

SEQ ID NO: 157358 - DNA, 22 bp, Artificial Sequence
  chemically synthesized
taaatgaaatccaatttatgta

SEQ ID NO: 157359 - DNA, 22 bp, Artificial Sequence
  chemically synthesized
aaatgaaatccaatttatgtat

SEQ ID NO: 157360 - DNA, 22 bp, Artificial Sequence
  chemically synthesized
aatgaaatccaatttatgtatt

SEQ ID NO: 157361 - DNA, 22 bp, Artificial Sequence
  chemically synthesized
atgtatttattttttgttactc

SEQ ID NO: 157362 - DNA, 22 bp, Artificial Sequence
  chemically synthesized
tgtatttattttttgttactca

SEQ ID NO: 157363 - DNA, 22 bp, Artificial Sequence
  chemically synthesized
attttttgttactcatactttt

SEQ ID NO: 157364 - DNA, 22 bp, Artificial Sequence
  chemically synthesized
ttttttgttactcatacttttt

SEQ ID NO: 157365 - DNA, 22 bp, Artificial Sequence
  chemically synthesized
tttgttactcatactttttgtg

SEQ ID NO: 157366 - DNA, 22 bp, Artificial Sequence
  chemically synthesized
ttgttactcatactttttgtgt

SEQ ID NO: 157367 - DNA, 22 bp, Artificial Sequence
  chemically synthesized
tgttactcatactttttgtgtc

SEQ ID NO: 157368 - DNA, 22 bp, Artificial Sequence
  chemically synthesized
gttactcatactttttgtgtca

SEQ ID NO: 157369 - DNA, 22 bp, Artificial Sequence
  chemically synthesized
ttactcatactttttgtgtcat

SEQ ID NO: 157370 - DNA, 22 bp, Artificial Sequence
  chemically synthesized
ctcatactttttgtgtcatatc

SEQ ID NO: 157371 - DNA, 22 bp, Artificial Sequence
  chemically synthesized
atactttttgtgtcatatctaa

SEQ ID NO: 157372 - DNA, 22 bp, Artificial Sequence
  chemically synthesized
tttgtgtcatatctaagaatct

SEQ ID NO: 157373 - DNA, 22 bp, Artificial Sequence
  chemically synthesized
ttgtgtcatatctaagaatcta

SEQ ID NO: 157374 - DNA, 22 bp, Artificial Sequence
  chemically synthesized
tgtgtcatatctaagaatctat

SEQ ID NO: 157375 - DNA, 22 bp, Artificial Sequence
  chemically synthesized
gtgtcatatctaagaatctatt

SEQ ID NO: 157376 - DNA, 22 bp, Artificial Sequence
  chemically synthesized
tgtcatatctaagaatctattg

SEQ ID NO: 157377 - DNA, 22 bp, Artificial Sequence
  chemically synthesized
agaatctattgtaaaatcaaag

SEQ ID NO: 157378 - DNA, 22 bp, Artificial Sequence
  chemically synthesized
ttgtaaaatcaaagttcatgaa

SEQ ID NO: 157379 - DNA, 22 bp, Artificial Sequence
  chemically synthesized
taaaatcaaagttcatgaagat

SEQ ID NO: 157380 - DNA, 22 bp, Artificial Sequence
  chemically synthesized
atgaagatttacccatgcttcc

SEQ ID NO: 157381 - DNA, 22 bp, Artificial Sequence
  chemically synthesized
acccatgcttccttccgagggt

SEQ ID NO: 157382 - DNA, 22 bp, Artificial Sequence
  chemically synthesized
cccatgcttccttccgagggtg

SEQ ID NO: 157383 - DNA, 22 bp, Artificial Sequence
  chemically synthesized
ccttccgagggtgttatggctt

SEQ ID NO: 157384 - DNA, 22 bp, Artificial Sequence
  chemically synthesized
cttccgagggtgttatggcttt

SEQ ID NO: 157385 - DNA, 22 bp, Artificial Sequence
  chemically synthesized
ccgagggtgttatggctttagt

SEQ ID NO: 157386 - DNA, 22 bp, Artificial Sequence
  chemically synthesized
cgagggtgttatggctttagtt

SEQ ID NO: 157387 - DNA, 22 bp, Artificial Sequence
  chemically synthesized
tggctttagttcaatttaggtc

SEQ ID NO: 157388 - DNA, 22 bp, Artificial Sequence
  chemically synthesized
tagttcaatttaggtcattaca

SEQ ID NO: 157389 - DNA, 22 bp, Artificial Sequence
  chemically synthesized
agttcaatttaggtcattacac

SEQ ID NO: 157390 - DNA, 22 bp, Artificial Sequence
  chemically synthesized
gttcaatttaggtcattacaca

SEQ ID NO: 157391 - DNA, 22 bp, Artificial Sequence
  chemically synthesized
aatttaggtcattacacaattt

SEQ ID NO: 157392 - DNA, 22 bp, Artificial Sequence
  chemically synthesized
aggtcattacacaatttttatg

SEQ ID NO: 157393 - DNA, 22 bp, Artificial Sequence
  chemically synthesized
ggtcattacacaatttttatgc

SEQ ID NO: 157394 - DNA, 22 bp, Artificial Sequence
  chemically synthesized
cacaatttttatgcatgctggc

SEQ ID NO: 157395 - DNA, 22 bp, Artificial Sequence
  chemically synthesized
ttatgcatgctggcttttaatc

SEQ ID NO: 157396 - DNA, 22 bp, Artificial Sequence
  chemically synthesized
tatgcatgctggcttttaatcc

SEQ ID NO: 157397 - DNA, 22 bp, Artificial Sequence
  chemically synthesized
atgcatgctggcttttaatcct

SEQ ID NO: 157398 - DNA, 22 bp, Artificial Sequence
  chemically synthesized
tgcatgctggcttttaatcctt

SEQ ID NO: 157399 - DNA, 22 bp, Artificial Sequence
  chemically synthesized
gcttttaatccttatttgaaag

SEQ ID NO: 157400 - DNA, 22 bp, Artificial Sequence
  chemically synthesized
ttaatccttatttgaaagaata

SEQ ID NO: 157401 - DNA, 22 bp, Artificial Sequence
  chemically synthesized
taatccttatttgaaagaatac

SEQ ID NO: 157402 - DNA, 22 bp, Artificial Sequence
  chemically synthesized
aatccttatttgaaagaataca

SEQ ID NO: 157403 - DNA, 22 bp, Artificial Sequence
  chemically synthesized
atccttatttgaaagaatacaa

SEQ ID NO: 157404 - DNA, 22 bp, Artificial Sequence
  chemically synthesized
atttgaaagaatacaaagttag

SEQ ID NO: 157405 - DNA, 22 bp, Artificial Sequence
  chemically synthesized
tttgaaagaatacaaagttagc

SEQ ID NO: 157406 - DNA, 22 bp, Artificial Sequence
  chemically synthesized
gaaagaatacaaagttagcatg

SEQ ID NO: 157407 - DNA, 22 bp, Artificial Sequence
  chemically synthesized
aaagaatacaaagttagcatga

SEQ ID NO: 157408 - DNA, 22 bp, Artificial Sequence
  chemically synthesized
gcatgacaacaaaaatatagct

SEQ ID NO: 157409 - DNA, 22 bp, Artificial Sequence
  chemically synthesized
gaccaattgaatatgaagttgt

SEQ ID NO: 157410 - DNA, 22 bp, Artificial Sequence
  chemically synthesized
accaattgaatatgaagttgta

SEQ ID NO: 157411 - DNA, 22 bp, Artificial Sequence
  chemically synthesized
aatatgaagttgtatataaaaa

SEQ ID NO: 157412 - DNA, 22 bp, Artificial Sequence
  chemically synthesized
tatataaaaacagaataagaac

SEQ ID NO: 157413 - DNA, 22 bp, Artificial Sequence
  chemically synthesized
gaattagatccatatttatata

SEQ ID NO: 157414 - DNA, 22 bp, Artificial Sequence
  chemically synthesized
gatccatatttatataaaaata

SEQ ID NO: 157415 - DNA, 22 bp, Artificial Sequence
  chemically synthesized
atataaaaatataaaataaaat

SEQ ID NO: 157416 - DNA, 22 bp, Artificial Sequence
  chemically synthesized
tataaaaatataaaataaaatg

SEQ ID NO: 157417 - DNA, 22 bp, Artificial Sequence
  chemically synthesized
atcatgcttggagaccaaccct

SEQ ID NO: 157418 - DNA, 22 bp, Artificial Sequence
  chemically synthesized
ggagaccaacccttgatcttat

SEQ ID NO: 157419 - DNA, 22 bp, Artificial Sequence
  chemically synthesized
gagaccaacccttgatcttata

SEQ ID NO: 157420 - DNA, 22 bp, Artificial Sequence
  chemically synthesized
gatcttatacttggtattagaa

SEQ ID NO: 157421 - DNA, 22 bp, Artificial Sequence
  chemically synthesized
atcttatacttggtattagaaa

SEQ ID NO: 157422 - DNA, 22 bp, Artificial Sequence
  chemically synthesized
atacttggtattagaaaaattg

SEQ ID NO: 157423 - DNA, 22 bp, Artificial Sequence
  chemically synthesized
tacttggtattagaaaaattgt

SEQ ID NO: 157424 - DNA, 22 bp, Artificial Sequence
  chemically synthesized
ggtattagaaaaattgtttata

SEQ ID NO: 157425 - DNA, 22 bp, Artificial Sequence
  chemically synthesized
gtattagaaaaattgtttatat

SEQ ID NO: 157426 - DNA, 22 bp, Artificial Sequence
  chemically synthesized
gaaaaattgtttatatgtttga

SEQ ID NO: 157427 - DNA, 22 bp, Artificial Sequence
  chemically synthesized
tttatatgtttgagaatactta

SEQ ID NO: 157428 - DNA, 22 bp, Artificial Sequence
  chemically synthesized
atatgtttgagaatacttaagt

SEQ ID NO: 157429 - DNA, 22 bp, Artificial Sequence
  chemically synthesized
tatgtttgagaatacttaagta

SEQ ID NO: 157430 - DNA, 22 bp, Artificial Sequence
  chemically synthesized
gagaatacttaagtaaaattct

SEQ ID NO: 157431 - DNA, 22 bp, Artificial Sequence
  chemically synthesized
agaatacttaagtaaaattcta

SEQ ID NO: 157432 - DNA, 22 bp, Artificial Sequence
  chemically synthesized
aagtaaaattctaattacccaa

SEQ ID NO: 157433 - DNA, 22 bp, Artificial Sequence
  chemically synthesized
agtaaaattctaattacccaag

SEQ ID NO: 157434 - DNA, 22 bp, Artificial Sequence
  chemically synthesized
taattacccaagtcccccaaac

SEQ ID NO: 157435 - DNA, 22 bp, Artificial Sequence
  chemically synthesized
attacccaagtcccccaaacaa

SEQ ID NO: 157436 - DNA, 22 bp, Artificial Sequence
  chemically synthesized
cccaagtcccccaaacaaattt

SEQ ID NO: 157437 - DNA, 22 bp, Artificial Sequence
  chemically synthesized
caggtggaatcaagaatctcta

SEQ ID NO: 157438 - DNA, 22 bp, Artificial Sequence
  chemically synthesized
aggtggaatcaagaatctctaa

SEQ ID NO: 157439 - DNA, 22 bp, Artificial Sequence
  chemically synthesized
taacactattattacctgtctt

SEQ ID NO: 157440 - DNA, 22 bp, Artificial Sequence
  chemically synthesized
acactattattacctgtcttta

SEQ ID NO: 157441 - DNA, 22 bp, Artificial Sequence
  chemically synthesized
ttattacctgtctttatcatga

SEQ ID NO: 157442 - DNA, 22 bp, Artificial Sequence
  chemically synthesized
ttacctgtctttatcatgatta

SEQ ID NO: 157443 - DNA, 22 bp, Artificial Sequence
  chemically synthesized
cctgtctttatcatgattactg

SEQ ID NO: 157444 - DNA, 22 bp, Artificial Sequence
  chemically synthesized
tctttatcatgattactgtctc

SEQ ID NO: 157445 - DNA, 22 bp, Artificial Sequence
  chemically synthesized
tatcatgattactgtctctatc

SEQ ID NO: 157446 - DNA, 22 bp, Artificial Sequence
  chemically synthesized
atcatgattactgtctctatcc

SEQ ID NO: 157447 - DNA, 22 bp, Artificial Sequence
  chemically synthesized
tcatgattactgtctctatccc

SEQ ID NO: 157448 - DNA, 22 bp, Artificial Sequence
  chemically synthesized
ctgtctctatccccctttatta

SEQ ID NO: 157449 - DNA, 22 bp, Artificial Sequence
  chemically synthesized
tctctatccccctttattacta

SEQ ID NO: 157450 - DNA, 22 bp, Artificial Sequence
  chemically synthesized
tatccccctttattactatcta

SEQ ID NO: 157451 - DNA, 22 bp, Artificial Sequence
  chemically synthesized
tccccctttattactatctaca

SEQ ID NO: 157452 - DNA, 22 bp, Artificial Sequence
  chemically synthesized
tattactatctacaccactatc

SEQ ID NO: 157453 - DNA, 22 bp, Artificial Sequence
  chemically synthesized
attactatctacaccactatcc

SEQ ID NO: 157454 - DNA, 22 bp, Artificial Sequence
  chemically synthesized
ttactatctacaccactatccc

SEQ ID NO: 157455 - DNA, 22 bp, Artificial Sequence
  chemically synthesized
ctatctacaccactatccctat

SEQ ID NO: 157456 - DNA, 22 bp, Artificial Sequence
  chemically synthesized
tctacaccactatccctatctg

SEQ ID NO: 157457 - DNA, 22 bp, Artificial Sequence
  chemically synthesized
caccactatccctatctgcagt

SEQ ID NO: 157458 - DNA, 22 bp, Artificial Sequence
  chemically synthesized
tccctatctgcagttccgtctc

SEQ ID NO: 157459 - DNA, 22 bp, Artificial Sequence
  chemically synthesized
tctgcagttccgtctctagctc

SEQ ID NO: 157460 - DNA, 22 bp, Artificial Sequence
  chemically synthesized
cagttccgtctctagctctaga

SEQ ID NO: 157461 - DNA, 22 bp, Artificial Sequence
  chemically synthesized
cgtctctagctctagatccaac

SEQ ID NO: 157462 - DNA, 22 bp, Artificial Sequence
  chemically synthesized
tagctctagatccaactctgca

SEQ ID NO: 157463 - DNA, 22 bp, Artificial Sequence
  chemically synthesized
gctctagatccaactctgcatc

SEQ ID NO: 157464 - DNA, 22 bp, Artificial Sequence
  chemically synthesized
tagatccaactctgcatctctc

SEQ ID NO: 157465 - DNA, 22 bp, Artificial Sequence
  chemically synthesized
gatccaactctgcatctctcca

SEQ ID NO: 157466 - DNA, 22 bp, Artificial Sequence
  chemically synthesized
tgcatctctccactttttactt

SEQ ID NO: 157467 - DNA, 22 bp, Artificial Sequence
  chemically synthesized
catctctccactttttactttg

SEQ ID NO: 157468 - DNA, 22 bp, Artificial Sequence
  chemically synthesized
tccactttttactttgtatatg

SEQ ID NO: 157469 - DNA, 22 bp, Artificial Sequence
  chemically synthesized
cactttttactttgtatatgga

SEQ ID NO: 157470 - DNA, 22 bp, Artificial Sequence
  chemically synthesized
tttactttgtatatggaatagc

SEQ ID NO: 157471 - DNA, 22 bp, Artificial Sequence
  chemically synthesized
ttactttgtatatggaatagct

SEQ ID NO: 157472 - DNA, 22 bp, Artificial Sequence
  chemically synthesized
tactttgtatatggaatagctt

SEQ ID NO: 157473 - DNA, 22 bp, Artificial Sequence
  chemically synthesized
actttgtatatggaatagcttc

SEQ ID NO: 157474 - DNA, 22 bp, Artificial Sequence
  chemically synthesized
ctttgtatatggaatagcttct

SEQ ID NO: 157475 - DNA, 22 bp, Artificial Sequence
  chemically synthesized
tgtatatggaatagcttcttaa

SEQ ID NO: 157476 - DNA, 22 bp, Artificial Sequence
  chemically synthesized
gtatatggaatagcttcttaag

SEQ ID NO: 157477 - DNA, 22 bp, Artificial Sequence
  chemically synthesized
tatatggaatagcttcttaaga

SEQ ID NO: 157478 - DNA, 22 bp, Artificial Sequence
  chemically synthesized
cttaagaatgaaaagtatataa

SEQ ID NO: 157479 - DNA, 22 bp, Artificial Sequence
  chemically synthesized
ttaagaatgaaaagtatataat

SEQ ID NO: 157480 - DNA, 22 bp, Artificial Sequence
  chemically synthesized
aagaatgaaaagtatataatat

SEQ ID NO: 157481 - DNA, 22 bp, Artificial Sequence
  chemically synthesized
agaatgaaaagtatataatatt

SEQ ID NO: 157482 - DNA, 22 bp, Artificial Sequence
  chemically synthesized
ataaaatgtatgttaacctgac

SEQ ID NO: 157483 - DNA, 22 bp, Artificial Sequence
  chemically synthesized
acctgactacataaaagttttg

SEQ ID NO: 157484 - DNA, 22 bp, Artificial Sequence
  chemically synthesized
actacataaaagttttgtaaat

SEQ ID NO: 157485 - DNA, 22 bp, Artificial Sequence
  chemically synthesized
cataaaagttttgtaaatgatt

SEQ ID NO: 157486 - DNA, 22 bp, Artificial Sequence
  chemically synthesized
tgtaaatgattgtgtatgaaaa

SEQ ID NO: 157487 - DNA, 22 bp, Artificial Sequence
  chemically synthesized
gtaaatgattgtgtatgaaaaa

SEQ ID NO: 157488 - DNA, 22 bp, Artificial Sequence
  chemically synthesized
taaatgattgtgtatgaaaaaa

SEQ ID NO: 157489 - DNA, 22 bp, Artificial Sequence
  chemically synthesized
tgtatgaaaaaattaatgaaga

SEQ ID NO: 157490 - DNA, 22 bp, Artificial Sequence
  chemically synthesized
atgaagataagatgcgggggaa

SEQ ID NO: 157491 - DNA, 22 bp, Artificial Sequence
  chemically synthesized
atatttaaattataattaatga

SEQ ID NO: 157492 - DNA, 22 bp, Artificial Sequence
  chemically synthesized
tatttaaattataattaatgat

SEQ ID NO: 157493 - DNA, 22 bp, Artificial Sequence
  chemically synthesized
aaattataattaatgatattgt

SEQ ID NO: 157494 - DNA, 22 bp, Artificial Sequence
  chemically synthesized
aattataattaatgatattgtg

SEQ ID NO: 157495 - DNA, 22 bp, Artificial Sequence
  chemically synthesized
taattaatgatattgtgtaact

SEQ ID NO: 157496 - DNA, 22 bp, Artificial Sequence
  chemically synthesized
atgatattgtgtaactatttta

SEQ ID NO: 157497 - DNA, 22 bp, Artificial Sequence
  chemically synthesized
tgtaactattttatgtttattt

SEQ ID NO: 157498 - DNA, 22 bp, Artificial Sequence
  chemically synthesized
ttttatgtttatttgggttttg

SEQ ID NO: 157499 - DNA, 22 bp, Artificial Sequence
  chemically synthesized
tatgtttatttgggttttgcat

SEQ ID NO: 157500 - DNA, 22 bp, Artificial Sequence
  chemically synthesized
atgtttatttgggttttgcatt

SEQ ID NO: 157501 - DNA, 22 bp, Artificial Sequence
  chemically synthesized
tgtttatttgggttttgcattg

SEQ ID NO: 157502 - DNA, 22 bp, Artificial Sequence
  chemically synthesized
atttgggttttgcattgacatt

SEQ ID NO: 157503 - DNA, 22 bp, Artificial Sequence
  chemically synthesized
tttgggttttgcattgacattg

SEQ ID NO: 157504 - DNA, 22 bp, Artificial Sequence
  chemically synthesized
gggttttgcattgacattggca

SEQ ID NO: 157505 - DNA, 22 bp, Artificial Sequence
  chemically synthesized
ggttttgcattgacattggcat

SEQ ID NO: 157506 - DNA, 22 bp, Artificial Sequence
  chemically synthesized
tgcattgacattggcatgttct

SEQ ID NO: 157507 - DNA, 22 bp, Artificial Sequence
  chemically synthesized
gcattgacattggcatgttctt

SEQ ID NO: 157508 - DNA, 22 bp, Artificial Sequence
  chemically synthesized
cattgacattggcatgttctta

SEQ ID NO: 157509 - DNA, 22 bp, Artificial Sequence
  chemically synthesized
acattggcatgttcttatgtat

SEQ ID NO: 157510 - DNA, 22 bp, Artificial Sequence
  chemically synthesized
gcatgttcttatgtatactctc

SEQ ID NO: 157511 - DNA, 22 bp, Artificial Sequence
  chemically synthesized
ttatgtatactctctccagcat

SEQ ID NO: 157512 - DNA, 22 bp, Artificial Sequence
  chemically synthesized
atgtatactctctccagcatgc

SEQ ID NO: 157513 - DNA, 22 bp, Artificial Sequence
  chemically synthesized
tgtatactctctccagcatgct

SEQ ID NO: 157514 - DNA, 22 bp, Artificial Sequence
  chemically synthesized
tctccagcatgcttctcaggaa

SEQ ID NO: 157515 - DNA, 22 bp, Artificial Sequence
  chemically synthesized
tccagcatgcttctcaggaact

SEQ ID NO: 157516 - DNA, 22 bp, Artificial Sequence
  chemically synthesized
cagcatgcttctcaggaactat

SEQ ID NO: 157517 - DNA, 22 bp, Artificial Sequence
  chemically synthesized
ctcaggaactattccccccttt

SEQ ID NO: 157518 - DNA, 22 bp, Artificial Sequence
  chemically synthesized
tcaggaactattcccccctttc

SEQ ID NO: 157519 - DNA, 22 bp, Artificial Sequence
  chemically synthesized
aggaactattcccccctttctc

SEQ ID NO: 157520 - DNA, 22 bp, Artificial Sequence
  chemically synthesized
ttcccccctttctctctaatac

SEQ ID NO: 157521 - DNA, 22 bp, Artificial Sequence
  chemically synthesized
ccccctttctctctaatacacc

SEQ ID NO: 157522 - DNA, 22 bp, Artificial Sequence
  chemically synthesized
tctctctaatacacccgaagtt

SEQ ID NO: 157523 - DNA, 22 bp, Artificial Sequence
  chemically synthesized
ctctctaatacacccgaagttt

SEQ ID NO: 157524 - DNA, 22 bp, Artificial Sequence
  chemically synthesized
tctctaatacacccgaagtttc

SEQ ID NO: 157525 - DNA, 22 bp, Artificial Sequence
  chemically synthesized
tctaatacacccgaagtttctg

SEQ ID NO: 157526 - DNA, 22 bp, Artificial Sequence
  chemically synthesized
taatacacccgaagtttctggg

SEQ ID NO: 157527 - DNA, 22 bp, Artificial Sequence
  chemically synthesized
atacacccgaagtttctgggaa

SEQ ID NO: 157528 - DNA, 22 bp, Artificial Sequence
  chemically synthesized
ctgggaataattattcttggtt

SEQ ID NO: 157529 - DNA, 22 bp, Artificial Sequence
  chemically synthesized
tgggaataattattcttggtta

SEQ ID NO: 157530 - DNA, 22 bp, Artificial Sequence
  chemically synthesized
ggaataattattcttggttaat

SEQ ID NO: 157531 - DNA, 22 bp, Artificial Sequence
  chemically synthesized
ttcttggttaattgcttcttga

SEQ ID NO: 157532 - DNA, 22 bp, Artificial Sequence
  chemically synthesized
ttggttaattgcttcttgaggg

SEQ ID NO: 157533 - DNA, 22 bp, Artificial Sequence
  chemically synthesized
ggttaattgcttcttgagggat

SEQ ID NO: 157534 - DNA, 22 bp, Artificial Sequence
  chemically synthesized
gttaattgcttcttgagggata

SEQ ID NO: 157535 - DNA, 22 bp, Artificial Sequence
  chemically synthesized
attgcttcttgagggatactga

SEQ ID NO: 157536 - DNA, 22 bp, Artificial Sequence
  chemically synthesized
cttcttgagggatactgaatca

SEQ ID NO: 157537 - DNA, 22 bp, Artificial Sequence
  chemically synthesized
cttgagggatactgaatcattc

SEQ ID NO: 157538 - DNA, 22 bp, Artificial Sequence
  chemically synthesized
ttgagggatactgaatcattct

SEQ ID NO: 157539 - DNA, 22 bp, Artificial Sequence
  chemically synthesized
gagggatactgaatcattctgt

SEQ ID NO: 157540 - DNA, 22 bp, Artificial Sequence
  chemically synthesized
agggatactgaatcattctgtc

SEQ ID NO: 157541 - DNA, 22 bp, Artificial Sequence
  chemically synthesized
aatcattctgtctctatgtcct

SEQ ID NO: 157542 - DNA, 22 bp, Artificial Sequence
  chemically synthesized
tgtctctatgtcctccagtcaa

SEQ ID NO: 157543 - DNA, 22 bp, Artificial Sequence
  chemically synthesized
tctctatgtcctccagtcaact

SEQ ID NO: 157544 - DNA, 22 bp, Artificial Sequence
  chemically synthesized
tatgtcctccagtcaactaagc

SEQ ID NO: 157545 - DNA, 22 bp, Artificial Sequence
  chemically synthesized
tgtcctccagtcaactaagcac

SEQ ID NO: 157546 - DNA, 22 bp, Artificial Sequence
  chemically synthesized
cagtcaactaagcacatataca

SEQ ID NO: 157547 - DNA, 22 bp, Artificial Sequence
  chemically synthesized
agcacatatacagggaggtagt

SEQ ID NO: 157548 - DNA, 22 bp, Artificial Sequence
  chemically synthesized
tgtccacagcccagttgaaagt

SEQ ID NO: 157549 - DNA, 22 bp, Artificial Sequence
  chemically synthesized
aaagtaaacagtaacaaatagt

SEQ ID NO: 157550 - DNA, 22 bp, Artificial Sequence
  chemically synthesized
atgtggtagctctcagttccac

SEQ ID NO: 157551 - DNA, 22 bp, Artificial Sequence
  chemically synthesized
tcagttccacctaggtaagtat

SEQ ID NO: 157552 - DNA, 22 bp, Artificial Sequence
  chemically synthesized
agttccacctaggtaagtatct

SEQ ID NO: 157553 - DNA, 22 bp, Artificial Sequence
  chemically synthesized
cacctaggtaagtatctgaggt

SEQ ID NO: 157554 - DNA, 22 bp, Artificial Sequence
  chemically synthesized
ggtaagtatctgaggtctagga

SEQ ID NO: 157555 - DNA, 22 bp, Artificial Sequence
  chemically synthesized
aggtctaggatcaactatagtt

SEQ ID NO: 157556 - DNA, 22 bp, Artificial Sequence
  chemically synthesized
ggatcaactatagttatgccta

SEQ ID NO: 157557 - DNA, 22 bp, Artificial Sequence
  chemically synthesized
tagttatgcctaatggtataat

SEQ ID NO: 157558 - DNA, 22 bp, Artificial Sequence
  chemically synthesized
tgcctaatggtataatgtgctg

SEQ ID NO: 157559 - DNA, 22 bp, Artificial Sequence
  chemically synthesized
atggtataatgtgctggcttgc

SEQ ID NO: 157560 - DNA, 22 bp, Artificial Sequence
  chemically synthesized
gcttgcaccagcttaggaaagc

SEQ ID NO: 157561 - DNA, 22 bp, Artificial Sequence
  chemically synthesized
gcaccagcttaggaaagctgat

SEQ ID NO: 157562 - DNA, 22 bp, Artificial Sequence
  chemically synthesized
caccagcttaggaaagctgatt

SEQ ID NO: 157563 - DNA, 22 bp, Artificial Sequence
  chemically synthesized
aggaaagctgattatgctcatc

SEQ ID NO: 157564 - DNA, 22 bp, Artificial Sequence
  chemically synthesized
ggaaagctgattatgctcatct

SEQ ID NO: 157565 - DNA, 22 bp, Artificial Sequence
  chemically synthesized
attatgctcatctcagctctgc

SEQ ID NO: 157566 - DNA, 22 bp, Artificial Sequence
  chemically synthesized
tgctcatctcagctctgcattt

SEQ ID NO: 157567 - DNA, 22 bp, Artificial Sequence
  chemically synthesized
atctcagctctgcatttaatag

SEQ ID NO: 157568 - DNA, 22 bp, Artificial Sequence
  chemically synthesized
agctctgcatttaatagcatct

SEQ ID NO: 157569 - DNA, 22 bp, Artificial Sequence
  chemically synthesized
tgcatttaatagcatctctttg

SEQ ID NO: 157570 - DNA, 22 bp, Artificial Sequence
  chemically synthesized
catttaatagcatctctttggt

SEQ ID NO: 157571 - DNA, 22 bp, Artificial Sequence
  chemically synthesized
aatagcatctctttggtagtct

SEQ ID NO: 157572 - DNA, 22 bp, Artificial Sequence
  chemically synthesized
atagcatctctttggtagtctg

SEQ ID NO: 157573 - DNA, 22 bp, Artificial Sequence
  chemically synthesized
tttggtagtctgaaattgatca

SEQ ID NO: 157574 - DNA, 22 bp, Artificial Sequence
  chemically synthesized
tggtagtctgaaattgatcatg

SEQ ID NO: 157575 - DNA, 22 bp, Artificial Sequence
  chemically synthesized
ggtagtctgaaattgatcatgg

SEQ ID NO: 157576 - DNA, 22 bp, Artificial Sequence
  chemically synthesized
gtagtctgaaattgatcatggt

SEQ ID NO: 157577 - DNA, 22 bp, Artificial Sequence
  chemically synthesized
aaattgatcatggtaggagtca

SEQ ID NO: 157578 - DNA, 22 bp, Artificial Sequence
  chemically synthesized
atcatggtaggagtcattaaaa

SEQ ID NO: 157579 - DNA, 22 bp, Artificial Sequence
  chemically synthesized
aaacacaaaaaatcggtaactg

SEQ ID NO: 157580 - DNA, 22 bp, Artificial Sequence
  chemically synthesized
gtaaaaatcagggcatttttat

SEQ ID NO: 157581 - DNA, 22 bp, Artificial Sequence
  chemically synthesized
ttatttggaaatatttattact

SEQ ID NO: 157582 - DNA, 22 bp, Artificial Sequence
  chemically synthesized
tatttggaaatatttattacta

SEQ ID NO: 157583 - DNA, 22 bp, Artificial Sequence
  chemically synthesized
atttggaaatatttattactat

SEQ ID NO: 157584 - DNA, 22 bp, Artificial Sequence
  chemically synthesized
tttggaaatatttattactatc

SEQ ID NO: 157585 - DNA, 22 bp, Artificial Sequence
  chemically synthesized
ggaaatatttattactatccca

SEQ ID NO: 157586 - DNA, 22 bp, Artificial Sequence
  chemically synthesized
gaaatatttattactatcccac

SEQ ID NO: 157587 - DNA, 22 bp, Artificial Sequence
  chemically synthesized
attactatcccactgattatgc

SEQ ID NO: 157588 - DNA, 22 bp, Artificial Sequence
  chemically synthesized
ttactatcccactgattatgcc

SEQ ID NO: 157589 - DNA, 22 bp, Artificial Sequence
  chemically synthesized
ctatcccactgattatgcctaa

SEQ ID NO: 157590 - DNA, 22 bp, Artificial Sequence
  chemically synthesized
tcccactgattatgcctaacga

SEQ ID NO: 157591 - DNA, 22 bp, Artificial Sequence
  chemically synthesized
attatgcctaacgaagagccct

SEQ ID NO: 157592 - DNA, 22 bp, Artificial Sequence
  chemically synthesized
tgcctaacgaagagccctggcc

SEQ ID NO: 157593 - DNA, 22 bp, Artificial Sequence
  chemically synthesized
acgaagagccctggcccaacac

SEQ ID NO: 157594 - DNA, 22 bp, Artificial Sequence
  chemically synthesized
gcccaacacgggaagaagagtt

SEQ ID NO: 157595 - DNA, 22 bp, Artificial Sequence
  chemically synthesized
agccttggtcacattcttattt

SEQ ID NO: 157596 - DNA, 22 bp, Artificial Sequence
  chemically synthesized
ggtcacattcttatttctgagc

SEQ ID NO: 157597 - DNA, 22 bp, Artificial Sequence
  chemically synthesized
gtcacattcttatttctgagcc

SEQ ID NO: 157598 - DNA, 22 bp, Artificial Sequence
  chemically synthesized
ttatttctgagccccatcctga

SEQ ID NO: 157599 - DNA, 22 bp, Artificial Sequence
  chemically synthesized
atttctgagccccatcctgaat

SEQ ID NO: 157600 - DNA, 22 bp, Artificial Sequence
  chemically synthesized
tttctgagccccatcctgaatt

SEQ ID NO: 157601 - DNA, 22 bp, Artificial Sequence
  chemically synthesized
ctgagccccatcctgaattcca

SEQ ID NO: 157602 - DNA, 22 bp, Artificial Sequence
  chemically synthesized
tgagccccatcctgaattccat

SEQ ID NO: 157603 - DNA, 22 bp, Artificial Sequence
  chemically synthesized
agccccatcctgaattccattt

SEQ ID NO: 157604 - DNA, 22 bp, Artificial Sequence
  chemically synthesized
aattccatttctggcctccaac

SEQ ID NO: 157605 - DNA, 22 bp, Artificial Sequence
  chemically synthesized
catttctggcctccaacgttaa

SEQ ID NO: 157606 - DNA, 22 bp, Artificial Sequence
  chemically synthesized
ctggcctccaacgttaatacct

SEQ ID NO: 157607 - DNA, 22 bp, Artificial Sequence
  chemically synthesized
tggcctccaacgttaataccta

SEQ ID NO: 157608 - DNA, 22 bp, Artificial Sequence
  chemically synthesized
gcctccaacgttaatacctaag

SEQ ID NO: 157609 - DNA, 22 bp, Artificial Sequence
  chemically synthesized
caacgttaatacctaaggctct

SEQ ID NO: 157610 - DNA, 22 bp, Artificial Sequence
  chemically synthesized
atacctaaggctctgctgcaga

SEQ ID NO: 157611 - DNA, 22 bp, Artificial Sequence
  chemically synthesized
aggctctgctgcagataagtgg

SEQ ID NO: 157612 - DNA, 22 bp, Artificial Sequence
  chemically synthesized
tgctgcagataagtggaacttt

SEQ ID NO: 157613 - DNA, 22 bp, Artificial Sequence
  chemically synthesized
ctgcagataagtggaactttag

SEQ ID NO: 157614 - DNA, 22 bp, Artificial Sequence
  chemically synthesized
cagataagtggaactttagtgt

SEQ ID NO: 157615 - DNA, 22 bp, Artificial Sequence
  chemically synthesized
tagtgttaataaacttgttccc

SEQ ID NO: 157616 - DNA, 22 bp, Artificial Sequence
  chemically synthesized
agtgttaataaacttgttccca

SEQ ID NO: 157617 - DNA, 22 bp, Artificial Sequence
  chemically synthesized
gtgttaataaacttgttcccag

SEQ ID NO: 157618 - DNA, 22 bp, Artificial Sequence
  chemically synthesized
ataaacttgttcccagataaat

SEQ ID NO: 157619 - DNA, 22 bp, Artificial Sequence
  chemically synthesized
gttcccagataaatatctctaa

SEQ ID NO: 157620 - DNA, 22 bp, Artificial Sequence
  chemically synthesized
ttcccagataaatatctctaag

SEQ ID NO: 157621 - DNA, 22 bp, Artificial Sequence
  chemically synthesized
ccagataaatatctctaagcct

SEQ ID NO: 157622 - DNA, 22 bp, Artificial Sequence
  chemically synthesized
taagcctgtaccctagccccac

SEQ ID NO: 157623 - DNA, 22 bp, Artificial Sequence
  chemically synthesized
agcctgtaccctagccccacca

SEQ ID NO: 157624 - DNA, 22 bp, Artificial Sequence
  chemically synthesized
taccctagccccaccatcacat

SEQ ID NO: 157625 - DNA, 22 bp, Artificial Sequence
  chemically synthesized
gccccaccatcacatgtgactt

SEQ ID NO: 157626 - DNA, 22 bp, Artificial Sequence
  chemically synthesized
gtgagatactgatgcttctgat

SEQ ID NO: 157627 - DNA, 22 bp, Artificial Sequence
  chemically synthesized
tgagatactgatgcttctgatc

SEQ ID NO: 157628 - DNA, 22 bp, Artificial Sequence
  chemically synthesized
atgcttctgatcttgctccctg

SEQ ID NO: 157629 - DNA, 22 bp, Artificial Sequence
  chemically synthesized
ctgatcttgctccctgacccgg

SEQ ID NO: 157630 - DNA, 22 bp, Artificial Sequence
  chemically synthesized
tgatcttgctccctgacccggt

SEQ ID NO: 157631 - DNA, 22 bp, Artificial Sequence
  chemically synthesized
atcttgctccctgacccggttc

SEQ ID NO: 157632 - DNA, 22 bp, Artificial Sequence
  chemically synthesized
gctccctgacccggttccagca

SEQ ID NO: 157633 - DNA, 22 bp, Artificial Sequence
  chemically synthesized
ctccctgacccggttccagcag

SEQ ID NO: 157634 - DNA, 22 bp, Artificial Sequence
  chemically synthesized
cctgacccggttccagcagaag

SEQ ID NO: 157635 - DNA, 22 bp, Artificial Sequence
  chemically synthesized
acccggttccagcagaagactg

SEQ ID NO: 157636 - DNA, 22 bp, Artificial Sequence
  chemically synthesized
cagcagaagactgacccttctg

SEQ ID NO: 157637 - DNA, 22 bp, Artificial Sequence
  chemically synthesized
acccttctgcaaaatacagagg

SEQ ID NO: 157638 - DNA, 22 bp, Artificial Sequence
  chemically synthesized
ctgcaaaatacagaggagcttt

SEQ ID NO: 157639 - DNA, 22 bp, Artificial Sequence
  chemically synthesized
tgcaaaatacagaggagctttt

SEQ ID NO: 157640 - DNA, 22 bp, Artificial Sequence
  chemically synthesized
caaaatacagaggagcttttct

SEQ ID NO: 157641 - DNA, 22 bp, Artificial Sequence
  chemically synthesized
ttctaatctatggatagcaggt

SEQ ID NO: 157642 - DNA, 22 bp, Artificial Sequence
  chemically synthesized
tctaatctatggatagcaggtg

SEQ ID NO: 157643 - DNA, 22 bp, Artificial Sequence
  chemically synthesized
ctaatctatggatagcaggtgg

SEQ ID NO: 157644 - DNA, 22 bp, Artificial Sequence
  chemically synthesized
taatctatggatagcaggtgga

SEQ ID NO: 157645 - DNA, 22 bp, Artificial Sequence
  chemically synthesized
atctatggatagcaggtggaga

SEQ ID NO: 157646 - DNA, 22 bp, Artificial Sequence
  chemically synthesized
tggatagcaggtggagaaagag

SEQ ID NO: 157647 - DNA, 22 bp, Artificial Sequence
  chemically synthesized
gtaagttaaagaaaaaaatgga

SEQ ID NO: 157648 - DNA, 22 bp, Artificial Sequence
  chemically synthesized
aagaaaaaaatggaaaatactt

SEQ ID NO: 157649 - DNA, 22 bp, Artificial Sequence
  chemically synthesized
tattctaggagaaactatcctt

SEQ ID NO: 157650 - DNA, 22 bp, Artificial Sequence
  chemically synthesized
attctaggagaaactatccttg

SEQ ID NO: 157651 - DNA, 22 bp, Artificial Sequence
  chemically synthesized
ttctaggagaaactatccttgt

SEQ ID NO: 157652 - DNA, 22 bp, Artificial Sequence
  chemically synthesized
taggagaaactatccttgtgtt

SEQ ID NO: 157653 - DNA, 22 bp, Artificial Sequence
  chemically synthesized
ggagaaactatccttgtgttct

SEQ ID NO: 157654 - DNA, 22 bp, Artificial Sequence
  chemically synthesized
tccttgtgttctaatatattaa

SEQ ID NO: 157655 - DNA, 22 bp, Artificial Sequence
  chemically synthesized
gtgttctaatatattaaattgt

SEQ ID NO: 157656 - DNA, 22 bp, Artificial Sequence
  chemically synthesized
tgttctaatatattaaattgtt

SEQ ID NO: 157657 - DNA, 22 bp, Artificial Sequence
  chemically synthesized
taatatattaaattgttctttt

SEQ ID NO: 157658 - DNA, 22 bp, Artificial Sequence
  chemically synthesized
atatattaaattgttcttttta

SEQ ID NO: 157659 - DNA, 22 bp, Artificial Sequence
  chemically synthesized
aattgttctttttattctatac

SEQ ID NO: 157660 - DNA, 22 bp, Artificial Sequence
  chemically synthesized
ttctttttattctatacattta

SEQ ID NO: 157661 - DNA, 22 bp, Artificial Sequence
  chemically synthesized
tttttattctatacatttaata

SEQ ID NO: 157662 - DNA, 22 bp, Artificial Sequence
  chemically synthesized
tttattctatacatttaatatt

SEQ ID NO: 157663 - DNA, 22 bp, Artificial Sequence
  chemically synthesized
ttattctatacatttaatattt

SEQ ID NO: 157664 - DNA, 22 bp, Artificial Sequence
  chemically synthesized
tattctatacatttaatattta

SEQ ID NO: 157665 - DNA, 22 bp, Artificial Sequence
  chemically synthesized
attctatacatttaatatttac

SEQ ID NO: 157666 - DNA, 22 bp, Artificial Sequence
  chemically synthesized
ttctatacatttaatatttact

SEQ ID NO: 157667 - DNA, 22 bp, Artificial Sequence
  chemically synthesized
tatacatttaatatttactata

SEQ ID NO: 157668 - DNA, 22 bp, Artificial Sequence
  chemically synthesized
tacatttaatatttactatatt

SEQ ID NO: 157669 - DNA, 22 bp, Artificial Sequence
  chemically synthesized
aatatttactatattccacata

SEQ ID NO: 157670 - DNA, 22 bp, Artificial Sequence
  chemically synthesized
atatttactatattccacatat

SEQ ID NO: 157671 - DNA, 22 bp, Artificial Sequence
  chemically synthesized
actatattccacatataatgat

SEQ ID NO: 157672 - DNA, 22 bp, Artificial Sequence
  chemically synthesized
ctatattccacatataatgata

SEQ ID NO: 157673 - DNA, 22 bp, Artificial Sequence
  chemically synthesized
tattccacatataatgataaac

SEQ ID NO: 157674 - DNA, 22 bp, Artificial Sequence
  chemically synthesized
cacatataatgataaacaatat

SEQ ID NO: 157675 - DNA, 22 bp, Artificial Sequence
  chemically synthesized
ctttaaaatactattattgtct

SEQ ID NO: 157676 - DNA, 22 bp, Artificial Sequence
  chemically synthesized
taaaatactattattgtcttta

SEQ ID NO: 157677 - DNA, 22 bp, Artificial Sequence
  chemically synthesized
aaaatactattattgtctttat

SEQ ID NO: 157678 - DNA, 22 bp, Artificial Sequence
  chemically synthesized
aaatactattattgtctttata

SEQ ID NO: 157679 - DNA, 22 bp, Artificial Sequence
  chemically synthesized
ttattgtctttatagcaaatat

SEQ ID NO: 157680 - DNA, 22 bp, Artificial Sequence
  chemically synthesized
ttgtctttatagcaaatatctg

SEQ ID NO: 157681 - DNA, 22 bp, Artificial Sequence
  chemically synthesized
tctttatagcaaatatctgggt

SEQ ID NO: 157682 - DNA, 22 bp, Artificial Sequence
  chemically synthesized
tatagcaaatatctgggtctca

SEQ ID NO: 157683 - DNA, 22 bp, Artificial Sequence
  chemically synthesized
atagcaaatatctgggtctcag

SEQ ID NO: 157684 - DNA, 22 bp, Artificial Sequence
  chemically synthesized
tagcaaatatctgggtctcaga

SEQ ID NO: 157685 - DNA, 22 bp, Artificial Sequence
  chemically synthesized
ggtctcagataacttgcaatat

SEQ ID NO: 157686 - DNA, 22 bp, Artificial Sequence
  chemically synthesized
agataacttgcaatataaatca

SEQ ID NO: 157687 - DNA, 22 bp, Artificial Sequence
  chemically synthesized
gcaatataaatcaactttaata

SEQ ID NO: 157688 - DNA, 22 bp, Artificial Sequence
  chemically synthesized
caatataaatcaactttaatat

SEQ ID NO: 157689 - DNA, 22 bp, Artificial Sequence
  chemically synthesized
taatataatcccaagattacac

SEQ ID NO: 157690 - DNA, 22 bp, Artificial Sequence
  chemically synthesized
aatataatcccaagattacacg

SEQ ID NO: 157691 - DNA, 22 bp, Artificial Sequence
  chemically synthesized
atataatcccaagattacacgt

SEQ ID NO: 157692 - DNA, 22 bp, Artificial Sequence
  chemically synthesized
cacgtcaattaaatgttagaac

SEQ ID NO: 157693 - DNA, 22 bp, Artificial Sequence
  chemically synthesized
aatgttagaaccatcaatactc

SEQ ID NO: 157694 - DNA, 22 bp, Artificial Sequence
  chemically synthesized
gaaccatcaatactctttatta

SEQ ID NO: 157695 - DNA, 22 bp, Artificial Sequence
  chemically synthesized
tttattagtgttatattacttt

SEQ ID NO: 157696 - DNA, 22 bp, Artificial Sequence
  chemically synthesized
tattagtgttatattactttag

SEQ ID NO: 157697 - DNA, 22 bp, Artificial Sequence
  chemically synthesized
attagtgttatattactttagc

SEQ ID NO: 157698 - DNA, 22 bp, Artificial Sequence
  chemically synthesized
ttagtgttatattactttagct

SEQ ID NO: 157699 - DNA, 22 bp, Artificial Sequence
  chemically synthesized
gtgttatattactttagctatt

SEQ ID NO: 157700 - DNA, 22 bp, Artificial Sequence
  chemically synthesized
tattactttagctattcatcta

SEQ ID NO: 157701 - DNA, 22 bp, Artificial Sequence
  chemically synthesized
ctttagctattcatctactctc

SEQ ID NO: 157702 - DNA, 22 bp, Artificial Sequence
  chemically synthesized
tagctattcatctactctcttt

SEQ ID NO: 157703 - DNA, 22 bp, Artificial Sequence
  chemically synthesized
agctattcatctactctcttta

SEQ ID NO: 157704 - DNA, 22 bp, Artificial Sequence
  chemically synthesized
gctattcatctactctctttat

SEQ ID NO: 157705 - DNA, 22 bp, Artificial Sequence
  chemically synthesized
ttcatctactctctttataaac

SEQ ID NO: 157706 - DNA, 22 bp, Artificial Sequence
  chemically synthesized
atctactctctttataaacact

SEQ ID NO: 157707 - DNA, 22 bp, Artificial Sequence
  chemically synthesized
ctctctttataaacactacaag

SEQ ID NO: 157708 - DNA, 22 bp, Artificial Sequence
  chemically synthesized
tctttataaacactacaagtta

SEQ ID NO: 157709 - DNA, 22 bp, Artificial Sequence
  chemically synthesized
tttataaacactacaagttagc

SEQ ID NO: 157710 - DNA, 22 bp, Artificial Sequence
  chemically synthesized
tataaacactacaagttagcag

SEQ ID NO: 157711 - DNA, 22 bp, Artificial Sequence
  chemically synthesized
ataaacactacaagttagcagt

SEQ ID NO: 157712 - DNA, 22 bp, Artificial Sequence
  chemically synthesized
taaacactacaagttagcagtt

SEQ ID NO: 157713 - DNA, 22 bp, Artificial Sequence
  chemically synthesized
caagttagcagtttcttcagtc

SEQ ID NO: 157714 - DNA, 22 bp, Artificial Sequence
  chemically synthesized
gcagtttcttcagtcataattt

SEQ ID NO: 157715 - DNA, 22 bp, Artificial Sequence
  chemically synthesized
cttcagtcataatttccatgtg

SEQ ID NO: 157716 - DNA, 22 bp, Artificial Sequence
  chemically synthesized
ttcagtcataatttccatgtga

SEQ ID NO: 157717 - DNA, 22 bp, Artificial Sequence
  chemically synthesized
cagtcataatttccatgtgaat

SEQ ID NO: 157718 - DNA, 22 bp, Artificial Sequence
  chemically synthesized
agtcataatttccatgtgaatc

SEQ ID NO: 157719 - DNA, 22 bp, Artificial Sequence
  chemically synthesized
ccatgtgaatctgtcatctcta

SEQ ID NO: 157720 - DNA, 22 bp, Artificial Sequence
  chemically synthesized
catgtgaatctgtcatctctat

SEQ ID NO: 157721 - DNA, 22 bp, Artificial Sequence
  chemically synthesized
tcatctctatgcttattttaac

SEQ ID NO: 157722 - DNA, 22 bp, Artificial Sequence
  chemically synthesized
tatgcttattttaactgttttt

SEQ ID NO: 157723 - DNA, 22 bp, Artificial Sequence
  chemically synthesized
tgcttattttaactgtttttca

SEQ ID NO: 157724 - DNA, 22 bp, Artificial Sequence
  chemically synthesized
attttaactgtttttcactgcc

SEQ ID NO: 157725 - DNA, 22 bp, Artificial Sequence
  chemically synthesized
ttttaactgtttttcactgcca

SEQ ID NO: 157726 - DNA, 22 bp, Artificial Sequence
  chemically synthesized
taactgtttttcactgccatag

SEQ ID NO: 157727 - DNA, 22 bp, Artificial Sequence
  chemically synthesized
aactgtttttcactgccataga

SEQ ID NO: 157728 - DNA, 22 bp, Artificial Sequence
  chemically synthesized
actgtttttcactgccatagat

SEQ ID NO: 157729 - DNA, 22 bp, Artificial Sequence
  chemically synthesized
tttttcactgccatagatgacc

SEQ ID NO: 157730 - DNA, 22 bp, Artificial Sequence
  chemically synthesized
ttcactgccatagatgacccaa

SEQ ID NO: 157731 - DNA, 22 bp, Artificial Sequence
  chemically synthesized
tcactgccatagatgacccaac

SEQ ID NO: 157732 - DNA, 22 bp, Artificial Sequence
  chemically synthesized
cactgccatagatgacccaact

SEQ ID NO: 157733 - DNA, 22 bp, Artificial Sequence
  chemically synthesized
actgccatagatgacccaactt

SEQ ID NO: 157734 - DNA, 22 bp, Artificial Sequence
  chemically synthesized
ccatagatgacccaacttgaga

SEQ ID NO: 157735 - DNA, 22 bp, Artificial Sequence
  chemically synthesized
gagatttctattaatgccttat

SEQ ID NO: 157736 - DNA, 22 bp, Artificial Sequence
  chemically synthesized
agatttctattaatgccttatc

SEQ ID NO: 157737 - DNA, 22 bp, Artificial Sequence
  chemically synthesized
ctattaatgccttatctggcat

SEQ ID NO: 157738 - DNA, 22 bp, Artificial Sequence
  chemically synthesized
tattaatgccttatctggcata

SEQ ID NO: 157739 - DNA, 22 bp, Artificial Sequence
  chemically synthesized
ttaatgccttatctggcatata

SEQ ID NO: 157740 - DNA, 22 bp, Artificial Sequence
  chemically synthesized
atgccttatctggcatataggc

SEQ ID NO: 157741 - DNA, 22 bp, Artificial Sequence
  chemically synthesized
atctggcatataggctatgttg

SEQ ID NO: 157742 - DNA, 22 bp, Artificial Sequence
  chemically synthesized
tctggcatataggctatgttgg

SEQ ID NO: 157743 - DNA, 22 bp, Artificial Sequence
  chemically synthesized
gcatataggctatgttggaata

SEQ ID NO: 157744 - DNA, 22 bp, Artificial Sequence
  chemically synthesized
tgttggaatacttttctgcatg

SEQ ID NO: 157745 - DNA, 22 bp, Artificial Sequence
  chemically synthesized
gaatacttttctgcatgaccca

SEQ ID NO: 157746 - DNA, 22 bp, Artificial Sequence
  chemically synthesized
ttctgcatgacccattaggttt

SEQ ID NO: 157747 - DNA, 22 bp, Artificial Sequence
  chemically synthesized
tctgcatgacccattaggtttc

SEQ ID NO: 157748 - DNA, 22 bp, Artificial Sequence
  chemically synthesized
ctgcatgacccattaggtttct

SEQ ID NO: 157749 - DNA, 22 bp, Artificial Sequence
  chemically synthesized
tgcatgacccattaggtttctc

SEQ ID NO: 157750 - DNA, 22 bp, Artificial Sequence
  chemically synthesized
catgacccattaggtttctctt

SEQ ID NO: 157751 - DNA, 22 bp, Artificial Sequence
  chemically synthesized
ggtttctcttccactcactgtg

SEQ ID NO: 157752 - DNA, 22 bp, Artificial Sequence
  chemically synthesized
ctcttccactcactgtggctta

SEQ ID NO: 157753 - DNA, 22 bp, Artificial Sequence
  chemically synthesized
tcttccactcactgtggcttac

SEQ ID NO: 157754 - DNA, 22 bp, Artificial Sequence
  chemically synthesized
ttccactcactgtggcttacct

SEQ ID NO: 157755 - DNA, 22 bp, Artificial Sequence
  chemically synthesized
ccactcactgtggcttacctgt

SEQ ID NO: 157756 - DNA, 22 bp, Artificial Sequence
  chemically synthesized
cactcactgtggcttacctgtg

SEQ ID NO: 157757 - DNA, 22 bp, Artificial Sequence
  chemically synthesized
actgtggcttacctgtgccctt

SEQ ID NO: 157758 - DNA, 22 bp, Artificial Sequence
  chemically synthesized
tggcttacctgtgcccttgttt

SEQ ID NO: 157759 - DNA, 22 bp, Artificial Sequence
  chemically synthesized
acctgtgcccttgtttcagaaa

SEQ ID NO: 157760 - DNA, 22 bp, Artificial Sequence
  chemically synthesized
cctgtgcccttgtttcagaaat

SEQ ID NO: 157761 - DNA, 22 bp, Artificial Sequence
  chemically synthesized
tgcccttgtttcagaaataaat

SEQ ID NO: 157762 - DNA, 22 bp, Artificial Sequence
  chemically synthesized
gtttcagaaataaattttttat

SEQ ID NO: 157763 - DNA, 22 bp, Artificial Sequence
  chemically synthesized
tttcagaaataaattttttatc

SEQ ID NO: 157764 - DNA, 22 bp, Artificial Sequence
  chemically synthesized
cagaaataaattttttatccct

SEQ ID NO: 157765 - DNA, 22 bp, Artificial Sequence
  chemically synthesized
agaaataaattttttatccctt

SEQ ID NO: 157766 - DNA, 22 bp, Artificial Sequence
  chemically synthesized
tttatccctttttctgaggaaa

SEQ ID NO: 157767 - DNA, 22 bp, Artificial Sequence
  chemically synthesized
ttatccctttttctgaggaaat

SEQ ID NO: 157768 - DNA, 22 bp, Artificial Sequence
  chemically synthesized
tatccctttttctgaggaaatg

SEQ ID NO: 157769 - DNA, 22 bp, Artificial Sequence
  chemically synthesized
atccctttttctgaggaaatgt

SEQ ID NO: 157770 - DNA, 22 bp, Artificial Sequence
  chemically synthesized
tccctttttctgaggaaatgtc

SEQ ID NO: 157771 - DNA, 22 bp, Artificial Sequence
  chemically synthesized
tttctgaggaaatgtcttagat

SEQ ID NO: 157772 - DNA, 22 bp, Artificial Sequence
  chemically synthesized
ttctgaggaaatgtcttagata

SEQ ID NO: 157773 - DNA, 22 bp, Artificial Sequence
  chemically synthesized
tctgaggaaatgtcttagatat

SEQ ID NO: 157774 - DNA, 22 bp, Artificial Sequence
  chemically synthesized
ctgaggaaatgtcttagatatg

SEQ ID NO: 157775 - DNA, 22 bp, Artificial Sequence
  chemically synthesized
tgaggaaatgtcttagatatga

SEQ ID NO: 157776 - DNA, 22 bp, Artificial Sequence
  chemically synthesized
aggaaatgtcttagatatgact

SEQ ID NO: 157777 - DNA, 22 bp, Artificial Sequence
  chemically synthesized
agatatgactgttagctcagaa

SEQ ID NO: 157778 - DNA, 22 bp, Artificial Sequence
  chemically synthesized
gatatgactgttagctcagaac

SEQ ID NO: 157779 - DNA, 22 bp, Artificial Sequence
  chemically synthesized
ttagctcagaacttgatgtgca

SEQ ID NO: 157780 - DNA, 22 bp, Artificial Sequence
  chemically synthesized
gctcagaacttgatgtgcaata

SEQ ID NO: 157781 - DNA, 22 bp, Artificial Sequence
  chemically synthesized
agaacttgatgtgcaataactg

SEQ ID NO: 157782 - DNA, 22 bp, Artificial Sequence
  chemically synthesized
gatgtgcaataactgagtagaa

SEQ ID NO: 157783 - DNA, 22 bp, Artificial Sequence
  chemically synthesized
atgtgcaataactgagtagaaa

SEQ ID NO: 157784 - DNA, 22 bp, Artificial Sequence
  chemically synthesized
agtagaaacttatatattccag

SEQ ID NO: 157785 - DNA, 22 bp, Artificial Sequence
  chemically synthesized
atatattccagtctccatgtgc

SEQ ID NO: 157786 - DNA, 22 bp, Artificial Sequence
  chemically synthesized
tatattccagtctccatgtgct

SEQ ID NO: 157787 - DNA, 22 bp, Artificial Sequence
  chemically synthesized
cagtctccatgtgcttctcaat

SEQ ID NO: 157788 - DNA, 22 bp, Artificial Sequence
  chemically synthesized
catgtgcttctcaatatcttca

SEQ ID NO: 157789 - DNA, 22 bp, Artificial Sequence
  chemically synthesized
ctcaatatcttcagaggaagta

SEQ ID NO: 157790 - DNA, 22 bp, Artificial Sequence
  chemically synthesized
tcaatatcttcagaggaagtat

SEQ ID NO: 157791 - DNA, 22 bp, Artificial Sequence
  chemically synthesized
aatatcttcagaggaagtatca

SEQ ID NO: 157792 - DNA, 22 bp, Artificial Sequence
  chemically synthesized
cagaggaagtatcaccatgacg

SEQ ID NO: 157793 - DNA, 22 bp, Artificial Sequence
  chemically synthesized
agaggaagtatcaccatgacgt

SEQ ID NO: 157794 - DNA, 22 bp, Artificial Sequence
  chemically synthesized
tcaaacgttccataacattcac

SEQ ID NO: 157795 - DNA, 22 bp, Artificial Sequence
  chemically synthesized
caaacgttccataacattcaca

SEQ ID NO: 157796 - DNA, 22 bp, Artificial Sequence
  chemically synthesized
aaacgttccataacattcacac

SEQ ID NO: 157797 - DNA, 22 bp, Artificial Sequence
  chemically synthesized
cataacattcacacctacaaca

SEQ ID NO: 157798 - DNA, 22 bp, Artificial Sequence
  chemically synthesized
acacctacaacattcactctcg

SEQ ID NO: 157799 - DNA, 22 bp, Artificial Sequence
  chemically synthesized
caacattcactctcgttggcat

SEQ ID NO: 157800 - DNA, 22 bp, Artificial Sequence
  chemically synthesized
actctcgttggcatcccgggac

SEQ ID NO: 157801 - DNA, 22 bp, Artificial Sequence
  chemically synthesized
tcgttggcatcccgggactgga

SEQ ID NO: 157802 - DNA, 22 bp, Artificial Sequence
  chemically synthesized
gttggcatcccgggactggagg

SEQ ID NO: 157803 - DNA, 22 bp, Artificial Sequence
  chemically synthesized
gcatcccgggactggaggcaga

SEQ ID NO: 157804 - DNA, 22 bp, Artificial Sequence
  chemically synthesized
gaggcagaacattatgtggata

SEQ ID NO: 157805 - DNA, 22 bp, Artificial Sequence
  chemically synthesized
tgtggatatccatccccttctg

SEQ ID NO: 157806 - DNA, 22 bp, Artificial Sequence
  chemically synthesized
ctgcctgatatacaccatcatc

SEQ ID NO: 157807 - DNA, 22 bp, Artificial Sequence
  chemically synthesized
tgcctgatatacaccatcatct

SEQ ID NO: 157808 - DNA, 22 bp, Artificial Sequence
  chemically synthesized
cctgatatacaccatcatcttt

SEQ ID NO: 157809 - DNA, 22 bp, Artificial Sequence
  chemically synthesized
atatacaccatcatctttccgg

SEQ ID NO: 157810 - DNA, 22 bp, Artificial Sequence
  chemically synthesized
tccgggaaatggcatcattctt

SEQ ID NO: 157811 - DNA, 22 bp, Artificial Sequence
  chemically synthesized
ccgggaaatggcatcattcttc

SEQ ID NO: 157812 - DNA, 22 bp, Artificial Sequence
  chemically synthesized
cgggaaatggcatcattcttca

SEQ ID NO: 157813 - DNA, 22 bp, Artificial Sequence
  chemically synthesized
ttcacatcatccgaattgactc

SEQ ID NO: 157814 - DNA, 22 bp, Artificial Sequence
  chemically synthesized
cacatcatccgaattgactctt

SEQ ID NO: 157815 - DNA, 22 bp, Artificial Sequence
  chemically synthesized
acatcatccgaattgactcttc

SEQ ID NO: 157816 - DNA, 22 bp, Artificial Sequence
  chemically synthesized
actcttccttgcaccaacccat

SEQ ID NO: 157817 - DNA, 22 bp, Artificial Sequence
  chemically synthesized
ttccttgcaccaacccatgtac

SEQ ID NO: 157818 - DNA, 22 bp, Artificial Sequence
  chemically synthesized
ccttgcaccaacccatgtacta

SEQ ID NO: 157819 - DNA, 22 bp, Artificial Sequence
  chemically synthesized
cttgcaccaacccatgtactat

SEQ ID NO: 157820 - DNA, 22 bp, Artificial Sequence
  chemically synthesized
gcaccaacccatgtactatttt

SEQ ID NO: 157821 - DNA, 22 bp, Artificial Sequence
  chemically synthesized
caccaacccatgtactattttc

SEQ ID NO: 157822 - DNA, 22 bp, Artificial Sequence
  chemically synthesized
ttttctggccatgccggccttt

SEQ ID NO: 157823 - DNA, 22 bp, Artificial Sequence
  chemically synthesized
tctggccatgccggcctttgtt

SEQ ID NO: 157824 - DNA, 22 bp, Artificial Sequence
  chemically synthesized
ctggccatgccggcctttgttg

SEQ ID NO: 157825 - DNA, 22 bp, Artificial Sequence
  chemically synthesized
tggccatgccggcctttgttga

SEQ ID NO: 157826 - DNA, 22 bp, Artificial Sequence
  chemically synthesized
gccatgccggcctttgttgaac

SEQ ID NO: 157827 - DNA, 22 bp, Artificial Sequence
  chemically synthesized
tgttgaacttggtgtctctgct

SEQ ID NO: 157828 - DNA, 22 bp, Artificial Sequence
  chemically synthesized
gttgaacttggtgtctctgctt

SEQ ID NO: 157829 - DNA, 22 bp, Artificial Sequence
  chemically synthesized
ttgaacttggtgtctctgcttc

SEQ ID NO: 157830 - DNA, 22 bp, Artificial Sequence
  chemically synthesized
aacttggtgtctctgcttccac

SEQ ID NO: 157831 - DNA, 22 bp, Artificial Sequence
  chemically synthesized
ggtgtctctgcttccaccatgc

SEQ ID NO: 157832 - DNA, 22 bp, Artificial Sequence
  chemically synthesized
gtgtctctgcttccaccatgcc

SEQ ID NO: 157833 - DNA, 22 bp, Artificial Sequence
  chemically synthesized
tgcttccaccatgcccactgtg

SEQ ID NO: 157834 - DNA, 22 bp, Artificial Sequence
  chemically synthesized
cttccaccatgcccactgtgtt

SEQ ID NO: 157835 - DNA, 22 bp, Artificial Sequence
  chemically synthesized
ccaccatgcccactgtgttaag

SEQ ID NO: 157836 - DNA, 22 bp, Artificial Sequence
  chemically synthesized
caccatgcccactgtgttaagc

SEQ ID NO: 157837 - DNA, 22 bp, Artificial Sequence
  chemically synthesized
tgttaagcatattcctctttgg

SEQ ID NO: 157838 - DNA, 22 bp, Artificial Sequence
  chemically synthesized
agcatattcctctttggcatta

SEQ ID NO: 157839 - DNA, 22 bp, Artificial Sequence
  chemically synthesized
ctctttggcattaacgatgtca

SEQ ID NO: 157840 - DNA, 22 bp, Artificial Sequence
  chemically synthesized
tttggcattaacgatgtcagtt

SEQ ID NO: 157841 - DNA, 22 bp, Artificial Sequence
  chemically synthesized
tggcattaacgatgtcagtttt

SEQ ID NO: 157842 - DNA, 22 bp, Artificial Sequence
  chemically synthesized
ggcattaacgatgtcagttttg

SEQ ID NO: 157843 - DNA, 22 bp, Artificial Sequence
  chemically synthesized
gcattaacgatgtcagttttgg

SEQ ID NO: 157844 - DNA, 22 bp, Artificial Sequence
  chemically synthesized
acgatgtcagttttggtggttg

SEQ ID NO: 157845 - DNA, 22 bp, Artificial Sequence
  chemically synthesized
tggtggttgcctgctccagatg

SEQ ID NO: 157846 - DNA, 22 bp, Artificial Sequence
  chemically synthesized
ggtggttgcctgctccagatgt

SEQ ID NO: 157847 - DNA, 22 bp, Artificial Sequence
  chemically synthesized
gtggttgcctgctccagatgtt

SEQ ID NO: 157848 - DNA, 22 bp, Artificial Sequence
  chemically synthesized
cctgctccagatgttttctatg

SEQ ID NO: 157849 - DNA, 22 bp, Artificial Sequence
  chemically synthesized
ctccagatgttttctatgcact

SEQ ID NO: 157850 - DNA, 22 bp, Artificial Sequence
  chemically synthesized
cagatgttttctatgcactctt

SEQ ID NO: 157851 - DNA, 22 bp, Artificial Sequence
  chemically synthesized
tctatgcactctttcactctta

SEQ ID NO: 157852 - DNA, 22 bp, Artificial Sequence
  chemically synthesized
ctatgcactctttcactcttat

SEQ ID NO: 157853 - DNA, 22 bp, Artificial Sequence
  chemically synthesized
tatgcactctttcactcttatg

SEQ ID NO: 157854 - DNA, 22 bp, Artificial Sequence
  chemically synthesized
tgcactctttcactcttatgga

SEQ ID NO: 157855 - DNA, 22 bp, Artificial Sequence
  chemically synthesized
tttcactcttatggagtcaggt

SEQ ID NO: 157856 - DNA, 22 bp, Artificial Sequence
  chemically synthesized
tcactcttatggagtcaggtgt

SEQ ID NO: 157857 - DNA, 22 bp, Artificial Sequence
  chemically synthesized
cactcttatggagtcaggtgtc

SEQ ID NO: 157858 - DNA, 22 bp, Artificial Sequence
  chemically synthesized
actcttatggagtcaggtgtcc

SEQ ID NO: 157859 - DNA, 22 bp, Artificial Sequence
  chemically synthesized
ttatggagtcaggtgtccttct

SEQ ID NO: 157860 - DNA, 22 bp, Artificial Sequence
  chemically synthesized
atggagtcaggtgtccttctgg

SEQ ID NO: 157861 - DNA, 22 bp, Artificial Sequence
  chemically synthesized
tggagtcaggtgtccttctggc

SEQ ID NO: 157862 - DNA, 22 bp, Artificial Sequence
  chemically synthesized
ctggcaatgtcagtggaccgct

SEQ ID NO: 157863 - DNA, 22 bp, Artificial Sequence
  chemically synthesized
tggcaatgtcagtggaccgctt

SEQ ID NO: 157864 - DNA, 22 bp, Artificial Sequence
  chemically synthesized
gcaatgtcagtggaccgctttg

SEQ ID NO: 157865 - DNA, 22 bp, Artificial Sequence
  chemically synthesized
tgtggccatctacagcccactg

SEQ ID NO: 157866 - DNA, 22 bp, Artificial Sequence
  chemically synthesized
gtggccatctacagcccactgc

SEQ ID NO: 157867 - DNA, 22 bp, Artificial Sequence
  chemically synthesized
tggccatctacagcccactgcg

SEQ ID NO: 157868 - DNA, 22 bp, Artificial Sequence
  chemically synthesized
cagcccactgcgctacacaacc

SEQ ID NO: 157869 - DNA, 22 bp, Artificial Sequence
  chemically synthesized
cgctacacaaccattctgacaa

SEQ ID NO: 157870 - DNA, 22 bp, Artificial Sequence
  chemically synthesized
cacaaccattctgacaattgcc

SEQ ID NO: 157871 - DNA, 22 bp, Artificial Sequence
  chemically synthesized
tgacaattgcctgcatttctgg

SEQ ID NO: 157872 - DNA, 22 bp, Artificial Sequence
  chemically synthesized
acaattgcctgcatttctggga

SEQ ID NO: 157873 - DNA, 22 bp, Artificial Sequence
  chemically synthesized
cctgcatttctgggacgggtgc

SEQ ID NO: 157874 - DNA, 22 bp, Artificial Sequence
  chemically synthesized
catttctgggacgggtgccgcc

SEQ ID NO: 157875 - DNA, 22 bp, Artificial Sequence
  chemically synthesized
ctgggacgggtgccgccattgc

SEQ ID NO: 157876 - DNA, 22 bp, Artificial Sequence
  chemically synthesized
tgggacgggtgccgccattgcc

SEQ ID NO: 157877 - DNA, 22 bp, Artificial Sequence
  chemically synthesized
ggacgggtgccgccattgcctt

SEQ ID NO: 157878 - DNA, 22 bp, Artificial Sequence
  chemically synthesized
ccttgcgcagtgtaatgcttat

SEQ ID NO: 157879 - DNA, 22 bp, Artificial Sequence
  chemically synthesized
gcgcagtgtaatgcttatgctc

SEQ ID NO: 157880 - DNA, 22 bp, Artificial Sequence
  chemically synthesized
cgcagtgtaatgcttatgctcc

SEQ ID NO: 157881 - DNA, 22 bp, Artificial Sequence
  chemically synthesized
atgctcccactgctctttctcc

SEQ ID NO: 157882 - DNA, 22 bp, Artificial Sequence
  chemically synthesized
tgctcccactgctctttctcct

SEQ ID NO: 157883 - DNA, 22 bp, Artificial Sequence
  chemically synthesized
ccactgctctttctcctgaggc

SEQ ID NO: 157884 - DNA, 22 bp, Artificial Sequence
  chemically synthesized
ctctttctcctgaggcgtctgc

SEQ ID NO: 157885 - DNA, 22 bp, Artificial Sequence
  chemically synthesized
tttctcctgaggcgtctgcctt

SEQ ID NO: 157886 - DNA, 22 bp, Artificial Sequence
  chemically synthesized
tctcctgaggcgtctgcctttc

SEQ ID NO: 157887 - DNA, 22 bp, Artificial Sequence
  chemically synthesized
ctcctgaggcgtctgcctttct

SEQ ID NO: 157888 - DNA, 22 bp, Artificial Sequence
  chemically synthesized
tcctgaggcgtctgcctttctg

SEQ ID NO: 157889 - DNA, 22 bp, Artificial Sequence
  chemically synthesized
ctgaggcgtctgcctttctgtg

SEQ ID NO: 157890 - DNA, 22 bp, Artificial Sequence
  chemically synthesized
aggcgtctgcctttctgtggcc

SEQ ID NO: 157891 - DNA, 22 bp, Artificial Sequence
  chemically synthesized
cctttctgtggccacaataccc

SEQ ID NO: 157892 - DNA, 22 bp, Artificial Sequence
  chemically synthesized
tctgtggccacaataccctcac

SEQ ID NO: 157893 - DNA, 22 bp, Artificial Sequence
  chemically synthesized
ctgtggccacaataccctcaca

SEQ ID NO: 157894 - DNA, 22 bp, Artificial Sequence
  chemically synthesized
tgtggccacaataccctcacac

SEQ ID NO: 157895 - DNA, 22 bp, Artificial Sequence
  chemically synthesized
tggccacaataccctcacacac

SEQ ID NO: 157896 - DNA, 22 bp, Artificial Sequence
  chemically synthesized
acacactcttattgcctccact

SEQ ID NO: 157897 - DNA, 22 bp, Artificial Sequence
  chemically synthesized
ttattgcctccactcagatctg

SEQ ID NO: 157898 - DNA, 22 bp, Artificial Sequence
  chemically synthesized
attgcctccactcagatctgat

SEQ ID NO: 157899 - DNA, 22 bp, Artificial Sequence
  chemically synthesized
ttgcctccactcagatctgatc

SEQ ID NO: 157900 - DNA, 22 bp, Artificial Sequence
  chemically synthesized
cctccactcagatctgatcaaa

SEQ ID NO: 157901 - DNA, 22 bp, Artificial Sequence
  chemically synthesized
cactcagatctgatcaaattgc

SEQ ID NO: 157902 - DNA, 22 bp, Artificial Sequence
  chemically synthesized
agatctgatcaaattgccctgt

SEQ ID NO: 157903 - DNA, 22 bp, Artificial Sequence
  chemically synthesized
atcaaattgccctgtggagaca

SEQ ID NO: 157904 - DNA, 22 bp, Artificial Sequence
  chemically synthesized
ccctgtggagacacacgtccca

SEQ ID NO: 157905 - DNA, 22 bp, Artificial Sequence
  chemically synthesized
tggagacacacgtcccaatagc

SEQ ID NO: 157906 - DNA, 22 bp, Artificial Sequence
  chemically synthesized
gctctatttgtcattaccttca

SEQ ID NO: 157907 - DNA, 22 bp, Artificial Sequence
  chemically synthesized
tatttgtcattaccttcacatt

SEQ ID NO: 157908 - DNA, 22 bp, Artificial Sequence
  chemically synthesized
tttgtcattaccttcacatttg

SEQ ID NO: 157909 - DNA, 22 bp, Artificial Sequence
  chemically synthesized
gtcattaccttcacatttggac

SEQ ID NO: 157910 - DNA, 22 bp, Artificial Sequence
  chemically synthesized
tcattaccttcacatttggact

SEQ ID NO: 157911 - DNA, 22 bp, Artificial Sequence
  chemically synthesized
ccttcacatttggactggactt

SEQ ID NO: 157912 - DNA, 22 bp, Artificial Sequence
  chemically synthesized
cacatttggactggacttattg

SEQ ID NO: 157913 - DNA, 22 bp, Artificial Sequence
  chemically synthesized
acatttggactggacttattgt

SEQ ID NO: 157914 - DNA, 22 bp, Artificial Sequence
  chemically synthesized
ggactggacttattgttcattg

SEQ ID NO: 157915 - DNA, 22 bp, Artificial Sequence
  chemically synthesized
gactggacttattgttcattgt

SEQ ID NO: 157916 - DNA, 22 bp, Artificial Sequence
  chemically synthesized
gacttattgttcattgtggttt

SEQ ID NO: 157917 - DNA, 22 bp, Artificial Sequence
  chemically synthesized
attgttcattgtggtttcttat

SEQ ID NO: 157918 - DNA, 22 bp, Artificial Sequence
  chemically synthesized
ttgttcattgtggtttcttatg

SEQ ID NO: 157919 - DNA, 22 bp, Artificial Sequence
  chemically synthesized
ttcattgtggtttcttatgtgc

SEQ ID NO: 157920 - DNA, 22 bp, Artificial Sequence
  chemically synthesized
attgtggtttcttatgtgctga

SEQ ID NO: 157921 - DNA, 22 bp, Artificial Sequence
  chemically synthesized
tggtttcttatgtgctgattct

SEQ ID NO: 157922 - DNA, 22 bp, Artificial Sequence
  chemically synthesized
cttatgtgctgattcttcatac

SEQ ID NO: 157923 - DNA, 22 bp, Artificial Sequence
  chemically synthesized
ttatgtgctgattcttcataca

SEQ ID NO: 157924 - DNA, 22 bp, Artificial Sequence
  chemically synthesized
atgtgctgattcttcatacagt

SEQ ID NO: 157925 - DNA, 22 bp, Artificial Sequence
  chemically synthesized
tgtgctgattcttcatacagta

SEQ ID NO: 157926 - DNA, 22 bp, Artificial Sequence
  chemically synthesized
attcttcatacagtactggaaa

SEQ ID NO: 157927 - DNA, 22 bp, Artificial Sequence
  chemically synthesized
ttcatacagtactggaaatagc

SEQ ID NO: 157928 - DNA, 22 bp, Artificial Sequence
  chemically synthesized
catacagtactggaaatagctt

SEQ ID NO: 157929 - DNA, 22 bp, Artificial Sequence
  chemically synthesized
atacagtactggaaatagcttc

SEQ ID NO: 157930 - DNA, 22 bp, Artificial Sequence
  chemically synthesized
gaaatagcttctggagcagggc

SEQ ID NO: 157931 - DNA, 22 bp, Artificial Sequence
  chemically synthesized
ctggagcagggcggtggcaggc

SEQ ID NO: 157932 - DNA, 22 bp, Artificial Sequence
  chemically synthesized
tggagcagggcggtggcaggca

SEQ ID NO: 157933 - DNA, 22 bp, Artificial Sequence
  chemically synthesized
gagcagggcggtggcaggcact

SEQ ID NO: 157934 - DNA, 22 bp, Artificial Sequence
  chemically synthesized
aacacatgtgtgtcgcacatat

SEQ ID NO: 157935 - DNA, 22 bp, Artificial Sequence
  chemically synthesized
tgcttgtgtactatgtgcccat

SEQ ID NO: 157936 - DNA, 22 bp, Artificial Sequence
  chemically synthesized
gtgtactatgtgcccatgatca

SEQ ID NO: 157937 - DNA, 22 bp, Artificial Sequence
  chemically synthesized
tgtactatgtgcccatgatcag

SEQ ID NO: 157938 - DNA, 22 bp, Artificial Sequence
  chemically synthesized
tgtgcccatgatcagcctctcc

SEQ ID NO: 157939 - DNA, 22 bp, Artificial Sequence
  chemically synthesized
tccctgatgcaccgctttggac

SEQ ID NO: 157940 - DNA, 22 bp, Artificial Sequence
  chemically synthesized
cctgatgcaccgctttggacgg

SEQ ID NO: 157941 - DNA, 22 bp, Artificial Sequence
  chemically synthesized
atgcaccgctttggacggcatt

SEQ ID NO: 157942 - DNA, 22 bp, Artificial Sequence
  chemically synthesized
tggacggcatttacctccactt

SEQ ID NO: 157943 - DNA, 22 bp, Artificial Sequence
  chemically synthesized
ggacggcatttacctccacttt

SEQ ID NO: 157944 - DNA, 22 bp, Artificial Sequence
  chemically synthesized
gacggcatttacctccactttt

SEQ ID NO: 157945 - DNA, 22 bp, Artificial Sequence
  chemically synthesized
acctccacttttccagactgtc

SEQ ID NO: 157946 - DNA, 22 bp, Artificial Sequence
  chemically synthesized
cctccacttttccagactgtca

SEQ ID NO: 157947 - DNA, 22 bp, Artificial Sequence
  chemically synthesized
cacttttccagactgtcacggc

SEQ ID NO: 157948 - DNA, 22 bp, Artificial Sequence
  chemically synthesized
ttccagactgtcacggccaatg

SEQ ID NO: 157949 - DNA, 22 bp, Artificial Sequence
  chemically synthesized
tccagactgtcacggccaatgc

SEQ ID NO: 157950 - DNA, 22 bp, Artificial Sequence
  chemically synthesized
ccagactgtcacggccaatgct

SEQ ID NO: 157951 - DNA, 22 bp, Artificial Sequence
  chemically synthesized
cagactgtcacggccaatgctt

SEQ ID NO: 157952 - DNA, 22 bp, Artificial Sequence
  chemically synthesized
tcacggccaatgcttacctctt

SEQ ID NO: 157953 - DNA, 22 bp, Artificial Sequence
  chemically synthesized
acctcttttttcctcctgtggt

SEQ ID NO: 157954 - DNA, 22 bp, Artificial Sequence
  chemically synthesized
cctcttttttcctcctgtggtc

SEQ ID NO: 157955 - DNA, 22 bp, Artificial Sequence
  chemically synthesized
ttttttcctcctgtggtcaacc

SEQ ID NO: 157956 - DNA, 22 bp, Artificial Sequence
  chemically synthesized
ttttcctcctgtggtcaacccc

SEQ ID NO: 157957 - DNA, 22 bp, Artificial Sequence
  chemically synthesized
tttcctcctgtggtcaacccca

SEQ ID NO: 157958 - DNA, 22 bp, Artificial Sequence
  chemically synthesized
ttcctcctgtggtcaaccccat

SEQ ID NO: 157959 - DNA, 22 bp, Artificial Sequence
  chemically synthesized
tcctcctgtggtcaaccccatt

SEQ ID NO: 157960 - DNA, 22 bp, Artificial Sequence
  chemically synthesized
cctcctgtggtcaaccccattg

SEQ ID NO: 157961 - DNA, 22 bp, Artificial Sequence
  chemically synthesized
ctcctgtggtcaaccccattgt

SEQ ID NO: 157962 - DNA, 22 bp, Artificial Sequence
  chemically synthesized
ctgtggtcaaccccattgtcta

SEQ ID NO: 157963 - DNA, 22 bp, Artificial Sequence
  chemically synthesized
tggtcaaccccattgtctatag

SEQ ID NO: 157964 - DNA, 22 bp, Artificial Sequence
  chemically synthesized
tctatagtatcaaaatcaaaga

SEQ ID NO: 157965 - DNA, 22 bp, Artificial Sequence
  chemically synthesized
tagtatcaaaatcaaagaaatt

SEQ ID NO: 157966 - DNA, 22 bp, Artificial Sequence
  chemically synthesized
gcaacagcgttgttcttacact

SEQ ID NO: 157967 - DNA, 22 bp, Artificial Sequence
  chemically synthesized
ttcttacactatccaggaagag

SEQ ID NO: 157968 - DNA, 22 bp, Artificial Sequence
  chemically synthesized
ttacactatccaggaagagggg

SEQ ID NO: 157969 - DNA, 22 bp, Artificial Sequence
  chemically synthesized
acactatccaggaagaggggtg

SEQ ID NO: 157970 - DNA, 22 bp, Artificial Sequence
  chemically synthesized
cactatccaggaagaggggtga

SEQ ID NO: 157971 - DNA, 22 bp, Artificial Sequence
  chemically synthesized
tccaggaagaggggtgagttct

SEQ ID NO: 157972 - DNA, 22 bp, Artificial Sequence
  chemically synthesized
taatggagactgaagataccct

SEQ ID NO: 157973 - DNA, 22 bp, Artificial Sequence
  chemically synthesized
atggagactgaagataccctga

SEQ ID NO: 157974 - DNA, 22 bp, Artificial Sequence
  chemically synthesized
aagataccctgacagcacaggc

SEQ ID NO: 157975 - DNA, 22 bp, Artificial Sequence
  chemically synthesized
acagcacaggcacttagatcag

SEQ ID NO: 157976 - DNA, 22 bp, Artificial Sequence
  chemically synthesized
agatcaggctttattacctgaa

SEQ ID NO: 157977 - DNA, 22 bp, Artificial Sequence
  chemically synthesized
gatcaggctttattacctgaat

SEQ ID NO: 157978 - DNA, 22 bp, Artificial Sequence
  chemically synthesized
tattacctgaatattagctttg

SEQ ID NO: 157979 - DNA, 22 bp, Artificial Sequence
  chemically synthesized
attacctgaatattagctttgc

SEQ ID NO: 157980 - DNA, 22 bp, Artificial Sequence
  chemically synthesized
ttacctgaatattagctttgca

SEQ ID NO: 157981 - DNA, 22 bp, Artificial Sequence
  chemically synthesized
cctgaatattagctttgcaaat

SEQ ID NO: 157982 - DNA, 22 bp, Artificial Sequence
  chemically synthesized
aatattagctttgcaaatatga

SEQ ID NO: 157983 - DNA, 22 bp, Artificial Sequence
  chemically synthesized
gctttgcaaatatgaaaaattc

SEQ ID NO: 157984 - DNA, 22 bp, Artificial Sequence
  chemically synthesized
tgcaaatatgaaaaattccatg

SEQ ID NO: 157985 - DNA, 22 bp, Artificial Sequence
  chemically synthesized
gcaaatatgaaaaattccatgg

SEQ ID NO: 157986 - DNA, 22 bp, Artificial Sequence
  chemically synthesized
caaatatgaaaaattccatggc

SEQ ID NO: 157987 - DNA, 22 bp, Artificial Sequence
  chemically synthesized
catggcttattattgcttgtta

SEQ ID NO: 157988 - DNA, 22 bp, Artificial Sequence
  chemically synthesized
attattgcttgttaatgagctt

SEQ ID NO: 157989 - DNA, 22 bp, Artificial Sequence
  chemically synthesized
ttattgcttgttaatgagcttt

SEQ ID NO: 157990 - DNA, 22 bp, Artificial Sequence
  chemically synthesized
ttgcttgttaatgagctttaac

SEQ ID NO: 157991 - DNA, 22 bp, Artificial Sequence
  chemically synthesized
cttgttaatgagctttaacatt

SEQ ID NO: 157992 - DNA, 22 bp, Artificial Sequence
  chemically synthesized
gttaatgagctttaacattttg

SEQ ID NO: 157993 - DNA, 22 bp, Artificial Sequence
  chemically synthesized
ttaatgagctttaacattttgt

SEQ ID NO: 157994 - DNA, 22 bp, Artificial Sequence
  chemically synthesized
atgagctttaacattttgtaga

SEQ ID NO: 157995 - DNA, 22 bp, Artificial Sequence
  chemically synthesized
taacattttgtagatgaagaaa

SEQ ID NO: 157996 - DNA, 22 bp, Artificial Sequence
  chemically synthesized
aacattttgtagatgaagaaaa

SEQ ID NO: 157997 - DNA, 22 bp, Artificial Sequence
  chemically synthesized
acattttgtagatgaagaaaaa

SEQ ID NO: 157998 - DNA, 22 bp, Artificial Sequence
  chemically synthesized
tgtagatgaagaaaaaaaacag

SEQ ID NO: 157999 - DNA, 22 bp, Artificial Sequence
  chemically synthesized
gtagatgaagaaaaaaaacagt

SEQ ID NO: 158000 - DNA, 22 bp, Artificial Sequence
  chemically synthesized
tagatgaagaaaaaaaacagtt

SEQ ID NO: 158001 - DNA, 22 bp, Artificial Sequence
  chemically synthesized
tatatatttccctgagaatagg

SEQ ID NO: 158002 - DNA, 22 bp, Artificial Sequence
  chemically synthesized
atatatttccctgagaatagga

SEQ ID NO: 158003 - DNA, 22 bp, Artificial Sequence
  chemically synthesized
tatatttccctgagaataggaa

SEQ ID NO: 158004 - DNA, 22 bp, Artificial Sequence
  chemically synthesized
ccctgagaataggaaatggcat

SEQ ID NO: 158005 - DNA, 22 bp, Artificial Sequence
  chemically synthesized
cctgagaataggaaatggcatt

SEQ ID NO: 158006 - DNA, 22 bp, Artificial Sequence
  chemically synthesized
agaataggaaatggcattactc

SEQ ID NO: 158007 - DNA, 22 bp, Artificial Sequence
  chemically synthesized
ctctgaaataaaattgtgggag

SEQ ID NO: 158008 - DNA, 22 bp, Artificial Sequence
  chemically synthesized
tgaaataaaattgtgggaggag

SEQ ID NO: 158009 - DNA, 22 bp, Artificial Sequence
  chemically synthesized
aaataaaattgtgggaggaggc

SEQ ID NO: 158010 - DNA, 22 bp, Artificial Sequence
  chemically synthesized
tgggaggaggcatagaacacag

SEQ ID NO: 158011 - DNA, 22 bp, Artificial Sequence
  chemically synthesized
tgtcctggtgatgacacacttt

SEQ ID NO: 158012 - DNA, 22 bp, Artificial Sequence
  chemically synthesized
gtcctggtgatgacacactttg

SEQ ID NO: 158013 - DNA, 22 bp, Artificial Sequence
  chemically synthesized
tcctggtgatgacacactttgt

SEQ ID NO: 158014 - DNA, 22 bp, Artificial Sequence
  chemically synthesized
gtgatgacacactttgtgtgct

SEQ ID NO: 158015 - DNA, 22 bp, Artificial Sequence
  chemically synthesized
tgtgtgctgaatccttgaatac

SEQ ID NO: 158016 - DNA, 22 bp, Artificial Sequence
  chemically synthesized
gtgtgctgaatccttgaatact

SEQ ID NO: 158017 - DNA, 22 bp, Artificial Sequence
  chemically synthesized
tgtgctgaatccttgaatactc

SEQ ID NO: 158018 - DNA, 22 bp, Artificial Sequence
  chemically synthesized
aatccttgaatactcaattcag

SEQ ID NO: 158019 - DNA, 22 bp, Artificial Sequence
  chemically synthesized
gaatactcaattcagtgacatt

SEQ ID NO: 158020 - DNA, 22 bp, Artificial Sequence
  chemically synthesized
aatactcaattcagtgacattt

SEQ ID NO: 158021 - DNA, 22 bp, Artificial Sequence
  chemically synthesized
aattcagtgacatttggttctg

SEQ ID NO: 158022 - DNA, 22 bp, Artificial Sequence
  chemically synthesized
agtgacatttggttctgggaat

SEQ ID NO: 158023 - DNA, 22 bp, Artificial Sequence
  chemically synthesized
ggttctgggaatatgtagaaag

SEQ ID NO: 158024 - DNA, 22 bp, Artificial Sequence
  chemically synthesized
gttctgggaatatgtagaaaga

SEQ ID NO: 158025 - DNA, 22 bp, Artificial Sequence
  chemically synthesized
tgggaatatgtagaaagagtct

SEQ ID NO: 158026 - DNA, 22 bp, Artificial Sequence
  chemically synthesized
ggaatatgtagaaagagtcttg

SEQ ID NO: 158027 - DNA, 22 bp, Artificial Sequence
  chemically synthesized
ggggaggtttaagtttctggtt

SEQ ID NO: 158028 - DNA, 22 bp, Artificial Sequence
  chemically synthesized
gggaggtttaagtttctggtta

SEQ ID NO: 158029 - DNA, 22 bp, Artificial Sequence
  chemically synthesized
aagtttctggttatattaaaat

SEQ ID NO: 158030 - DNA, 22 bp, Artificial Sequence
  chemically synthesized
agtttctggttatattaaaatt

SEQ ID NO: 158031 - DNA, 22 bp, Artificial Sequence
  chemically synthesized
ctggttatattaaaattagtga

SEQ ID NO: 158032 - DNA, 22 bp, Artificial Sequence
  chemically synthesized
tggttatattaaaattagtgat

SEQ ID NO: 158033 - DNA, 22 bp, Artificial Sequence
  chemically synthesized
gttatattaaaattagtgatac

SEQ ID NO: 158034 - DNA, 22 bp, Artificial Sequence
  chemically synthesized
tattaaaattagtgatacatac

SEQ ID NO: 158035 - DNA, 22 bp, Artificial Sequence
  chemically synthesized
aaattagtgatacatacttgtg

SEQ ID NO: 158036 - DNA, 22 bp, Artificial Sequence
  chemically synthesized
gtgatacatacttgtgaaggaa

SEQ ID NO: 158037 - DNA, 22 bp, Artificial Sequence
  chemically synthesized
gtgaaggaaaataatcaggaca

SEQ ID NO: 158038 - DNA, 22 bp, Artificial Sequence
  chemically synthesized
tgaaggaaaataatcaggacac

SEQ ID NO: 158039 - DNA, 22 bp, Artificial Sequence
  chemically synthesized
tattattttgtttgtatagttt

SEQ ID NO: 158040 - DNA, 22 bp, Artificial Sequence
  chemically synthesized
ttttgtttgtatagtttcagaa

SEQ ID NO: 158041 - DNA, 22 bp, Artificial Sequence
  chemically synthesized
tgtttgtatagtttcagaacat

SEQ ID NO: 158042 - DNA, 22 bp, Artificial Sequence
  chemically synthesized
gtttgtatagtttcagaacatg

SEQ ID NO: 158043 - DNA, 22 bp, Artificial Sequence
  chemically synthesized
tttgtatagtttcagaacatgt

SEQ ID NO: 158044 - DNA, 22 bp, Artificial Sequence
  chemically synthesized
gtatagtttcagaacatgtaca

SEQ ID NO: 158045 - DNA, 22 bp, Artificial Sequence
  chemically synthesized
tatagtttcagaacatgtacat

SEQ ID NO: 158046 - DNA, 22 bp, Artificial Sequence
  chemically synthesized
cagaacatgtacatctaattta

SEQ ID NO: 158047 - DNA, 22 bp, Artificial Sequence
  chemically synthesized
agaacatgtacatctaatttaa

SEQ ID NO: 158048 - DNA, 22 bp, Artificial Sequence
  chemically synthesized
atttaatgtcaaaaaatcagaa

SEQ ID NO: 158049 - DNA, 22 bp, Artificial Sequence
  chemically synthesized
aatgtcaaaaaatcagaaccct

SEQ ID NO: 158050 - DNA, 22 bp, Artificial Sequence
  chemically synthesized
atgtcaaaaaatcagaaccctg

SEQ ID NO: 158051 - DNA, 22 bp, Artificial Sequence
  chemically synthesized
cttacctctgatggatataaag

SEQ ID NO: 158052 - DNA, 22 bp, Artificial Sequence
  chemically synthesized
acctctgatggatataaagatg

SEQ ID NO: 158053 - DNA, 22 bp, Artificial Sequence
  chemically synthesized
cctctgatggatataaagatgg

SEQ ID NO: 158054 - DNA, 22 bp, Artificial Sequence
  chemically synthesized
tgatggatataaagatggaaga

SEQ ID NO: 158055 - DNA, 22 bp, Artificial Sequence
  chemically synthesized
atggatataaagatggaagaat

SEQ ID NO: 158056 - DNA, 22 bp, Artificial Sequence
  chemically synthesized
ctggggagatggaaatattttg

SEQ ID NO: 158057 - DNA, 22 bp, Artificial Sequence
  chemically synthesized
tggggagatggaaatattttgt

SEQ ID NO: 158058 - DNA, 22 bp, Artificial Sequence
  chemically synthesized
gggagatggaaatattttgttg

SEQ ID NO: 158059 - DNA, 22 bp, Artificial Sequence
  chemically synthesized
tgttgtgttagggatgtggtga

SEQ ID NO: 158060 - DNA, 22 bp, Artificial Sequence
  chemically synthesized
gttgtgttagggatgtggtgac

SEQ ID NO: 158061 - DNA, 22 bp, Artificial Sequence
  chemically synthesized
ttgtgttagggatgtggtgaca

SEQ ID NO: 158062 - DNA, 22 bp, Artificial Sequence
  chemically synthesized
tgttagggatgtggtgacattg

SEQ ID NO: 158063 - DNA, 22 bp, Artificial Sequence
  chemically synthesized
gggatgtggtgacattgttttg

SEQ ID NO: 158064 - DNA, 22 bp, Artificial Sequence
  chemically synthesized
ttttgtcaatttgtcaaaacgg

SEQ ID NO: 158065 - DNA, 22 bp, Artificial Sequence
  chemically synthesized
tgtcaatttgtcaaaacggtac

SEQ ID NO: 158066 - DNA, 22 bp, Artificial Sequence
  chemically synthesized
gtcaatttgtcaaaacggtaca

SEQ ID NO: 158067 - DNA, 22 bp, Artificial Sequence
  chemically synthesized
tcaatttgtcaaaacggtacag

SEQ ID NO: 158068 - DNA, 22 bp, Artificial Sequence
  chemically synthesized
gtcaaaacggtacagctaagat

SEQ ID NO: 158069 - DNA, 22 bp, Artificial Sequence
  chemically synthesized
tcaaaacggtacagctaagatt

SEQ ID NO: 158070 - DNA, 22 bp, Artificial Sequence
  chemically synthesized
agatttgcacatttctaggtac

SEQ ID NO: 158071 - DNA, 22 bp, Artificial Sequence
  chemically synthesized
gcacatttctaggtacatcaat

SEQ ID NO: 158072 - DNA, 22 bp, Artificial Sequence
  chemically synthesized
cacatttctaggtacatcaatt

SEQ ID NO: 158073 - DNA, 22 bp, Artificial Sequence
  chemically synthesized
ctaggtacatcaattttacatc

SEQ ID NO: 158074 - DNA, 22 bp, Artificial Sequence
  chemically synthesized
taggtacatcaattttacatca

SEQ ID NO: 158075 - DNA, 22 bp, Artificial Sequence
  chemically synthesized
ggtacatcaattttacatcaaa

SEQ ID NO: 158076 - DNA, 22 bp, Artificial Sequence
  chemically synthesized
tacatcaaaacttctgaatgat

SEQ ID NO: 158077 - DNA, 22 bp, Artificial Sequence
  chemically synthesized
acatcaaaacttctgaatgata

SEQ ID NO: 158078 - DNA, 22 bp, Artificial Sequence
  chemically synthesized
catcaaaacttctgaatgataa

SEQ ID NO: 158079 - DNA, 22 bp, Artificial Sequence
  chemically synthesized
ctgaatgataataataacaaaa

SEQ ID NO: 158080 - DNA, 22 bp, Artificial Sequence
  chemically synthesized
tgaatgataataataacaaaaa

SEQ ID NO: 158081 - DNA, 22 bp, Artificial Sequence
  chemically synthesized
aatgataataataacaaaaagg

SEQ ID NO: 158082 - DNA, 22 bp, Artificial Sequence
  chemically synthesized
gatttcatagtgaatacaagtg

SEQ ID NO: 158083 - DNA, 22 bp, Artificial Sequence
  chemically synthesized
catagtgaatacaagtgtggaa

SEQ ID NO: 158084 - DNA, 22 bp, Artificial Sequence
  chemically synthesized
atagtgaatacaagtgtggaaa

SEQ ID NO: 158085 - DNA, 22 bp, Artificial Sequence
  chemically synthesized
ataattgttgaagttgtgtcat

SEQ ID NO: 158086 - DNA, 22 bp, Artificial Sequence
  chemically synthesized
ttgaagttgtgtcatgggtgcc

SEQ ID NO: 158087 - DNA, 22 bp, Artificial Sequence
  chemically synthesized
aagttgtgtcatgggtgcctgg

SEQ ID NO: 158088 - DNA, 22 bp, Artificial Sequence
  chemically synthesized
tgtcatgggtgcctggaaatta

SEQ ID NO: 158089 - DNA, 22 bp, Artificial Sequence
  chemically synthesized
gaaattaattataatattctgt

SEQ ID NO: 158090 - DNA, 22 bp, Artificial Sequence
  chemically synthesized
attataatattctgtttacttt

SEQ ID NO: 158091 - DNA, 22 bp, Artificial Sequence
  chemically synthesized
taatattctgtttactttgtgt

SEQ ID NO: 158092 - DNA, 22 bp, Artificial Sequence
  chemically synthesized
tgtttactttgtgtagtttaca

SEQ ID NO: 158093 - DNA, 22 bp, Artificial Sequence
  chemically synthesized
tttactttgtgtagtttacaat

SEQ ID NO: 158094 - DNA, 22 bp, Artificial Sequence
  chemically synthesized
actttgtgtagtttacaatttc

SEQ ID NO: 158095 - DNA, 22 bp, Artificial Sequence
  chemically synthesized
ctttgtgtagtttacaatttct

SEQ ID NO: 158096 - DNA, 22 bp, Artificial Sequence
  chemically synthesized
tgtgtagtttacaatttctgta

SEQ ID NO: 158097 - DNA, 22 bp, Artificial Sequence
  chemically synthesized
gtgtagtttacaatttctgtaa

SEQ ID NO: 158098 - DNA, 22 bp, Artificial Sequence
  chemically synthesized
tgtagtttacaatttctgtaat

SEQ ID NO: 158099 - DNA, 22 bp, Artificial Sequence
  chemically synthesized
acaatttctgtaataaaaagat

SEQ ID NO: 158100 - DNA, 22 bp, Artificial Sequence
  chemically synthesized
caatttctgtaataaaaagatt

SEQ ID NO: 158101 - DNA, 22 bp, Artificial Sequence
  chemically synthesized
ctgtaataaaaagattcttaaa

SEQ ID NO: 158102 - DNA, 22 bp, Artificial Sequence
  chemically synthesized
tgtaataaaaagattcttaaaa

SEQ ID NO: 158103 - DNA, 22 bp, Artificial Sequence
  chemically synthesized
taataaaaagattcttaaaaaa

SEQ ID NO: 158104 - DNA, 22 bp, Artificial Sequence
  chemically synthesized
ttaaaaaaattatactcagtgt

SEQ ID NO: 158105 - DNA, 22 bp, Artificial Sequence
  chemically synthesized
aaaaaaattatactcagtgtgc

SEQ ID NO: 158106 - DNA, 22 bp, Artificial Sequence
  chemically synthesized
aaaaaattatactcagtgtgct

SEQ ID NO: 158107 - DNA, 22 bp, Artificial Sequence
  chemically synthesized
tactcagtgtgctaatgttaaa

SEQ ID NO: 158108 - DNA, 22 bp, Artificial Sequence
  chemically synthesized
agtgtgctaatgttaaatctta

SEQ ID NO: 158109 - DNA, 22 bp, Artificial Sequence
  chemically synthesized
atgttaaatcttaattgaatat

SEQ ID NO: 158110 - DNA, 22 bp, Artificial Sequence
  chemically synthesized
aatcttaattgaatatgcacca

SEQ ID NO: 158111 - DNA, 22 bp, Artificial Sequence
  chemically synthesized
aattgaatatgcaccatgaagc

SEQ ID NO: 158112 - DNA, 22 bp, Artificial Sequence
  chemically synthesized
attgaatatgcaccatgaagca

SEQ ID NO: 158113 - DNA, 22 bp, Artificial Sequence
  chemically synthesized
aatatgcaccatgaagcagaga

SEQ ID NO: 158114 - DNA, 22 bp, Artificial Sequence
  chemically synthesized
ttaactggtcaggaggaaactg

SEQ ID NO: 158115 - DNA, 22 bp, Artificial Sequence
  chemically synthesized
taactggtcaggaggaaactgt

SEQ ID NO: 158116 - DNA, 22 bp, Artificial Sequence
  chemically synthesized
aactggtcaggaggaaactgtt

SEQ ID NO: 158117 - DNA, 22 bp, Artificial Sequence
  chemically synthesized
actggtcaggaggaaactgttt

SEQ ID NO: 158118 - DNA, 22 bp, Artificial Sequence
  chemically synthesized
gtcaggaggaaactgtttggct

SEQ ID NO: 158119 - DNA, 22 bp, Artificial Sequence
  chemically synthesized
tttggctttagaaagctatttt

SEQ ID NO: 158120 - DNA, 22 bp, Artificial Sequence
  chemically synthesized
ggctttagaaagctattttatt

SEQ ID NO: 158121 - DNA, 22 bp, Artificial Sequence
  chemically synthesized
gctttagaaagctattttattt

SEQ ID NO: 158122 - DNA, 22 bp, Artificial Sequence
  chemically synthesized
tagaaagctattttatttttaa

SEQ ID NO: 158123 - DNA, 22 bp, Artificial Sequence
  chemically synthesized
agaaagctattttatttttaat

SEQ ID NO: 158124 - DNA, 22 bp, Artificial Sequence
  chemically synthesized
gaaagctattttatttttaatg

SEQ ID NO: 158125 - DNA, 22 bp, Artificial Sequence
  chemically synthesized
ttttatttttaatgagttcaat

SEQ ID NO: 158126 - DNA, 22 bp, Artificial Sequence
  chemically synthesized
tatttttaatgagttcaatact

SEQ ID NO: 158127 - DNA, 22 bp, Artificial Sequence
  chemically synthesized
atttttaatgagttcaatacta

SEQ ID NO: 158128 - DNA, 22 bp, Artificial Sequence
  chemically synthesized
tttttaatgagttcaatactag

SEQ ID NO: 158129 - DNA, 22 bp, Artificial Sequence
  chemically synthesized
ttaatgagttcaatactagaaa

SEQ ID NO: 158130 - DNA, 22 bp, Artificial Sequence
  chemically synthesized
taatgagttcaatactagaaag

SEQ ID NO: 158131 - DNA, 22 bp, Artificial Sequence
  chemically synthesized
aatgagttcaatactagaaaga

SEQ ID NO: 158132 - DNA, 22 bp, Artificial Sequence
  chemically synthesized
atgagttcaatactagaaagaa

SEQ ID NO: 158133 - DNA, 22 bp, Artificial Sequence
  chemically synthesized
aatactagaaagaaaaaaaacc

SEQ ID NO: 158134 - DNA, 22 bp, Artificial Sequence
  chemically synthesized
gaaagaaaaaaaaccacaacta

SEQ ID NO: 158135 - DNA, 22 bp, Artificial Sequence
  chemically synthesized
cttgaaaatactgttttagaag

SEQ ID NO: 158136 - DNA, 22 bp, Artificial Sequence
  chemically synthesized
gaaaatactgttttagaagaaa

SEQ ID NO: 158137 - DNA, 22 bp, Artificial Sequence
  chemically synthesized
aaaatactgttttagaagaaaa

SEQ ID NO: 158138 - DNA, 22 bp, Artificial Sequence
  chemically synthesized
ttttagaagaaaataactaaaa

SEQ ID NO: 158139 - DNA, 22 bp, Artificial Sequence
  chemically synthesized
tagaagaaaataactaaaaaac

SEQ ID NO: 158140 - DNA, 22 bp, Artificial Sequence
  chemically synthesized
agaagaaaataactaaaaaaca

SEQ ID NO: 158141 - DNA, 22 bp, Artificial Sequence
  chemically synthesized
gaagaaaataactaaaaaacag

SEQ ID NO: 158142 - DNA, 22 bp, Artificial Sequence
  chemically synthesized
aaaaacagaaaaagcaaggcct

SEQ ID NO: 158143 - DNA, 22 bp, Artificial Sequence
  chemically synthesized
ctcctgcaatagtctttggtga

SEQ ID NO: 158144 - DNA, 22 bp, Artificial Sequence
  chemically synthesized
ctgcaatagtctttggtgacat

SEQ ID NO: 158145 - DNA, 22 bp, Artificial Sequence
  chemically synthesized
caatagtctttggtgacatcaa

SEQ ID NO: 158146 - DNA, 22 bp, Artificial Sequence
  chemically synthesized
tggtgacatcaatcactcggta

SEQ ID NO: 158147 - DNA, 22 bp, Artificial Sequence
  chemically synthesized
ggtgacatcaatcactcggtag

SEQ ID NO: 158148 - DNA, 22 bp, Artificial Sequence
  chemically synthesized
gtgacatcaatcactcggtagt

SEQ ID NO: 158149 - DNA, 22 bp, Artificial Sequence
  chemically synthesized
ggtagtagacaagcttctgaca

SEQ ID NO: 158150 - DNA, 22 bp, Artificial Sequence
  chemically synthesized
ctgacaaacaaaaaggtaggga

SEQ ID NO: 158151 - DNA, 22 bp, Artificial Sequence
  chemically synthesized
tgacaaacaaaaaggtagggag

SEQ ID NO: 158152 - DNA, 22 bp, Artificial Sequence
  chemically synthesized
acaaacaaaaaggtagggagga

SEQ ID NO: 158153 - DNA, 22 bp, Artificial Sequence
  chemically synthesized
tagaaaatccctcagacaggga

SEQ ID NO: 158154 - DNA, 22 bp, Artificial Sequence
  chemically synthesized
gaaaatccctcagacagggatt

SEQ ID NO: 158155 - DNA, 22 bp, Artificial Sequence
  chemically synthesized
agacagggattgcagagcccaa

SEQ ID NO: 158156 - DNA, 22 bp, Artificial Sequence
  chemically synthesized
cagagcccaactttttgttttc

SEQ ID NO: 158157 - DNA, 22 bp, Artificial Sequence
  chemically synthesized
tttgttttcttcagataatttt

SEQ ID NO: 158158 - DNA, 22 bp, Artificial Sequence
  chemically synthesized
ttgttttcttcagataattttg

SEQ ID NO: 158159 - DNA, 22 bp, Artificial Sequence
  chemically synthesized
tgttttcttcagataattttga

SEQ ID NO: 158160 - DNA, 22 bp, Artificial Sequence
  chemically synthesized
gttttcttcagataattttgaa

SEQ ID NO: 158161 - DNA, 22 bp, Artificial Sequence
  chemically synthesized
ttttcttcagataattttgaat

SEQ ID NO: 158162 - DNA, 22 bp, Artificial Sequence
  chemically synthesized
tcttcagataattttgaatttc

SEQ ID NO: 158163 - DNA, 22 bp, Artificial Sequence
  chemically synthesized
cttcagataattttgaatttcc

SEQ ID NO: 158164 - DNA, 22 bp, Artificial Sequence
  chemically synthesized
ttcagataattttgaatttcca

SEQ ID NO: 158165 - DNA, 22 bp, Artificial Sequence
  chemically synthesized
cagataattttgaatttccatg

SEQ ID NO: 158166 - DNA, 22 bp, Artificial Sequence
  chemically synthesized
agataattttgaatttccatga

SEQ ID NO: 158167 - DNA, 22 bp, Artificial Sequence
  chemically synthesized
tgaatttccatgaaccacagtg

SEQ ID NO: 158168 - DNA, 22 bp, Artificial Sequence
  chemically synthesized
gaatttccatgaaccacagtga

SEQ ID NO: 158169 - DNA, 22 bp, Artificial Sequence
  chemically synthesized
aatttccatgaaccacagtgaa

SEQ ID NO: 158170 - DNA, 22 bp, Artificial Sequence
  chemically synthesized
ccatgaaccacagtgaatatcc

SEQ ID NO: 158171 - DNA, 22 bp, Artificial Sequence
  chemically synthesized
catgaaccacagtgaatatcct

SEQ ID NO: 158172 - DNA, 22 bp, Artificial Sequence
  chemically synthesized
ttaaaccacacagtcttgagtg

SEQ ID NO: 158173 - DNA, 22 bp, Artificial Sequence
  chemically synthesized
aaccacacagtcttgagtgatt

SEQ ID NO: 158174 - DNA, 22 bp, Artificial Sequence
  chemically synthesized
gagtgattatcagccaaccaag

SEQ ID NO: 158175 - DNA, 22 bp, Artificial Sequence
  chemically synthesized
agtgattatcagccaaccaagt

SEQ ID NO: 158176 - DNA, 22 bp, Artificial Sequence
  chemically synthesized
tcagccaaccaagtaactaata

SEQ ID NO: 158177 - DNA, 22 bp, Artificial Sequence
  chemically synthesized
atagaaggtttggtcaaataaa

SEQ ID NO: 158178 - DNA, 22 bp, Artificial Sequence
  chemically synthesized
ggtcaaataaaaatatgtatca

SEQ ID NO: 158179 - DNA, 22 bp, Artificial Sequence
  chemically synthesized
gtcaaataaaaatatgtatcaa

SEQ ID NO: 158180 - DNA, 22 bp, Artificial Sequence
  chemically synthesized
atatttttttctgttttcctcg

SEQ ID NO: 158181 - DNA, 22 bp, Artificial Sequence
  chemically synthesized
tatttttttctgttttcctcga

SEQ ID NO: 158182 - DNA, 22 bp, Artificial Sequence
  chemically synthesized
ttttctgttttcctcgaaatta

SEQ ID NO: 158183 - DNA, 22 bp, Artificial Sequence
  chemically synthesized
tttctgttttcctcgaaattaa

SEQ ID NO: 158184 - DNA, 22 bp, Artificial Sequence
  chemically synthesized
ttctgttttcctcgaaattaat

SEQ ID NO: 158185 - DNA, 22 bp, Artificial Sequence
  chemically synthesized
tctgttttcctcgaaattaatt

SEQ ID NO: 158186 - DNA, 22 bp, Artificial Sequence
  chemically synthesized
ctgttttcctcgaaattaattt

SEQ ID NO: 158187 - DNA, 22 bp, Artificial Sequence
  chemically synthesized
tgttttcctcgaaattaattta

SEQ ID NO: 158188 - DNA, 22 bp, Artificial Sequence
  chemically synthesized
ttttcctcgaaattaatttatg

SEQ ID NO: 158189 - DNA, 22 bp, Artificial Sequence
  chemically synthesized
tcctcgaaattaatttatggac

SEQ ID NO: 158190 - DNA, 22 bp, Artificial Sequence
  chemically synthesized
cctcgaaattaatttatggact

SEQ ID NO: 158191 - DNA, 22 bp, Artificial Sequence
  chemically synthesized
ctcgaaattaatttatggactt

SEQ ID NO: 158192 - DNA, 22 bp, Artificial Sequence
  chemically synthesized
gaaattaatttatggacttaaa

SEQ ID NO: 158193 - DNA, 22 bp, Artificial Sequence
  chemically synthesized
atttatggacttaaaaaatttt

SEQ ID NO: 158194 - DNA, 22 bp, Artificial Sequence
  chemically synthesized
atggacttaaaaaatttttaat

SEQ ID NO: 158195 - DNA, 22 bp, Artificial Sequence
  chemically synthesized
tggacttaaaaaatttttaatg

SEQ ID NO: 158196 - DNA, 22 bp, Artificial Sequence
  chemically synthesized
aaaaaatttttaatgtatgaaa

SEQ ID NO: 158197 - DNA, 22 bp, Artificial Sequence
  chemically synthesized
aaaaatttttaatgtatgaaac

SEQ ID NO: 158198 - DNA, 22 bp, Artificial Sequence
  chemically synthesized
ttaatgtatgaaacacctttga

SEQ ID NO: 158199 - DNA, 22 bp, Artificial Sequence
  chemically synthesized
taatgtatgaaacacctttgaa

SEQ ID NO: 158200 - DNA, 22 bp, Artificial Sequence
  chemically synthesized
aatgtatgaaacacctttgaaa

SEQ ID NO: 158201 - DNA, 22 bp, Artificial Sequence
  chemically synthesized
atgtatgaaacacctttgaaag

SEQ ID NO: 158202 - DNA, 22 bp, Artificial Sequence
  chemically synthesized
tgaaagtgttcaatgtagtgaa

SEQ ID NO: 158203 - DNA, 22 bp, Artificial Sequence
  chemically synthesized
gaaagtgttcaatgtagtgaag

SEQ ID NO: 158204 - DNA, 22 bp, Artificial Sequence
  chemically synthesized
aaagtgttcaatgtagtgaagt

SEQ ID NO: 158205 - DNA, 22 bp, Artificial Sequence
  chemically synthesized
aatgtagtgaagtcataaaaac

SEQ ID NO: 158206 - DNA, 22 bp, Artificial Sequence
  chemically synthesized
aaaaaaaaattctcaaaatttc

SEQ ID NO: 158207 - DNA, 22 bp, Artificial Sequence
  chemically synthesized
aaaaaaaattctcaaaatttca

SEQ ID NO: 158208 - DNA, 22 bp, Artificial Sequence
  chemically synthesized
tcaaaatttcagagtaatttag

SEQ ID NO: 158209 - DNA, 22 bp, Artificial Sequence
  chemically synthesized
aaaatttcagagtaatttagaa

SEQ ID NO: 158210 - DNA, 22 bp, Artificial Sequence
  chemically synthesized
cagagtaatttagaagcccttc

SEQ ID NO: 158211 - DNA, 22 bp, Artificial Sequence
  chemically synthesized
agagtaatttagaagcccttcc

SEQ ID NO: 158212 - DNA, 22 bp, Artificial Sequence
  chemically synthesized
agaagcccttccttaacaataa

SEQ ID NO: 158213 - DNA, 22 bp, Artificial Sequence
  chemically synthesized
gaagcccttccttaacaataat

SEQ ID NO: 158214 - DNA, 22 bp, Artificial Sequence
  chemically synthesized
ccttaacaataattattggtaa

SEQ ID NO: 158215 - DNA, 22 bp, Artificial Sequence
  chemically synthesized
cttaacaataattattggtaac

SEQ ID NO: 158216 - DNA, 22 bp, Artificial Sequence
  chemically synthesized
aacaataattattggtaacctc

SEQ ID NO: 158217 - DNA, 22 bp, Artificial Sequence
  chemically synthesized
acaataattattggtaacctcc

SEQ ID NO: 158218 - DNA, 22 bp, Artificial Sequence
  chemically synthesized
ttggtaacctccattacagtcc

SEQ ID NO: 158219 - DNA, 22 bp, Artificial Sequence
  chemically synthesized
gtaacctccattacagtcctgt

SEQ ID NO: 158220 - DNA, 22 bp, Artificial Sequence
  chemically synthesized
cattacagtcctgtattactat

SEQ ID NO: 158221 - DNA, 22 bp, Artificial Sequence
  chemically synthesized
cagtcctgtattactattctta

SEQ ID NO: 158222 - DNA, 22 bp, Artificial Sequence
  chemically synthesized
tattactattcttatggtatac

SEQ ID NO: 158223 - DNA, 22 bp, Artificial Sequence
  chemically synthesized
ctattcttatggtatacatgaa

SEQ ID NO: 158224 - DNA, 22 bp, Artificial Sequence
  chemically synthesized
ttcttatggtatacatgaaaaa

SEQ ID NO: 158225 - DNA, 22 bp, Artificial Sequence
  chemically synthesized
ttatggtatacatgaaaaaact

SEQ ID NO: 158226 - DNA, 22 bp, Artificial Sequence
  chemically synthesized
atggtatacatgaaaaaactaa

SEQ ID NO: 158227 - DNA, 22 bp, Artificial Sequence
  chemically synthesized
tggtatacatgaaaaaactaag

SEQ ID NO: 158228 - DNA, 22 bp, Artificial Sequence
  chemically synthesized
agagataatttttgtaacttta

SEQ ID NO: 158229 - DNA, 22 bp, Artificial Sequence
  chemically synthesized
ttgtaactttatcaagttcaca

SEQ ID NO: 158230 - DNA, 22 bp, Artificial Sequence
  chemically synthesized
tgtaactttatcaagttcacac

SEQ ID NO: 158231 - DNA, 22 bp, Artificial Sequence
  chemically synthesized
gtaactttatcaagttcacaca

SEQ ID NO: 158232 - DNA, 22 bp, Artificial Sequence
  chemically synthesized
taactttatcaagttcacacaa

SEQ ID NO: 158233 - DNA, 22 bp, Artificial Sequence
  chemically synthesized
tatcaagttcacacaatggaaa

SEQ ID NO: 158234 - DNA, 22 bp, Artificial Sequence
  chemically synthesized
atcaagttcacacaatggaaaa

SEQ ID NO: 158235 - DNA, 22 bp, Artificial Sequence
  chemically synthesized
tcaagttcacacaatggaaaac

SEQ ID NO: 158236 - DNA, 22 bp, Artificial Sequence
  chemically synthesized
acacaatggaaaacttgtacac

SEQ ID NO: 158237 - DNA, 22 bp, Artificial Sequence
  chemically synthesized
gtacacccaagagccaagtcct

SEQ ID NO: 158238 - DNA, 22 bp, Artificial Sequence
  chemically synthesized
tacacccaagagccaagtcctc

SEQ ID NO: 158239 - DNA, 22 bp, Artificial Sequence
  chemically synthesized
agtgtgatgttatacacttgaa

SEQ ID NO: 158240 - DNA, 22 bp, Artificial Sequence
  chemically synthesized
tacacttgaaccagatgtacct

SEQ ID NO: 158241 - DNA, 22 bp, Artificial Sequence
  chemically synthesized
gaaccagatgtacctaggttga

SEQ ID NO: 158242 - DNA, 22 bp, Artificial Sequence
  chemically synthesized
aaccagatgtacctaggttgaa

SEQ ID NO: 158243 - DNA, 22 bp, Artificial Sequence
  chemically synthesized
ggttgaaatcttagctatcttg

SEQ ID NO: 158244 - DNA, 22 bp, Artificial Sequence
  chemically synthesized
aaatcttagctatcttgctatt

SEQ ID NO: 158245 - DNA, 22 bp, Artificial Sequence
  chemically synthesized
agctatcttgctattagtaatt

SEQ ID NO: 158246 - DNA, 22 bp, Artificial Sequence
  chemically synthesized
gctatcttgctattagtaattg

SEQ ID NO: 158247 - DNA, 22 bp, Artificial Sequence
  chemically synthesized
tcttgctattagtaattgtggg

SEQ ID NO: 158248 - DNA, 22 bp, Artificial Sequence
  chemically synthesized
gctattagtaattgtgggatct

SEQ ID NO: 158249 - DNA, 22 bp, Artificial Sequence
  chemically synthesized
ctattagtaattgtgggatctt

SEQ ID NO: 158250 - DNA, 22 bp, Artificial Sequence
  chemically synthesized
ttagtaattgtgggatcttgct

SEQ ID NO: 158251 - DNA, 22 bp, Artificial Sequence
  chemically synthesized
gtaattgtgggatcttgctagt

SEQ ID NO: 158252 - DNA, 22 bp, Artificial Sequence
  chemically synthesized
tgggatcttgctagtagtatga

SEQ ID NO: 158253 - DNA, 22 bp, Artificial Sequence
  chemically synthesized
gctagtagtatgacctgtttga

SEQ ID NO: 158254 - DNA, 22 bp, Artificial Sequence
  chemically synthesized
ctagtagtatgacctgtttgaa

SEQ ID NO: 158255 - DNA, 22 bp, Artificial Sequence
  chemically synthesized
gtagtatgacctgtttgaatat

SEQ ID NO: 158256 - DNA, 22 bp, Artificial Sequence
  chemically synthesized
tttgaatataatttattcattt

SEQ ID NO: 158257 - DNA, 22 bp, Artificial Sequence
  chemically synthesized
gaatataatttattcatttata

SEQ ID NO: 158258 - DNA, 22 bp, Artificial Sequence
  chemically synthesized
aatataatttattcatttataa

SEQ ID NO: 158259 - DNA, 22 bp, Artificial Sequence
  chemically synthesized
attcatttataaatgaataaga

SEQ ID NO: 158260 - DNA, 22 bp, Artificial Sequence
  chemically synthesized
ttcatttataaatgaataagaa

SEQ ID NO: 158261 - DNA, 22 bp, Artificial Sequence
  chemically synthesized
atttataaatgaataagaaaat

SEQ ID NO: 158262 - DNA, 22 bp, Artificial Sequence
  chemically synthesized
ataaatgaataagaaaataaaa

SEQ ID NO: 158263 - DNA, 22 bp, Artificial Sequence
  chemically synthesized
taaatgaataagaaaataaaat

SEQ ID NO: 158264 - DNA, 22 bp, Artificial Sequence
  chemically synthesized
ttatgatcttgaagattaaatg

SEQ ID NO: 158265 - DNA, 22 bp, Artificial Sequence
  chemically synthesized
tatgatcttgaagattaaatga

SEQ ID NO: 158266 - DNA, 22 bp, Artificial Sequence
  chemically synthesized
atgatcttgaagattaaatgaa

SEQ ID NO: 158267 - DNA, 22 bp, Artificial Sequence
  chemically synthesized
tgatcttgaagattaaatgaaa

SEQ ID NO: 158268 - DNA, 22 bp, Artificial Sequence
  chemically synthesized
gaagattaaatgaaatggtgca

SEQ ID NO: 158269 - DNA, 22 bp, Artificial Sequence
  chemically synthesized
aagattaaatgaaatggtgcac

SEQ ID NO: 158270 - DNA, 22 bp, Artificial Sequence
  chemically synthesized
aatgaaatggtgcacattaagc

SEQ ID NO: 158271 - DNA, 22 bp, Artificial Sequence
  chemically synthesized
agcaattagcaaagttcctagt

SEQ ID NO: 158272 - DNA, 22 bp, Artificial Sequence
  chemically synthesized
gcaaagttcctagtaaaatttg

SEQ ID NO: 158273 - DNA, 22 bp, Artificial Sequence
  chemically synthesized
ctagtaaaatttgctcaataag

SEQ ID NO: 158274 - DNA, 22 bp, Artificial Sequence
  chemically synthesized
gtaaaatttgctcaataagtaa

SEQ ID NO: 158275 - DNA, 22 bp, Artificial Sequence
  chemically synthesized
gctcaataagtaattatatttt

SEQ ID NO: 158276 - DNA, 22 bp, Artificial Sequence
  chemically synthesized
ctcaataagtaattatatttta

SEQ ID NO: 158277 - DNA, 22 bp, Artificial Sequence
  chemically synthesized
aataagtaattatattttatta

SEQ ID NO: 158278 - DNA, 22 bp, Artificial Sequence
  chemically synthesized
tattttattaagtaattacttt

SEQ ID NO: 158279 - DNA, 22 bp, Artificial Sequence
  chemically synthesized
tattaagtaattactttttcac

SEQ ID NO: 158280 - DNA, 22 bp, Artificial Sequence
  chemically synthesized
attaagtaattactttttcacc

SEQ ID NO: 158281 - DNA, 22 bp, Artificial Sequence
  chemically synthesized
ttaagtaattactttttcacca

SEQ ID NO: 158282 - DNA, 22 bp, Artificial Sequence
  chemically synthesized
agtaattactttttcaccaaat

SEQ ID NO: 158283 - DNA, 22 bp, Artificial Sequence
  chemically synthesized
ctttttcaccaaatctgactac

SEQ ID NO: 158284 - DNA, 22 bp, Artificial Sequence
  chemically synthesized
tttcaccaaatctgactacaat

SEQ ID NO: 158285 - DNA, 22 bp, Artificial Sequence
  chemically synthesized
ttcaccaaatctgactacaata

SEQ ID NO: 158286 - DNA, 22 bp, Artificial Sequence
  chemically synthesized
tcaccaaatctgactacaatac

SEQ ID NO: 158287 - DNA, 22 bp, Artificial Sequence
  chemically synthesized
caccaaatctgactacaatacg

SEQ ID NO: 158288 - DNA, 22 bp, Artificial Sequence
  chemically synthesized
accaaatctgactacaatacgt

SEQ ID NO: 158289 - DNA, 22 bp, Artificial Sequence
  chemically synthesized
actacaatacgtgaatacacag

SEQ ID NO: 158290 - DNA, 22 bp, Artificial Sequence
  chemically synthesized
caatacgtgaatacacagtcaa

SEQ ID NO: 158291 - DNA, 22 bp, Artificial Sequence
  chemically synthesized
cacaattcctgacagtctctct

SEQ ID NO: 158292 - DNA, 22 bp, Artificial Sequence
  chemically synthesized
acaattcctgacagtctctcta

SEQ ID NO: 158293 - DNA, 22 bp, Artificial Sequence
  chemically synthesized
ctgacagtctctctaaatgcta

SEQ ID NO: 158294 - DNA, 22 bp, Artificial Sequence
  chemically synthesized
acagtctctctaaatgctaatt

SEQ ID NO: 158295 - DNA, 22 bp, Artificial Sequence
  chemically synthesized
tctaaatgctaattttaaactc

SEQ ID NO: 158296 - DNA, 22 bp, Artificial Sequence
  chemically synthesized
taaatgctaattttaaactcaa

SEQ ID NO: 158297 - DNA, 22 bp, Artificial Sequence
  chemically synthesized
aatgctaattttaaactcaagt

SEQ ID NO: 158298 - DNA, 22 bp, Artificial Sequence
  chemically synthesized
attttaaactcaagtacataaa

SEQ ID NO: 158299 - DNA, 22 bp, Artificial Sequence
  chemically synthesized
taaactcaagtacataaaaatt

SEQ ID NO: 158300 - DNA, 22 bp, Artificial Sequence
  chemically synthesized
aaactcaagtacataaaaatta

SEQ ID NO: 158301 - DNA, 22 bp, Artificial Sequence
  chemically synthesized
aactcaagtacataaaaattaa

SEQ ID NO: 158302 - DNA, 22 bp, Artificial Sequence
  chemically synthesized
aagtacataaaaattaaagtca

SEQ ID NO: 158303 - DNA, 22 bp, Artificial Sequence
  chemically synthesized
aagtcacaaatttctctgtcac

SEQ ID NO: 158304 - DNA, 22 bp, Artificial Sequence
  chemically synthesized
ctctgtcacgagctatagtgta

SEQ ID NO: 158305 - DNA, 22 bp, Artificial Sequence
  chemically synthesized
tctgtcacgagctatagtgtac

SEQ ID NO: 158306 - DNA, 22 bp, Artificial Sequence
  chemically synthesized
tgtcacgagctatagtgtacca

SEQ ID NO: 158307 - DNA, 22 bp, Artificial Sequence
  chemically synthesized
tcacgagctatagtgtaccata

SEQ ID NO: 158308 - DNA, 22 bp, Artificial Sequence
  chemically synthesized
tagtgtaccatactaagtgatt

SEQ ID NO: 158309 - DNA, 22 bp, Artificial Sequence
  chemically synthesized
agtgatttatatagattagttc

SEQ ID NO: 158310 - DNA, 22 bp, Artificial Sequence
  chemically synthesized
atatagattagttcatttaatc

SEQ ID NO: 158311 - DNA, 22 bp, Artificial Sequence
  chemically synthesized
tatagattagttcatttaatcc

SEQ ID NO: 158312 - DNA, 22 bp, Artificial Sequence
  chemically synthesized
gttcatttaatccacggaacaa

SEQ ID NO: 158313 - DNA, 22 bp, Artificial Sequence
  chemically synthesized
atttaatccacggaacaaatat

SEQ ID NO: 158314 - DNA, 22 bp, Artificial Sequence
  chemically synthesized
aatccacggaacaaatatatga

SEQ ID NO: 158315 - DNA, 22 bp, Artificial Sequence
  chemically synthesized
atccacggaacaaatatatgaa

SEQ ID NO: 158316 - DNA, 22 bp, Artificial Sequence
  chemically synthesized
tcagtttgtctacatgttacaa

SEQ ID NO: 158317 - DNA, 22 bp, Artificial Sequence
  chemically synthesized
gtctacatgttacaaatgtaga

SEQ ID NO: 158318 - DNA, 22 bp, Artificial Sequence
  chemically synthesized
tctacatgttacaaatgtagaa

SEQ ID NO: 158319 - DNA, 22 bp, Artificial Sequence
  chemically synthesized
catgttacaaatgtagaaacag

SEQ ID NO: 158320 - DNA, 22 bp, Artificial Sequence
  chemically synthesized
caaatgtagaaacagaaacata

SEQ ID NO: 158321 - DNA, 22 bp, Artificial Sequence
  chemically synthesized
ataagtggcagaatcacaactc

SEQ ID NO: 158322 - DNA, 22 bp, Artificial Sequence
  chemically synthesized
aaaaccagacaatccaactaaa

SEQ ID NO: 158323 - DNA, 22 bp, Artificial Sequence
  chemically synthesized
aaaacctgattctttagcccac

SEQ ID NO: 158324 - DNA, 22 bp, Artificial Sequence
  chemically synthesized
attctttagcccaccatattat

SEQ ID NO: 158325 - DNA, 22 bp, Artificial Sequence
  chemically synthesized
tttagcccaccatattatcagt

SEQ ID NO: 158326 - DNA, 22 bp, Artificial Sequence
  chemically synthesized
tagcccaccatattatcagtgg

SEQ ID NO: 158327 - DNA, 22 bp, Artificial Sequence
  chemically synthesized
agcccaccatattatcagtggt

SEQ ID NO: 158328 - DNA, 22 bp, Artificial Sequence
  chemically synthesized
gcccaccatattatcagtggtc

SEQ ID NO: 158329 - DNA, 22 bp, Artificial Sequence
  chemically synthesized
tcagtggtcccataacttaaaa

SEQ ID NO: 158330 - DNA, 22 bp, Artificial Sequence
  chemically synthesized
aaaattcagatttgactttaaa

SEQ ID NO: 158331 - DNA, 22 bp, Artificial Sequence
  chemically synthesized
aaattcagatttgactttaaaa

SEQ ID NO: 158332 - DNA, 22 bp, Artificial Sequence
  chemically synthesized
agatttgactttaaaattggaa

SEQ ID NO: 158333 - DNA, 22 bp, Artificial Sequence
  chemically synthesized
gactttaaaattggaatctgaa

SEQ ID NO: 158334 - DNA, 22 bp, Artificial Sequence
  chemically synthesized
actttaaaattggaatctgaag

SEQ ID NO: 158335 - DNA, 22 bp, Artificial Sequence
  chemically synthesized
taaaattggaatctgaagaaca

SEQ ID NO: 158336 - DNA, 22 bp, Artificial Sequence
  chemically synthesized
aaaattggaatctgaagaacac

SEQ ID NO: 158337 - DNA, 22 bp, Artificial Sequence
  chemically synthesized
aaattggaatctgaagaacacc

SEQ ID NO: 158338 - DNA, 22 bp, Artificial Sequence
  chemically synthesized
gaatctgaagaacaccaagcaa

SEQ ID NO: 158339 - DNA, 22 bp, Artificial Sequence
  chemically synthesized
aagaacaccaagcaattctgta

SEQ ID NO: 158340 - DNA, 22 bp, Artificial Sequence
  chemically synthesized
tgtaaaccattttctcctttga

SEQ ID NO: 158341 - DNA, 22 bp, Artificial Sequence
  chemically synthesized
taaaccattttctcctttgaga

SEQ ID NO: 158342 - DNA, 22 bp, Artificial Sequence
  chemically synthesized
tctcctttgagattcatgagga

SEQ ID NO: 158343 - DNA, 22 bp, Artificial Sequence
  chemically synthesized
ctcctttgagattcatgaggac

SEQ ID NO: 158344 - DNA, 22 bp, Artificial Sequence
  chemically synthesized
tcctttgagattcatgaggaca

SEQ ID NO: 158345 - DNA, 22 bp, Artificial Sequence
  chemically synthesized
ctttgagattcatgaggacaaa

SEQ ID NO: 158346 - DNA, 22 bp, Artificial Sequence
  chemically synthesized
tgagattcatgaggacaaaatt

SEQ ID NO: 158347 - DNA, 22 bp, Artificial Sequence
  chemically synthesized
gagattcatgaggacaaaattc

SEQ ID NO: 158348 - DNA, 22 bp, Artificial Sequence
  chemically synthesized
agattcatgaggacaaaattca

SEQ ID NO: 158349 - DNA, 22 bp, Artificial Sequence
  chemically synthesized
atgaggacaaaattcactcacc

SEQ ID NO: 158350 - DNA, 22 bp, Artificial Sequence
  chemically synthesized
actcacctctgtttcctctaat

SEQ ID NO: 158351 - DNA, 22 bp, Artificial Sequence
  chemically synthesized
acctctgtttcctctaattata

SEQ ID NO: 158352 - DNA, 22 bp, Artificial Sequence
  chemically synthesized
tgtttcctctaattatagtcat

SEQ ID NO: 158353 - DNA, 22 bp, Artificial Sequence
  chemically synthesized
tttcctctaattatagtcatat

SEQ ID NO: 158354 - DNA, 22 bp, Artificial Sequence
  chemically synthesized
cctctaattatagtcatatatt

SEQ ID NO: 158355 - DNA, 22 bp, Artificial Sequence
  chemically synthesized
ctctaattatagtcatatatta

SEQ ID NO: 158356 - DNA, 22 bp, Artificial Sequence
  chemically synthesized
taattatagtcatatattaata

SEQ ID NO: 158357 - DNA, 22 bp, Artificial Sequence
  chemically synthesized
attatagtcatatattaataat

SEQ ID NO: 158358 - DNA, 22 bp, Artificial Sequence
  chemically synthesized
tagtcatatattaataatgtat

SEQ ID NO: 158359 - DNA, 22 bp, Artificial Sequence
  chemically synthesized
ataatgtataaaggttttctca

SEQ ID NO: 158360 - DNA, 22 bp, Artificial Sequence
  chemically synthesized
tctcaagaggatctttataaaa

SEQ ID NO: 158361 - DNA, 22 bp, Artificial Sequence
  chemically synthesized
ctcaagaggatctttataaaag

SEQ ID NO: 158362 - DNA, 22 bp, Artificial Sequence
  chemically synthesized
tcaagaggatctttataaaagg

SEQ ID NO: 158363 - DNA, 22 bp, Artificial Sequence
  chemically synthesized
aagaggatctttataaaagggg

SEQ ID NO: 158364 - DNA, 22 bp, Artificial Sequence
  chemically synthesized
tataaaaggggccttcccacat

SEQ ID NO: 158365 - DNA, 22 bp, Artificial Sequence
  chemically synthesized
ataaaaggggccttcccacatt

SEQ ID NO: 158366 - DNA, 22 bp, Artificial Sequence
  chemically synthesized
taaaaggggccttcccacatta

SEQ ID NO: 158367 - DNA, 22 bp, Artificial Sequence
  chemically synthesized
cccacattagtttaactgctta

SEQ ID NO: 158368 - DNA, 22 bp, Artificial Sequence
  chemically synthesized
ccacattagtttaactgcttag

SEQ ID NO: 158369 - DNA, 22 bp, Artificial Sequence
  chemically synthesized
gtttaactgcttaggtactgat

SEQ ID NO: 158370 - DNA, 22 bp, Artificial Sequence
  chemically synthesized
aactgcttaggtactgattctc

SEQ ID NO: 158371 - DNA, 22 bp, Artificial Sequence
  chemically synthesized
actgcttaggtactgattctct

SEQ ID NO: 158372 - DNA, 22 bp, Artificial Sequence
  chemically synthesized
cttaggtactgattctcttcta

SEQ ID NO: 158373 - DNA, 22 bp, Artificial Sequence
  chemically synthesized
aggtactgattctcttctactt

SEQ ID NO: 158374 - DNA, 22 bp, Artificial Sequence
  chemically synthesized
ggtactgattctcttctacttc

SEQ ID NO: 158375 - DNA, 22 bp, Artificial Sequence
  chemically synthesized
attctcttctacttcctcaacc

SEQ ID NO: 158376 - DNA, 22 bp, Artificial Sequence
  chemically synthesized
tcttctacttcctcaaccaaca

SEQ ID NO: 158377 - DNA, 22 bp, Artificial Sequence
  chemically synthesized
ttctacttcctcaaccaacact

SEQ ID NO: 158378 - DNA, 22 bp, Artificial Sequence
  chemically synthesized
ctacttcctcaaccaacacttt

SEQ ID NO: 158379 - DNA, 22 bp, Artificial Sequence
  chemically synthesized
tacttcctcaaccaacactttt

SEQ ID NO: 158380 - DNA, 22 bp, Artificial Sequence
  chemically synthesized
cttcctcaaccaacacttttag

SEQ ID NO: 158381 - DNA, 22 bp, Artificial Sequence
  chemically synthesized
cctcaaccaacacttttagaac

SEQ ID NO: 158382 - DNA, 22 bp, Artificial Sequence
  chemically synthesized
ctcaaccaacacttttagaact

SEQ ID NO: 158383 - DNA, 22 bp, Artificial Sequence
  chemically synthesized
aaccaacacttttagaactatc

SEQ ID NO: 158384 - DNA, 22 bp, Artificial Sequence
  chemically synthesized
ttagaactatcatctaagatta

SEQ ID NO: 158385 - DNA, 22 bp, Artificial Sequence
  chemically synthesized
tagaactatcatctaagattac

SEQ ID NO: 158386 - DNA, 22 bp, Artificial Sequence
  chemically synthesized
agaactatcatctaagattaca

SEQ ID NO: 158387 - DNA, 22 bp, Artificial Sequence
  chemically synthesized
gaactatcatctaagattacat

SEQ ID NO: 158388 - DNA, 22 bp, Artificial Sequence
  chemically synthesized
tcatctaagattacatcggtca

SEQ ID NO: 158389 - DNA, 22 bp, Artificial Sequence
  chemically synthesized
agattacatcggtcaaattttc

SEQ ID NO: 158390 - DNA, 22 bp, Artificial Sequence
  chemically synthesized
catcggtcaaattttcttatgc

SEQ ID NO: 158391 - DNA, 22 bp, Artificial Sequence
  chemically synthesized
tcttatgcttacaataaataaa

SEQ ID NO: 158392 - DNA, 22 bp, Artificial Sequence
  chemically synthesized
cttatgcttacaataaataaat

SEQ ID NO: 158393 - DNA, 22 bp, Artificial Sequence
  chemically synthesized
ttatgcttacaataaataaata

SEQ ID NO: 158394 - DNA, 22 bp, Artificial Sequence
  chemically synthesized
atgcttacaataaataaatact

SEQ ID NO: 158395 - DNA, 22 bp, Artificial Sequence
  chemically synthesized
tgcttacaataaataaatactt

SEQ ID NO: 158396 - DNA, 22 bp, Artificial Sequence
  chemically synthesized
acaataaataaatactttttaa

SEQ ID NO: 158397 - DNA, 22 bp, Artificial Sequence
  chemically synthesized
caataaataaatactttttaag

SEQ ID NO: 158398 - DNA, 22 bp, Artificial Sequence
  chemically synthesized
tttaagccagcaacttcacttc

SEQ ID NO: 158399 - DNA, 22 bp, Artificial Sequence
  chemically synthesized
ttaagccagcaacttcacttca

SEQ ID NO: 158400 - DNA, 22 bp, Artificial Sequence
  chemically synthesized
taagccagcaacttcacttcac

SEQ ID NO: 158401 - DNA, 22 bp, Artificial Sequence
  chemically synthesized
aagccagcaacttcacttcact

SEQ ID NO: 158402 - DNA, 22 bp, Artificial Sequence
  chemically synthesized
agccagcaacttcacttcactt

SEQ ID NO: 158403 - DNA, 22 bp, Artificial Sequence
  chemically synthesized
cacttcacttactatgttttat

SEQ ID NO: 158404 - DNA, 22 bp, Artificial Sequence
  chemically synthesized
acttcacttactatgttttatt

SEQ ID NO: 158405 - DNA, 22 bp, Artificial Sequence
  chemically synthesized
cacttactatgttttattacat

SEQ ID NO: 158406 - DNA, 22 bp, Artificial Sequence
  chemically synthesized
acttactatgttttattacata

SEQ ID NO: 158407 - DNA, 22 bp, Artificial Sequence
  chemically synthesized
actatgttttattacatattat

SEQ ID NO: 158408 - DNA, 22 bp, Artificial Sequence
  chemically synthesized
ctatgttttattacatattatt

SEQ ID NO: 158409 - DNA, 22 bp, Artificial Sequence
  chemically synthesized
tgttttattacatattattcat

SEQ ID NO: 158410 - DNA, 22 bp, Artificial Sequence
  chemically synthesized
tattacatattattcattctaa

SEQ ID NO: 158411 - DNA, 22 bp, Artificial Sequence
  chemically synthesized
attacatattattcattctaag

SEQ ID NO: 158412 - DNA, 22 bp, Artificial Sequence
  chemically synthesized
ttacatattattcattctaagt

SEQ ID NO: 158413 - DNA, 22 bp, Artificial Sequence
  chemically synthesized
catattattcattctaagtgta

SEQ ID NO: 158414 - DNA, 22 bp, Artificial Sequence
  chemically synthesized
ttcattctaagtgtagtcctag

SEQ ID NO: 158415 - DNA, 22 bp, Artificial Sequence
  chemically synthesized
attctaagtgtagtcctagata

SEQ ID NO: 158416 - DNA, 22 bp, Artificial Sequence
  chemically synthesized
taagtgtagtcctagatatagt

SEQ ID NO: 158417 - DNA, 22 bp, Artificial Sequence
  chemically synthesized
agtgtagtcctagatatagtag

SEQ ID NO: 158418 - DNA, 22 bp, Artificial Sequence
  chemically synthesized
gatatagtagagtactacgcca

SEQ ID NO: 158419 - DNA, 22 bp, Artificial Sequence
  chemically synthesized
cgccaagacatcaggtcaagga

SEQ ID NO: 158420 - DNA, 22 bp, Artificial Sequence
  chemically synthesized
aaagcagaagagatgagaaaca

SEQ ID NO: 158421 - DNA, 22 bp, Artificial Sequence
  chemically synthesized
caaatcctgtgacaacaaacat

SEQ ID NO: 158422 - DNA, 22 bp, Artificial Sequence
  chemically synthesized
tgacaacaaacatctcaataga

SEQ ID NO: 158423 - DNA, 22 bp, Artificial Sequence
  chemically synthesized
aatagaaatcacacagtccaag

SEQ ID NO: 158424 - DNA, 22 bp, Artificial Sequence
  chemically synthesized
tcaaagcgctcagggataaaag

SEQ ID NO: 158425 - DNA, 22 bp, Artificial Sequence
  chemically synthesized
caaagcgctcagggataaaaga

SEQ ID NO: 158426 - DNA, 22 bp, Artificial Sequence
  chemically synthesized
aaagcgctcagggataaaagaa

SEQ ID NO: 158427 - DNA, 22 bp, Artificial Sequence
  chemically synthesized
agggataaaagaaaactgatat

SEQ ID NO: 158428 - DNA, 22 bp, Artificial Sequence
  chemically synthesized
atattcaagaatattttatagg

SEQ ID NO: 158429 - DNA, 22 bp, Artificial Sequence
  chemically synthesized
aagaatattttatagggtaaaa

SEQ ID NO: 158430 - DNA, 22 bp, Artificial Sequence
  chemically synthesized
tatagggtaaaactgttattca

SEQ ID NO: 158431 - DNA, 22 bp, Artificial Sequence
  chemically synthesized
atagggtaaaactgttattcaa

SEQ ID NO: 158432 - DNA, 22 bp, Artificial Sequence
  chemically synthesized
tagggtaaaactgttattcaaa

SEQ ID NO: 158433 - DNA, 22 bp, Artificial Sequence
  chemically synthesized
ttattcaaatataagcaatata

SEQ ID NO: 158434 - DNA, 22 bp, Artificial Sequence
  chemically synthesized
ttcaaatataagcaatatataa

SEQ ID NO: 158435 - DNA, 22 bp, Artificial Sequence
  chemically synthesized
aaatataagcaatatataaagt

SEQ ID NO: 158436 - DNA, 22 bp, Artificial Sequence
  chemically synthesized
tcccagacaaacaaaagttgag

SEQ ID NO: 158437 - DNA, 22 bp, Artificial Sequence
  chemically synthesized
cccagacaaacaaaagttgaga

SEQ ID NO: 158438 - DNA, 22 bp, Artificial Sequence
  chemically synthesized
ccagacaaacaaaagttgagag

SEQ ID NO: 158439 - DNA, 22 bp, Artificial Sequence
  chemically synthesized
agagaattcaccaacaccagac

SEQ ID NO: 158440 - DNA, 22 bp, Artificial Sequence
  chemically synthesized
accaacaccagaccatcttgca

SEQ ID NO: 158441 - DNA, 22 bp, Artificial Sequence
  chemically synthesized
gcaaaaaatgctaaagggagtt

SEQ ID NO: 158442 - DNA, 22 bp, Artificial Sequence
  chemically synthesized
caaaaaatgctaaagggagtta

SEQ ID NO: 158443 - DNA, 22 bp, Artificial Sequence
  chemically synthesized
aagggagttatgcaatctgaaa

SEQ ID NO: 158444 - DNA, 22 bp, Artificial Sequence
  chemically synthesized
tgcaatctgaaagaaaaaagac

SEQ ID NO: 158445 - DNA, 22 bp, Artificial Sequence
  chemically synthesized
aaagaaaaaagacattaacatg

SEQ ID NO: 158446 - DNA, 22 bp, Artificial Sequence
  chemically synthesized
acatgcaaaagaaaacttttca

SEQ ID NO: 158447 - DNA, 22 bp, Artificial Sequence
  chemically synthesized
ttcaaagtatgaaacccactgg

SEQ ID NO: 158448 - DNA, 22 bp, Artificial Sequence
  chemically synthesized
tcaaagtatgaaacccactggt

SEQ ID NO: 158449 - DNA, 22 bp, Artificial Sequence
  chemically synthesized
caaagtatgaaacccactggta

SEQ ID NO: 158450 - DNA, 22 bp, Artificial Sequence
  chemically synthesized
aaagtatgaaacccactggtaa

SEQ ID NO: 158451 - DNA, 22 bp, Artificial Sequence
  chemically synthesized
gtaaaattaagtacatagacaa

SEQ ID NO: 158452 - DNA, 22 bp, Artificial Sequence
  chemically synthesized
agtacatagacaaacctagaat

SEQ ID NO: 158453 - DNA, 22 bp, Artificial Sequence
  chemically synthesized
gaataccccattactgtatttt

SEQ ID NO: 158454 - DNA, 22 bp, Artificial Sequence
  chemically synthesized
ctgtattttttggtgtgcaatc

SEQ ID NO: 158455 - DNA, 22 bp, Artificial Sequence
  chemically synthesized
tattttttggtgtgcaatccac

SEQ ID NO: 158456 - DNA, 22 bp, Artificial Sequence
  chemically synthesized
tttggtgtgcaatccacacaga

SEQ ID NO: 158457 - DNA, 22 bp, Artificial Sequence
  chemically synthesized
ttggtgtgcaatccacacagaa

SEQ ID NO: 158458 - DNA, 22 bp, Artificial Sequence
  chemically synthesized
tggtgtgcaatccacacagaac

SEQ ID NO: 158459 - DNA, 22 bp, Artificial Sequence
  chemically synthesized
ggtgtgcaatccacacagaact

SEQ ID NO: 158460 - DNA, 22 bp, Artificial Sequence
  chemically synthesized
gtgtgcaatccacacagaactc

SEQ ID NO: 158461 - DNA, 22 bp, Artificial Sequence
  chemically synthesized
cagtatgaaacccaaaaaacaa

SEQ ID NO: 158462 - DNA, 22 bp, Artificial Sequence
  chemically synthesized
tcaaaaacagtaatagctatag

SEQ ID NO: 158463 - DNA, 22 bp, Artificial Sequence
  chemically synthesized
caaaaacagtaatagctatagc

SEQ ID NO: 158464 - DNA, 22 bp, Artificial Sequence
  chemically synthesized
aaaaacagtaatagctatagca

SEQ ID NO: 158465 - DNA, 22 bp, Artificial Sequence
  chemically synthesized
tagcaaccttttaagatgtagg

SEQ ID NO: 158466 - DNA, 22 bp, Artificial Sequence
  chemically synthesized
ttaagatgtaggtaatataaaa

SEQ ID NO: 158467 - DNA, 22 bp, Artificial Sequence
  chemically synthesized
taagatgtaggtaatataaaat

SEQ ID NO: 158468 - DNA, 22 bp, Artificial Sequence
  chemically synthesized
aagatgtaggtaatataaaata

SEQ ID NO: 158469 - DNA, 22 bp, Artificial Sequence
  chemically synthesized
agatgtaggtaatataaaatat

SEQ ID NO: 158470 - DNA, 22 bp, Artificial Sequence
  chemically synthesized
aagtgtagaatttttttgcctg

SEQ ID NO: 158471 - DNA, 22 bp, Artificial Sequence
  chemically synthesized
ttttgcctgtttttgcccttgt

SEQ ID NO: 158472 - DNA, 22 bp, Artificial Sequence
  chemically synthesized
tttgcctgtttttgcccttgtt

SEQ ID NO: 158473 - DNA, 22 bp, Artificial Sequence
  chemically synthesized
ttgcctgtttttgcccttgttt

SEQ ID NO: 158474 - DNA, 22 bp, Artificial Sequence
  chemically synthesized
tgcctgtttttgcccttgttta

SEQ ID NO: 158475 - DNA, 22 bp, Artificial Sequence
  chemically synthesized
gcctgtttttgcccttgtttat

SEQ ID NO: 158476 - DNA, 22 bp, Artificial Sequence
  chemically synthesized
cctgtttttgcccttgtttata

SEQ ID NO: 158477 - DNA, 22 bp, Artificial Sequence
  chemically synthesized
tttttgcccttgtttatattcc

SEQ ID NO: 158478 - DNA, 22 bp, Artificial Sequence
  chemically synthesized
ttgcccttgtttatattccttt

SEQ ID NO: 158479 - DNA, 22 bp, Artificial Sequence
  chemically synthesized
tgcccttgtttatattccttta

SEQ ID NO: 158480 - DNA, 22 bp, Artificial Sequence
  chemically synthesized
gcccttgtttatattcctttat

SEQ ID NO: 158481 - DNA, 22 bp, Artificial Sequence
  chemically synthesized
cccttgtttatattcctttatt

SEQ ID NO: 158482 - DNA, 22 bp, Artificial Sequence
  chemically synthesized
gtttatattcctttatttgcga

SEQ ID NO: 158483 - DNA, 22 bp, Artificial Sequence
  chemically synthesized
tttatattcctttatttgcgat

SEQ ID NO: 158484 - DNA, 22 bp, Artificial Sequence
  chemically synthesized
atattcctttatttgcgatcta

SEQ ID NO: 158485 - DNA, 22 bp, Artificial Sequence
  chemically synthesized
tattcctttatttgcgatctaa

SEQ ID NO: 158486 - DNA, 22 bp, Artificial Sequence
  chemically synthesized
ctttatttgcgatctaagataa

SEQ ID NO: 158487 - DNA, 22 bp, Artificial Sequence
  chemically synthesized
tatttgcgatctaagataattc

SEQ ID NO: 158488 - DNA, 22 bp, Artificial Sequence
  chemically synthesized
atttgcgatctaagataattcg

SEQ ID NO: 158489 - DNA, 22 bp, Artificial Sequence
  chemically synthesized
tttgcgatctaagataattcgt

SEQ ID NO: 158490 - DNA, 22 bp, Artificial Sequence
  chemically synthesized
gcgatctaagataattcgtcat

SEQ ID NO: 158491 - DNA, 22 bp, Artificial Sequence
  chemically synthesized
cgatctaagataattcgtcatc

SEQ ID NO: 158492 - DNA, 22 bp, Artificial Sequence
  chemically synthesized
agataattcgtcatcctttaaa

SEQ ID NO: 158493 - DNA, 22 bp, Artificial Sequence
  chemically synthesized
gtcatcctttaaaataacttgc

SEQ ID NO: 158494 - DNA, 22 bp, Artificial Sequence
  chemically synthesized
taaaataacttgctatatttat

SEQ ID NO: 158495 - DNA, 22 bp, Artificial Sequence
  chemically synthesized
aaaataacttgctatatttata

SEQ ID NO: 158496 - DNA, 22 bp, Artificial Sequence
  chemically synthesized
aaataacttgctatatttataa

SEQ ID NO: 158497 - DNA, 22 bp, Artificial Sequence
  chemically synthesized
gctatatttataagatgtttct

SEQ ID NO: 158498 - DNA, 22 bp, Artificial Sequence
  chemically synthesized
ctatatttataagatgtttctt

SEQ ID NO: 158499 - DNA, 22 bp, Artificial Sequence
  chemically synthesized
tatttataagatgtttcttgta

SEQ ID NO: 158500 - DNA, 22 bp, Artificial Sequence
  chemically synthesized
ataagatgtttcttgtaagccc

SEQ ID NO: 158501 - DNA, 22 bp, Artificial Sequence
  chemically synthesized
taagatgtttcttgtaagcccc

SEQ ID NO: 158502 - DNA, 22 bp, Artificial Sequence
  chemically synthesized
cttgtaagccccatggtaacca

SEQ ID NO: 158503 - DNA, 22 bp, Artificial Sequence
  chemically synthesized
ttgtaagccccatggtaaccac

SEQ ID NO: 158504 - DNA, 22 bp, Artificial Sequence
  chemically synthesized
gtaagccccatggtaaccacag

SEQ ID NO: 158505 - DNA, 22 bp, Artificial Sequence
  chemically synthesized
taagccccatggtaaccacagc

SEQ ID NO: 158506 - DNA, 22 bp, Artificial Sequence
  chemically synthesized
taatagatttactaaaaataaa

SEQ ID NO: 158507 - DNA, 22 bp, Artificial Sequence
  chemically synthesized
actaaaaataaaaagtaacaaa

SEQ ID NO: 158508 - DNA, 22 bp, Artificial Sequence
  chemically synthesized
ctaaaaataaaaagtaacaaat

SEQ ID NO: 158509 - DNA, 22 bp, Artificial Sequence
  chemically synthesized
aaaataaaaagtaacaaattaa

SEQ ID NO: 158510 - DNA, 22 bp, Artificial Sequence
  chemically synthesized
aaatatgctaccagagataatc

SEQ ID NO: 158511 - DNA, 22 bp, Artificial Sequence
  chemically synthesized
ccagagataatcacataaccat

SEQ ID NO: 158512 - DNA, 22 bp, Artificial Sequence
  chemically synthesized
catacagccaaaaataagcaaa

SEQ ID NO: 158513 - DNA, 22 bp, Artificial Sequence
  chemically synthesized
acttagtaactacactgagtgt

SEQ ID NO: 158514 - DNA, 22 bp, Artificial Sequence
  chemically synthesized
cttagtaactacactgagtgta

SEQ ID NO: 158515 - DNA, 22 bp, Artificial Sequence
  chemically synthesized
agtaactacactgagtgtaaat

SEQ ID NO: 158516 - DNA, 22 bp, Artificial Sequence
  chemically synthesized
gtaactacactgagtgtaaata

SEQ ID NO: 158517 - DNA, 22 bp, Artificial Sequence
  chemically synthesized
cactgagtgtaaatagtctcag

SEQ ID NO: 158518 - DNA, 22 bp, Artificial Sequence
  chemically synthesized
agtgtaaatagtctcagttccc

SEQ ID NO: 158519 - DNA, 22 bp, Artificial Sequence
  chemically synthesized
agttccccaattaaaagtaata

SEQ ID NO: 158520 - DNA, 22 bp, Artificial Sequence
  chemically synthesized
cccaattaaaagtaatagaatg

SEQ ID NO: 158521 - DNA, 22 bp, Artificial Sequence
  chemically synthesized
aaagtaatagaatggtaaatgg

SEQ ID NO: 158522 - DNA, 22 bp, Artificial Sequence
  chemically synthesized
tatgcgatcttcaagaaaccca

SEQ ID NO: 158523 - DNA, 22 bp, Artificial Sequence
  chemically synthesized
atgcgatcttcaagaaacccac

SEQ ID NO: 158524 - DNA, 22 bp, Artificial Sequence
  chemically synthesized
tgcgatcttcaagaaacccact

SEQ ID NO: 158525 - DNA, 22 bp, Artificial Sequence
  chemically synthesized
caagaaacccacttcacctata

SEQ ID NO: 158526 - DNA, 22 bp, Artificial Sequence
  chemically synthesized
aagaaacccacttcacctataa

SEQ ID NO: 158527 - DNA, 22 bp, Artificial Sequence
  chemically synthesized
cacctataaaggcacacataaa

SEQ ID NO: 158528 - DNA, 22 bp, Artificial Sequence
  chemically synthesized
acctataaaggcacacataaat

SEQ ID NO: 158529 - DNA, 22 bp, Artificial Sequence
  chemically synthesized
taaaggcacacataaatgaaag

SEQ ID NO: 158530 - DNA, 22 bp, Artificial Sequence
  chemically synthesized
gaaaaaaattccatgaactgga

SEQ ID NO: 158531 - DNA, 22 bp, Artificial Sequence
  chemically synthesized
catgaactggaaaccagaaaga

SEQ ID NO: 158532 - DNA, 22 bp, Artificial Sequence
  chemically synthesized
gaaaccagaaagagcagtagta

SEQ ID NO: 158533 - DNA, 22 bp, Artificial Sequence
  chemically synthesized
tacttaaatcagataaaataga

SEQ ID NO: 158534 - DNA, 22 bp, Artificial Sequence
  chemically synthesized
aaatcagataaaatagactaca

SEQ ID NO: 158535 - DNA, 22 bp, Artificial Sequence
  chemically synthesized
aatcagataaaatagactacaa

SEQ ID NO: 158536 - DNA, 22 bp, Artificial Sequence
  chemically synthesized
caaatttaaaaactgtaagaaa

SEQ ID NO: 158537 - DNA, 22 bp, Artificial Sequence
  chemically synthesized
aaaaactgtaagaaaagataag

SEQ ID NO: 158538 - DNA, 22 bp, Artificial Sequence
  chemically synthesized
aaaactgtaagaaaagataagg

SEQ ID NO: 158539 - DNA, 22 bp, Artificial Sequence
  chemically synthesized
taagaaaagataaggagggtca

SEQ ID NO: 158540 - DNA, 22 bp, Artificial Sequence
  chemically synthesized
tataataataaaggggtcaatt

SEQ ID NO: 158541 - DNA, 22 bp, Artificial Sequence
  chemically synthesized
agcaagaggatacaattataaa

SEQ ID NO: 158542 - DNA, 22 bp, Artificial Sequence
  chemically synthesized
taaatattgatgtatccaacat

SEQ ID NO: 158543 - DNA, 22 bp, Artificial Sequence
  chemically synthesized
atgtatccaacatcaaagttcc

SEQ ID NO: 158544 - DNA, 22 bp, Artificial Sequence
  chemically synthesized
ccaagtatataaggaaaacatt

SEQ ID NO: 158545 - DNA, 22 bp, Artificial Sequence
  chemically synthesized
atagtcctaaagggcgagacag

SEQ ID NO: 158546 - DNA, 22 bp, Artificial Sequence
  chemically synthesized
aagggcgagacagactgcaata

SEQ ID NO: 158547 - DNA, 22 bp, Artificial Sequence
  chemically synthesized
caatacaataatagtagggaac

SEQ ID NO: 158548 - DNA, 22 bp, Artificial Sequence
  chemically synthesized
taaacacttcagtctcagtaat

SEQ ID NO: 158549 - DNA, 22 bp, Artificial Sequence
  chemically synthesized
aaacacttcagtctcagtaatg

SEQ ID NO: 158550 - DNA, 22 bp, Artificial Sequence
  chemically synthesized
aacacttcagtctcagtaatga

SEQ ID NO: 158551 - DNA, 22 bp, Artificial Sequence
  chemically synthesized
cagtctcagtaatgaacagatc

SEQ ID NO: 158552 - DNA, 22 bp, Artificial Sequence
  chemically synthesized
agtctcagtaatgaacagatcg

SEQ ID NO: 158553 - DNA, 22 bp, Artificial Sequence
  chemically synthesized
agtaatgaacagatcggccaga

SEQ ID NO: 158554 - DNA, 22 bp, Artificial Sequence
  chemically synthesized
aaaatcaacaaatgaacaacac

SEQ ID NO: 158555 - DNA, 22 bp, Artificial Sequence
  chemically synthesized
atgtacccactatatctaatag

SEQ ID NO: 158556 - DNA, 22 bp, Artificial Sequence
  chemically synthesized
tatctaatagacccaactgaca

SEQ ID NO: 158557 - DNA, 22 bp, Artificial Sequence
  chemically synthesized
atagacccaactgacattaaca

SEQ ID NO: 158558 - DNA, 22 bp, Artificial Sequence
  chemically synthesized
acattaacagaacttgtccccc

SEQ ID NO: 158559 - DNA, 22 bp, Artificial Sequence
  chemically synthesized
acagaacttgtcccccaactgc

SEQ ID NO: 158560 - DNA, 22 bp, Artificial Sequence
  chemically synthesized
gtcccccaactgctgaagaaga

SEQ ID NO: 158561 - DNA, 22 bp, Artificial Sequence
  chemically synthesized
tcccccaactgctgaagaagat

SEQ ID NO: 158562 - DNA, 22 bp, Artificial Sequence
  chemically synthesized
ctgaagaagatacatttcttta

SEQ ID NO: 158563 - DNA, 22 bp, Artificial Sequence
  chemically synthesized
aagaagatacatttctttaaag

SEQ ID NO: 158564 - DNA, 22 bp, Artificial Sequence
  chemically synthesized
ctttaaagcagcatgtacaaca

SEQ ID NO: 158565 - DNA, 22 bp, Artificial Sequence
  chemically synthesized
tttaaagcagcatgtacaacat

SEQ ID NO: 158566 - DNA, 22 bp, Artificial Sequence
  chemically synthesized
taaagcagcatgtacaacattt

SEQ ID NO: 158567 - DNA, 22 bp, Artificial Sequence
  chemically synthesized
aaagcagcatgtacaacatttt

SEQ ID NO: 158568 - DNA, 22 bp, Artificial Sequence
  chemically synthesized
aagcagcatgtacaacattttc

SEQ ID NO: 158569 - DNA, 22 bp, Artificial Sequence
  chemically synthesized
tcctaaataaggccatatgtta

SEQ ID NO: 158570 - DNA, 22 bp, Artificial Sequence
  chemically synthesized
cctaaataaggccatatgttag

SEQ ID NO: 158571 - DNA, 22 bp, Artificial Sequence
  chemically synthesized
ctaaataaggccatatgttagg

SEQ ID NO: 158572 - DNA, 22 bp, Artificial Sequence
  chemically synthesized
aataaggccatatgttaggcca

SEQ ID NO: 158573 - DNA, 22 bp, Artificial Sequence
  chemically synthesized
ggccacaaggtaagtttgtaca

SEQ ID NO: 158574 - DNA, 22 bp, Artificial Sequence
  chemically synthesized
gtacaaatttttcagaagtaga

SEQ ID NO: 158575 - DNA, 22 bp, Artificial Sequence
  chemically synthesized
tacaaatttttcagaagtagaa

SEQ ID NO: 158576 - DNA, 22 bp, Artificial Sequence
  chemically synthesized
ttcagaagtagaaattttatca

SEQ ID NO: 158577 - DNA, 22 bp, Artificial Sequence
  chemically synthesized
tcagaagtagaaattttatcaa

SEQ ID NO: 158578 - DNA, 22 bp, Artificial Sequence
  chemically synthesized
cagaagtagaaattttatcaag

SEQ ID NO: 158579 - DNA, 22 bp, Artificial Sequence
  chemically synthesized
agaagtagaaattttatcaagt

SEQ ID NO: 158580 - DNA, 22 bp, Artificial Sequence
  chemically synthesized
tatcaagtatattttctgacca

SEQ ID NO: 158581 - DNA, 22 bp, Artificial Sequence
  chemically synthesized
atcaagtatattttctgaccac

SEQ ID NO: 158582 - DNA, 22 bp, Artificial Sequence
  chemically synthesized
tcaagtatattttctgaccaca

SEQ ID NO: 158583 - DNA, 22 bp, Artificial Sequence
  chemically synthesized
tctgaccacagtggaataaaac

SEQ ID NO: 158584 - DNA, 22 bp, Artificial Sequence
  chemically synthesized
ctgaccacagtggaataaaact

SEQ ID NO: 158585 - DNA, 22 bp, Artificial Sequence
  chemically synthesized
tgaccacagtggaataaaacta

SEQ ID NO: 158586 - DNA, 22 bp, Artificial Sequence
  chemically synthesized
accacagtggaataaaactaga

SEQ ID NO: 158587 - DNA, 22 bp, Artificial Sequence
  chemically synthesized
gaaatgaataacaagaagatca

SEQ ID NO: 158588 - DNA, 22 bp, Artificial Sequence
  chemically synthesized
ctgaatgtcaggcctctgagcc

SEQ ID NO: 158589 - DNA, 22 bp, Artificial Sequence
  chemically synthesized
aatgtcaggcctctgagcccaa

SEQ ID NO: 158590 - DNA, 22 bp, Artificial Sequence
  chemically synthesized
tgagcccaagctaagccatcat

SEQ ID NO: 158591 - DNA, 22 bp, Artificial Sequence
  chemically synthesized
agcccaagctaagccatcatgt

SEQ ID NO: 158592 - DNA, 22 bp, Artificial Sequence
  chemically synthesized
agccatcatgtcccctgtgacc

SEQ ID NO: 158593 - DNA, 22 bp, Artificial Sequence
  chemically synthesized
tgacctgcatatacacatacag

SEQ ID NO: 158594 - DNA, 22 bp, Artificial Sequence
  chemically synthesized
catatacacatacagatggcca

SEQ ID NO: 158595 - DNA, 22 bp, Artificial Sequence
  chemically synthesized
ctgccttaactgatgacattcc

SEQ ID NO: 158596 - DNA, 22 bp, Artificial Sequence
  chemically synthesized
tgccttaactgatgacattcca

SEQ ID NO: 158597 - DNA, 22 bp, Artificial Sequence
  chemically synthesized
ccttaactgatgacattccacc

SEQ ID NO: 158598 - DNA, 22 bp, Artificial Sequence
  chemically synthesized
aactgatgacattccaccacaa

SEQ ID NO: 158599 - DNA, 22 bp, Artificial Sequence
  chemically synthesized
actgatgacattccaccacaaa

SEQ ID NO: 158600 - DNA, 22 bp, Artificial Sequence
  chemically synthesized
atgacattccaccacaaaagaa

SEQ ID NO: 158601 - DNA, 22 bp, Artificial Sequence
  chemically synthesized
caccacaaaagaagtgaaaatg

SEQ ID NO: 158602 - DNA, 22 bp, Artificial Sequence
  chemically synthesized
ttcctgccttaactgatgacat

SEQ ID NO: 158603 - DNA, 22 bp, Artificial Sequence
  chemically synthesized
ctgccttaactgatgacattgt

SEQ ID NO: 158604 - DNA, 22 bp, Artificial Sequence
  chemically synthesized
ccttaactgatgacattgtctt

SEQ ID NO: 158605 - DNA, 22 bp, Artificial Sequence
  chemically synthesized
aactgatgacattgtcttgtga

SEQ ID NO: 158606 - DNA, 22 bp, Artificial Sequence
  chemically synthesized
actgatgacattgtcttgtgaa

SEQ ID NO: 158607 - DNA, 22 bp, Artificial Sequence
  chemically synthesized
atgacattgtcttgtgaaattc

SEQ ID NO: 158608 - DNA, 22 bp, Artificial Sequence
  chemically synthesized
tcttgtgaaattccttctcctg

SEQ ID NO: 158609 - DNA, 22 bp, Artificial Sequence
  chemically synthesized
gtgaaattccttctcctggctc

SEQ ID NO: 158610 - DNA, 22 bp, Artificial Sequence
  chemically synthesized
tgaaattccttctcctggctca

SEQ ID NO: 158611 - DNA, 22 bp, Artificial Sequence
  chemically synthesized
cttctcctggctcatcctggct

SEQ ID NO: 158612 - DNA, 22 bp, Artificial Sequence
  chemically synthesized
ctcctggctcatcctggctcaa

SEQ ID NO: 158613 - DNA, 22 bp, Artificial Sequence
  chemically synthesized
tcctggctcatcctggctcaaa

SEQ ID NO: 158614 - DNA, 22 bp, Artificial Sequence
  chemically synthesized
ctggctcatcctggctcaaaag

SEQ ID NO: 158615 - DNA, 22 bp, Artificial Sequence
  chemically synthesized
gctcatcctggctcaaaagctc

SEQ ID NO: 158616 - DNA, 22 bp, Artificial Sequence
  chemically synthesized
atcctggctcaaaagctcccct

SEQ ID NO: 158617 - DNA, 22 bp, Artificial Sequence
  chemically synthesized
gctcaaaagctcccctactgag

SEQ ID NO: 158618 - DNA, 22 bp, Artificial Sequence
  chemically synthesized
aaaagctcccctactgagcacc

SEQ ID NO: 158619 - DNA, 22 bp, Artificial Sequence
  chemically synthesized
ccctactgagcaccttgtgacc

SEQ ID NO: 158620 - DNA, 22 bp, Artificial Sequence
  chemically synthesized
ctgagcaccttgtgacccccac

SEQ ID NO: 158621 - DNA, 22 bp, Artificial Sequence
  chemically synthesized
agcaccttgtgacccccactcc

SEQ ID NO: 158622 - DNA, 22 bp, Artificial Sequence
  chemically synthesized
gtgacccccactcctgcccgcc

SEQ ID NO: 158623 - DNA, 22 bp, Artificial Sequence
  chemically synthesized
tgacccccactcctgcccgcca

SEQ ID NO: 158624 - DNA, 22 bp, Artificial Sequence
  chemically synthesized
ctgcccgccagagaacaacccc

SEQ ID NO: 158625 - DNA, 22 bp, Artificial Sequence
  chemically synthesized
cccgccagagaacaacccccct

SEQ ID NO: 158626 - DNA, 22 bp, Artificial Sequence
  chemically synthesized
tgactgtaattttcctttacct

SEQ ID NO: 158627 - DNA, 22 bp, Artificial Sequence
  chemically synthesized
gactgtaattttcctttaccta

SEQ ID NO: 158628 - DNA, 22 bp, Artificial Sequence
  chemically synthesized
actgtaattttcctttacctac

SEQ ID NO: 158629 - DNA, 22 bp, Artificial Sequence
  chemically synthesized
taattttcctttacctacccaa

SEQ ID NO: 158630 - DNA, 22 bp, Artificial Sequence
  chemically synthesized
tcctttacctacccaaatctta

SEQ ID NO: 158631 - DNA, 22 bp, Artificial Sequence
  chemically synthesized
cctttacctacccaaatcttat

SEQ ID NO: 158632 - DNA, 22 bp, Artificial Sequence
  chemically synthesized
ctttacctacccaaatcttata

SEQ ID NO: 158633 - DNA, 22 bp, Artificial Sequence
  chemically synthesized
tacctacccaaatcttataaaa

SEQ ID NO: 158634 - DNA, 22 bp, Artificial Sequence
  chemically synthesized
acctacccaaatcttataaaac

SEQ ID NO: 158635 - DNA, 22 bp, Artificial Sequence
  chemically synthesized
cctacccaaatcttataaaaca

SEQ ID NO: 158636 - DNA, 22 bp, Artificial Sequence
  chemically synthesized
cccaaatcttataaaacagccc

SEQ ID NO: 158637 - DNA, 22 bp, Artificial Sequence
  chemically synthesized
ataaaacagccccactcctatc

SEQ ID NO: 158638 - DNA, 22 bp, Artificial Sequence
  chemically synthesized
taaaacagccccactcctatct

SEQ ID NO: 158639 - DNA, 22 bp, Artificial Sequence
  chemically synthesized
ctatctccctttgctgactctc

SEQ ID NO: 158640 - DNA, 22 bp, Artificial Sequence
  chemically synthesized
tctccctttgctgactctcttt

SEQ ID NO: 158641 - DNA, 22 bp, Artificial Sequence
  chemically synthesized
cctttgctgactctctttttgg

SEQ ID NO: 158642 - DNA, 22 bp, Artificial Sequence
  chemically synthesized
tgctgactctctttttggactc

SEQ ID NO: 158643 - DNA, 22 bp, Artificial Sequence
  chemically synthesized
gctgactctctttttggactca

SEQ ID NO: 158644 - DNA, 22 bp, Artificial Sequence
  chemically synthesized
ctgactctctttttggactcag

SEQ ID NO: 158645 - DNA, 22 bp, Artificial Sequence
  chemically synthesized
actctctttttggactcagcct

SEQ ID NO: 158646 - DNA, 22 bp, Artificial Sequence
  chemically synthesized
tctttttggactcagcctgcct

SEQ ID NO: 158647 - DNA, 22 bp, Artificial Sequence
  chemically synthesized
tttttggactcagcctgcctgc

SEQ ID NO: 158648 - DNA, 22 bp, Artificial Sequence
  chemically synthesized
tttggactcagcctgcctgcac

SEQ ID NO: 158649 - DNA, 22 bp, Artificial Sequence
  chemically synthesized
ttggactcagcctgcctgcacc

SEQ ID NO: 158650 - DNA, 22 bp, Artificial Sequence
  chemically synthesized
tggactcagcctgcctgcaccc

SEQ ID NO: 158651 - DNA, 22 bp, Artificial Sequence
  chemically synthesized
ggactcagcctgcctgcaccca

SEQ ID NO: 158652 - DNA, 22 bp, Artificial Sequence
  chemically synthesized
gactcagcctgcctgcacccag

SEQ ID NO: 158653 - DNA, 22 bp, Artificial Sequence
  chemically synthesized
agcctgcctgcacccaggtgaa

SEQ ID NO: 158654 - DNA, 22 bp, Artificial Sequence
  chemically synthesized
cctgcacccaggtgaaataaac

SEQ ID NO: 158655 - DNA, 22 bp, Artificial Sequence
  chemically synthesized
cacccaggtgaaataaacagcc

SEQ ID NO: 158656 - DNA, 22 bp, Artificial Sequence
  chemically synthesized
gttgcttacacaaagcctgttt

SEQ ID NO: 158657 - DNA, 22 bp, Artificial Sequence
  chemically synthesized
ttgcttacacaaagcctgtttg

SEQ ID NO: 158658 - DNA, 22 bp, Artificial Sequence
  chemically synthesized
cttacacaaagcctgtttggta

SEQ ID NO: 158659 - DNA, 22 bp, Artificial Sequence
  chemically synthesized
acacaaagcctgtttggtagtc

SEQ ID NO: 158660 - DNA, 22 bp, Artificial Sequence
  chemically synthesized
cacaaagcctgtttggtagtct

SEQ ID NO: 158661 - DNA, 22 bp, Artificial Sequence
  chemically synthesized
tttggtagtctcttcatatgga

SEQ ID NO: 158662 - DNA, 22 bp, Artificial Sequence
  chemically synthesized
ggtagtctcttcatatggacgc

SEQ ID NO: 158663 - DNA, 22 bp, Artificial Sequence
  chemically synthesized
gtagtctcttcatatggacgcg

SEQ ID NO: 158664 - DNA, 22 bp, Artificial Sequence
  chemically synthesized
ttcatatggacgcgcatgaaat

SEQ ID NO: 158665 - DNA, 22 bp, Artificial Sequence
  chemically synthesized
catatggacgcgcatgaaattt

SEQ ID NO: 158666 - DNA, 22 bp, Artificial Sequence
  chemically synthesized
atatggacgcgcatgaaatttg

SEQ ID NO: 158667 - DNA, 22 bp, Artificial Sequence
  chemically synthesized
ggtgccgtgactcagattgggg

SEQ ID NO: 158668 - DNA, 22 bp, Artificial Sequence
  chemically synthesized
gtgccgtgactcagattggggg

SEQ ID NO: 158669 - DNA, 22 bp, Artificial Sequence
  chemically synthesized
agattgggggacctcccttggg

SEQ ID NO: 158670 - DNA, 22 bp, Artificial Sequence
  chemically synthesized
ggggacctcccttgggagatca

SEQ ID NO: 158671 - DNA, 22 bp, Artificial Sequence
  chemically synthesized
ccttgggagatcaatcccctgt

SEQ ID NO: 158672 - DNA, 22 bp, Artificial Sequence
  chemically synthesized
gggagatcaatcccctgtcctc

SEQ ID NO: 158673 - DNA, 22 bp, Artificial Sequence
  chemically synthesized
ggagatcaatcccctgtcctcc

SEQ ID NO: 158674 - DNA, 22 bp, Artificial Sequence
  chemically synthesized
tcctcctgctctttgctccgtg

SEQ ID NO: 158675 - DNA, 22 bp, Artificial Sequence
  chemically synthesized
ctgctctttgctccgtgagaaa

SEQ ID NO: 158676 - DNA, 22 bp, Artificial Sequence
  chemically synthesized
ctctttgctccgtgagaaagat

SEQ ID NO: 158677 - DNA, 22 bp, Artificial Sequence
  chemically synthesized
tttgctccgtgagaaagatcca

SEQ ID NO: 158678 - DNA, 22 bp, Artificial Sequence
  chemically synthesized
tgctccgtgagaaagatccacc

SEQ ID NO: 158679 - DNA, 22 bp, Artificial Sequence
  chemically synthesized
gctccgtgagaaagatccacct

SEQ ID NO: 158680 - DNA, 22 bp, Artificial Sequence
  chemically synthesized
ctccgtgagaaagatccaccta

SEQ ID NO: 158681 - DNA, 22 bp, Artificial Sequence
  chemically synthesized
cgtgagaaagatccacctacga

SEQ ID NO: 158682 - DNA, 22 bp, Artificial Sequence
  chemically synthesized
cgacctcaggtcctcaaactga

SEQ ID NO: 158683 - DNA, 22 bp, Artificial Sequence
  chemically synthesized
aggtcctcaaactgaccagccc

SEQ ID NO: 158684 - DNA, 22 bp, Artificial Sequence
  chemically synthesized
aaactgaccagcccaagaaaca

SEQ ID NO: 158685 - DNA, 22 bp, Artificial Sequence
  chemically synthesized
accagcccaagaaacatttcac

SEQ ID NO: 158686 - DNA, 22 bp, Artificial Sequence
  chemically synthesized
caccaatttcaaatccggtaag

SEQ ID NO: 158687 - DNA, 22 bp, Artificial Sequence
  chemically synthesized
accaatttcaaatccggtaagt

SEQ ID NO: 158688 - DNA, 22 bp, Artificial Sequence
  chemically synthesized
caaatccggtaagtggcctctt

SEQ ID NO: 158689 - DNA, 22 bp, Artificial Sequence
  chemically synthesized
aaatccggtaagtggcctcttt

SEQ ID NO: 158690 - DNA, 22 bp, Artificial Sequence
  chemically synthesized
tttttactgtcttctccaacct

SEQ ID NO: 158691 - DNA, 22 bp, Artificial Sequence
  chemically synthesized
tttactgtcttctccaacctcc

SEQ ID NO: 158692 - DNA, 22 bp, Artificial Sequence
  chemically synthesized
ttactgtcttctccaacctccc

SEQ ID NO: 158693 - DNA, 22 bp, Artificial Sequence
  chemically synthesized
tactgtcttctccaacctccct

SEQ ID NO: 158694 - DNA, 22 bp, Artificial Sequence
  chemically synthesized
actgtcttctccaacctccctc

SEQ ID NO: 158695 - DNA, 22 bp, Artificial Sequence
  chemically synthesized
ctgtcttctccaacctccctca

SEQ ID NO: 158696 - DNA, 22 bp, Artificial Sequence
  chemically synthesized
tcttctccaacctccctcacta

SEQ ID NO: 158697 - DNA, 22 bp, Artificial Sequence
  chemically synthesized
ctccaacctccctcactatccc

SEQ ID NO: 158698 - DNA, 22 bp, Artificial Sequence
  chemically synthesized
tccaacctccctcactatccct

SEQ ID NO: 158699 - DNA, 22 bp, Artificial Sequence
  chemically synthesized
caacctccctcactatccctca

SEQ ID NO: 158700 - DNA, 22 bp, Artificial Sequence
  chemically synthesized
cctcactatccctcaacttctt

SEQ ID NO: 158701 - DNA, 22 bp, Artificial Sequence
  chemically synthesized
actatccctcaacttctttctc

SEQ ID NO: 158702 - DNA, 22 bp, Artificial Sequence
  chemically synthesized
tccctcaacttctttctccttt

SEQ ID NO: 158703 - DNA, 22 bp, Artificial Sequence
  chemically synthesized
aacttctttctcctttcaatct

SEQ ID NO: 158704 - DNA, 22 bp, Artificial Sequence
  chemically synthesized
ctttctcctttcaatcttggca

SEQ ID NO: 158705 - DNA, 22 bp, Artificial Sequence
  chemically synthesized
tttctcctttcaatcttggcac

SEQ ID NO: 158706 - DNA, 22 bp, Artificial Sequence
  chemically synthesized
tctcctttcaatcttggcacca

SEQ ID NO: 158707 - DNA, 22 bp, Artificial Sequence
  chemically synthesized
ctcctttcaatcttggcaccac

SEQ ID NO: 158708 - DNA, 22 bp, Artificial Sequence
  chemically synthesized
tcctttcaatcttggcaccaca

SEQ ID NO: 158709 - DNA, 22 bp, Artificial Sequence
  chemically synthesized
ctttcaatcttggcaccacact

SEQ ID NO: 158710 - DNA, 22 bp, Artificial Sequence
  chemically synthesized
tcaatcttggcaccacacttca

SEQ ID NO: 158711 - DNA, 22 bp, Artificial Sequence
  chemically synthesized
caatcttggcaccacacttcaa

SEQ ID NO: 158712 - DNA, 22 bp, Artificial Sequence
  chemically synthesized
aatcttggcaccacacttcaat

SEQ ID NO: 158713 - DNA, 22 bp, Artificial Sequence
  chemically synthesized
ggcaccacacttcaatttctcc

SEQ ID NO: 158714 - DNA, 22 bp, Artificial Sequence
  chemically synthesized
gcaccacacttcaatttctccc

SEQ ID NO: 158715 - DNA, 22 bp, Artificial Sequence
  chemically synthesized
caatttctcccttctcttaatt

SEQ ID NO: 158716 - DNA, 22 bp, Artificial Sequence
  chemically synthesized
aatttctcccttctcttaattt

SEQ ID NO: 158717 - DNA, 22 bp, Artificial Sequence
  chemically synthesized
ctcccttctcttaatttcaatt

SEQ ID NO: 158718 - DNA, 22 bp, Artificial Sequence
  chemically synthesized
tcccttctcttaatttcaattc

SEQ ID NO: 158719 - DNA, 22 bp, Artificial Sequence
  chemically synthesized
ccttctcttaatttcaattcct

SEQ ID NO: 158720 - DNA, 22 bp, Artificial Sequence
  chemically synthesized
ctcttaatttcaattcctttca

SEQ ID NO: 158721 - DNA, 22 bp, Artificial Sequence
  chemically synthesized
tcttaatttcaattcctttcat

SEQ ID NO: 158722 - DNA, 22 bp, Artificial Sequence
  chemically synthesized
ttaatttcaattcctttcattt

SEQ ID NO: 158723 - DNA, 22 bp, Artificial Sequence
  chemically synthesized
aatttcaattcctttcattttc

SEQ ID NO: 158724 - DNA, 22 bp, Artificial Sequence
  chemically synthesized
atttcaattcctttcattttcc

SEQ ID NO: 158725 - DNA, 22 bp, Artificial Sequence
  chemically synthesized
caattcctttcattttccagta

SEQ ID NO: 158726 - DNA, 22 bp, Artificial Sequence
  chemically synthesized
aattcctttcattttccagtag

SEQ ID NO: 158727 - DNA, 22 bp, Artificial Sequence
  chemically synthesized
ctttcattttccagtagagaca

SEQ ID NO: 158728 - DNA, 22 bp, Artificial Sequence
  chemically synthesized
tcattttccagtagagacaaag

SEQ ID NO: 158729 - DNA, 22 bp, Artificial Sequence
  chemically synthesized
cattttccagtagagacaaagg

SEQ ID NO: 158730 - DNA, 22 bp, Artificial Sequence
  chemically synthesized
attttccagtagagacaaagga

SEQ ID NO: 158731 - DNA, 22 bp, Artificial Sequence
  chemically synthesized
tccagtagagacaaaggagaca

SEQ ID NO: 158732 - DNA, 22 bp, Artificial Sequence
  chemically synthesized
ccagtagagacaaaggagacat

SEQ ID NO: 158733 - DNA, 22 bp, Artificial Sequence
  chemically synthesized
cagtagagacaaaggagacatg

SEQ ID NO: 158734 - DNA, 22 bp, Artificial Sequence
  chemically synthesized
tatccgtggacccaaaactccg

SEQ ID NO: 158735 - DNA, 22 bp, Artificial Sequence
  chemically synthesized
atccgtggacccaaaactccgg

SEQ ID NO: 158736 - DNA, 22 bp, Artificial Sequence
  chemically synthesized
tccgtggacccaaaactccggt

SEQ ID NO: 158737 - DNA, 22 bp, Artificial Sequence
  chemically synthesized
cggtgccagtcacggactggga

SEQ ID NO: 158738 - DNA, 22 bp, Artificial Sequence
  chemically synthesized
ggaaggcagccttcccttggtg

SEQ ID NO: 158739 - DNA, 22 bp, Artificial Sequence
  chemically synthesized
cccttggtgtttaatcattgca

SEQ ID NO: 158740 - DNA, 22 bp, Artificial Sequence
  chemically synthesized
ccttggtgtttaatcattgcag

SEQ ID NO: 158741 - DNA, 22 bp, Artificial Sequence
  chemically synthesized
ggtgtttaatcattgcagggac

SEQ ID NO: 158742 - DNA, 22 bp, Artificial Sequence
  chemically synthesized
gtgtttaatcattgcagggaca

SEQ ID NO: 158743 - DNA, 22 bp, Artificial Sequence
  chemically synthesized
aatcattgcagggacacctctc

SEQ ID NO: 158744 - DNA, 22 bp, Artificial Sequence
  chemically synthesized
atcattgcagggacacctctct

SEQ ID NO: 158745 - DNA, 22 bp, Artificial Sequence
  chemically synthesized
cagggacacctctctgattatt

SEQ ID NO: 158746 - DNA, 22 bp, Artificial Sequence
  chemically synthesized
tctgattattaaaccatgtttc

SEQ ID NO: 158747 - DNA, 22 bp, Artificial Sequence
  chemically synthesized
tgattattaaaccatgtttcag

SEQ ID NO: 158748 - DNA, 22 bp, Artificial Sequence
  chemically synthesized
attattaaaccatgtttcagag

SEQ ID NO: 158749 - DNA, 22 bp, Artificial Sequence
  chemically synthesized
ttaaaccatgtttcagaggtgt

SEQ ID NO: 158750 - DNA, 22 bp, Artificial Sequence
  chemically synthesized
aaccatgtttcagaggtgtcag

SEQ ID NO: 158751 - DNA, 22 bp, Artificial Sequence
  chemically synthesized
cagaggtgtcagaccacgcagg

SEQ ID NO: 158752 - DNA, 22 bp, Artificial Sequence
  chemically synthesized
agaggtgtcagaccacgcaggg

SEQ ID NO: 158753 - DNA, 22 bp, Artificial Sequence
  chemically synthesized
ccttggtccttcacccttagcg

SEQ ID NO: 158754 - DNA, 22 bp, Artificial Sequence
  chemically synthesized
ggtccttcacccttagcggcaa

SEQ ID NO: 158755 - DNA, 22 bp, Artificial Sequence
  chemically synthesized
gtccttcacccttagcggcaaa

SEQ ID NO: 158756 - DNA, 22 bp, Artificial Sequence
  chemically synthesized
cacccttagcggcaaatcccac

SEQ ID NO: 158757 - DNA, 22 bp, Artificial Sequence
  chemically synthesized
acccttagcggcaaatcccact

SEQ ID NO: 158758 - DNA, 22 bp, Artificial Sequence
  chemically synthesized
agcggcaaatcccacttttctg

SEQ ID NO: 158759 - DNA, 22 bp, Artificial Sequence
  chemically synthesized
gcggcaaatcccacttttctgg

SEQ ID NO: 158760 - DNA, 22 bp, Artificial Sequence
  chemically synthesized
ttctggaggggggtaagtaccc

SEQ ID NO: 158761 - DNA, 22 bp, Artificial Sequence
  chemically synthesized
tctggaggggggtaagtacccc

SEQ ID NO: 158762 - DNA, 22 bp, Artificial Sequence
  chemically synthesized
ctggaggggggtaagtacccca

SEQ ID NO: 158763 - DNA, 22 bp, Artificial Sequence
  chemically synthesized
tggaggggggtaagtaccccaa

SEQ ID NO: 158764 - DNA, 22 bp, Artificial Sequence
  chemically synthesized
gaggggggtaagtaccccaacc

SEQ ID NO: 158765 - DNA, 22 bp, Artificial Sequence
  chemically synthesized
ctctccatgtctctgccccttc

SEQ ID NO: 158766 - DNA, 22 bp, Artificial Sequence
  chemically synthesized
tctccatgtctctgccccttca

SEQ ID NO: 158767 - DNA, 22 bp, Artificial Sequence
  chemically synthesized
tccatgtctctgccccttcact

SEQ ID NO: 158768 - DNA, 22 bp, Artificial Sequence
  chemically synthesized
catgtctctgccccttcactgc

SEQ ID NO: 158769 - DNA, 22 bp, Artificial Sequence
  chemically synthesized
tgccccttcactgcttttctgg

SEQ ID NO: 158770 - DNA, 22 bp, Artificial Sequence
  chemically synthesized
ccccttcactgcttttctgggg

SEQ ID NO: 158771 - DNA, 22 bp, Artificial Sequence
  chemically synthesized
cactgcttttctgggggcaaga

SEQ ID NO: 158772 - DNA, 22 bp, Artificial Sequence
  chemically synthesized
actgcttttctgggggcaagaa

SEQ ID NO: 158773 - DNA, 22 bp, Artificial Sequence
  chemically synthesized
cttttctgggggcaagaacccc

SEQ ID NO: 158774 - DNA, 22 bp, Artificial Sequence
  chemically synthesized
ttctgggggcaagaaccccaat

SEQ ID NO: 158775 - DNA, 22 bp, Artificial Sequence
  chemically synthesized
tctgggggcaagaaccccaatc

SEQ ID NO: 158776 - DNA, 22 bp, Artificial Sequence
  chemically synthesized
ctgggggcaagaaccccaatcc

SEQ ID NO: 158777 - DNA, 22 bp, Artificial Sequence
  chemically synthesized
tgggggcaagaaccccaatccc

SEQ ID NO: 158778 - DNA, 22 bp, Artificial Sequence
  chemically synthesized
ggggcaagaaccccaatccctt

SEQ ID NO: 158779 - DNA, 22 bp, Artificial Sequence
  chemically synthesized
atttctgtgccccaacctctta

SEQ ID NO: 158780 - DNA, 22 bp, Artificial Sequence
  chemically synthesized
tttctgtgccccaacctcttat

SEQ ID NO: 158781 - DNA, 22 bp, Artificial Sequence
  chemically synthesized
ctgtgccccaacctcttatctc

SEQ ID NO: 158782 - DNA, 22 bp, Artificial Sequence
  chemically synthesized
tgtgccccaacctcttatctca

SEQ ID NO: 158783 - DNA, 22 bp, Artificial Sequence
  chemically synthesized
tgccccaacctcttatctcagc

SEQ ID NO: 158784 - DNA, 22 bp, Artificial Sequence
  chemically synthesized
ttatctcagcaccccatccctt

SEQ ID NO: 158785 - DNA, 22 bp, Artificial Sequence
  chemically synthesized
atctcagcaccccatcccttat

SEQ ID NO: 158786 - DNA, 22 bp, Artificial Sequence
  chemically synthesized
tctcagcaccccatcccttatt

SEQ ID NO: 158787 - DNA, 22 bp, Artificial Sequence
  chemically synthesized
agcaccccatcccttatttcca

SEQ ID NO: 158788 - DNA, 22 bp, Artificial Sequence
  chemically synthesized
atttccacgccccatcctctta

SEQ ID NO: 158789 - DNA, 22 bp, Artificial Sequence
  chemically synthesized
tttccacgccccatcctcttat

SEQ ID NO: 158790 - DNA, 22 bp, Artificial Sequence
  chemically synthesized
ccacgccccatcctcttatctc

SEQ ID NO: 158791 - DNA, 22 bp, Artificial Sequence
  chemically synthesized
cacgccccatcctcttatctct

SEQ ID NO: 158792 - DNA, 22 bp, Artificial Sequence
  chemically synthesized
ttatctctgcaccccaatccct

SEQ ID NO: 158793 - DNA, 22 bp, Artificial Sequence
  chemically synthesized
atctctgcaccccaatccctta

SEQ ID NO: 158794 - DNA, 22 bp, Artificial Sequence
  chemically synthesized
tctctgcaccccaatcccttat

SEQ ID NO: 158795 - DNA, 22 bp, Artificial Sequence
  chemically synthesized
tgcaccccaatcccttatttct

SEQ ID NO: 158796 - DNA, 22 bp, Artificial Sequence
  chemically synthesized
caccccaatcccttatttctgc

SEQ ID NO: 158797 - DNA, 22 bp, Artificial Sequence
  chemically synthesized
atttctgcaccccgacctctta

SEQ ID NO: 158798 - DNA, 22 bp, Artificial Sequence
  chemically synthesized
tttctgcaccccgacctcttat

SEQ ID NO: 158799 - DNA, 22 bp, Artificial Sequence
  chemically synthesized
ctgcaccccgacctcttatctc

SEQ ID NO: 158800 - DNA, 22 bp, Artificial Sequence
  chemically synthesized
tgcaccccgacctcttatctct

SEQ ID NO: 158801 - DNA, 22 bp, Artificial Sequence
  chemically synthesized
caccccgacctcttatctctgc

SEQ ID NO: 158802 - DNA, 22 bp, Artificial Sequence
  chemically synthesized
ttatctctgcaccctgatccct

SEQ ID NO: 158803 - DNA, 22 bp, Artificial Sequence
  chemically synthesized
atctctgcaccctgatccctta

SEQ ID NO: 158804 - DNA, 22 bp, Artificial Sequence
  chemically synthesized
tctctgcaccctgatcccttat

SEQ ID NO: 158805 - DNA, 22 bp, Artificial Sequence
  chemically synthesized
tgcaccctgatcccttatttct

SEQ ID NO: 158806 - DNA, 22 bp, Artificial Sequence
  chemically synthesized
caccctgatcccttatttctgc

SEQ ID NO: 158807 - DNA, 22 bp, Artificial Sequence
  chemically synthesized
atcccttatttctgcaccccaa

SEQ ID NO: 158808 - DNA, 22 bp, Artificial Sequence
  chemically synthesized
atttctgcaccccaacctctta

SEQ ID NO: 158809 - DNA, 22 bp, Artificial Sequence
  chemically synthesized
tttctgcaccccaacctcttat

SEQ ID NO: 158810 - DNA, 22 bp, Artificial Sequence
  chemically synthesized
ctgcaccccaacctcttatctc

SEQ ID NO: 158811 - DNA, 22 bp, Artificial Sequence
  chemically synthesized
tgcaccccaacctcttatctct

SEQ ID NO: 158812 - DNA, 22 bp, Artificial Sequence
  chemically synthesized
caccccaacctcttatctctgc

SEQ ID NO: 158813 - DNA, 22 bp, Artificial Sequence
  chemically synthesized
ttatctctgcaccccgatccct

SEQ ID NO: 158814 - DNA, 22 bp, Artificial Sequence
  chemically synthesized
atctctgcaccccgatccctta

SEQ ID NO: 158815 - DNA, 22 bp, Artificial Sequence
  chemically synthesized
tctctgcaccccgatcccttat

SEQ ID NO: 158816 - DNA, 22 bp, Artificial Sequence
  chemically synthesized
tgcaccccgatcccttatttct

SEQ ID NO: 158817 - DNA, 22 bp, Artificial Sequence
  chemically synthesized
caccccgatcccttatttctgt

SEQ ID NO: 158818 - DNA, 22 bp, Artificial Sequence
  chemically synthesized
atttctgtgccccaacctctta

SEQ ID NO: 158819 - DNA, 22 bp, Artificial Sequence
  chemically synthesized
tttctgtgccccaacctcttat

SEQ ID NO: 158820 - DNA, 22 bp, Artificial Sequence
  chemically synthesized
ctgtgccccaacctcttatctc

SEQ ID NO: 158821 - DNA, 22 bp, Artificial Sequence
  chemically synthesized
tgtgccccaacctcttatctct

SEQ ID NO: 158822 - DNA, 22 bp, Artificial Sequence
  chemically synthesized
tgccccaacctcttatctctgc

SEQ ID NO: 158823 - DNA, 22 bp, Artificial Sequence
  chemically synthesized
ttatctctgcaccccaacccct

SEQ ID NO: 158824 - DNA, 22 bp, Artificial Sequence
  chemically synthesized
atctctgcaccccaacccctta

SEQ ID NO: 158825 - DNA, 22 bp, Artificial Sequence
  chemically synthesized
tctctgcaccccaaccccttat

SEQ ID NO: 158826 - DNA, 22 bp, Artificial Sequence
  chemically synthesized
tgcaccccaaccccttatttct

SEQ ID NO: 158827 - DNA, 22 bp, Artificial Sequence
  chemically synthesized
caccccaaccccttatttctgt

SEQ ID NO: 158828 - DNA, 22 bp, Artificial Sequence
  chemically synthesized
atttctgtgccctgacctctta

SEQ ID NO: 158829 - DNA, 22 bp, Artificial Sequence
  chemically synthesized
tttctgtgccctgacctcttat

SEQ ID NO: 158830 - DNA, 22 bp, Artificial Sequence
  chemically synthesized
ctgtgccctgacctcttatctc

SEQ ID NO: 158831 - DNA, 22 bp, Artificial Sequence
  chemically synthesized
tgtgccctgacctcttatctct

SEQ ID NO: 158832 - DNA, 22 bp, Artificial Sequence
  chemically synthesized
tgccctgacctcttatctctgc

SEQ ID NO: 158833 - DNA, 22 bp, Artificial Sequence
  chemically synthesized
acctcttatctctgcaccccaa

SEQ ID NO: 158834 - DNA, 22 bp, Artificial Sequence
  chemically synthesized
ttatctctgcaccccaacccct

SEQ ID NO: 158835 - DNA, 22 bp, Artificial Sequence
  chemically synthesized
atctctgcaccccaacccctta

SEQ ID NO: 158836 - DNA, 22 bp, Artificial Sequence
  chemically synthesized
tctctgcaccccaaccccttat

SEQ ID NO: 158837 - DNA, 22 bp, Artificial Sequence
  chemically synthesized
tgcaccccaaccccttatttcc

SEQ ID NO: 158838 - DNA, 22 bp, Artificial Sequence
  chemically synthesized
caccccaaccccttatttccgt

SEQ ID NO: 158839 - DNA, 22 bp, Artificial Sequence
  chemically synthesized
atttccgtgccccaaccccttg

SEQ ID NO: 158840 - DNA, 22 bp, Artificial Sequence
  chemically synthesized
tttccgtgccccaaccccttgc

SEQ ID NO: 158841 - DNA, 22 bp, Artificial Sequence
  chemically synthesized
ccgtgccccaaccccttgccca

SEQ ID NO: 158842 - DNA, 22 bp, Artificial Sequence
  chemically synthesized
cgtgccccaaccccttgcccat

SEQ ID NO: 158843 - DNA, 22 bp, Artificial Sequence
  chemically synthesized
gcccatttttctggtgagtaag

SEQ ID NO: 158844 - DNA, 22 bp, Artificial Sequence
  chemically synthesized
cccatttttctggtgagtaaga

SEQ ID NO: 158845 - DNA, 22 bp, Artificial Sequence
  chemically synthesized
ttctggtgagtaagaacccccg

SEQ ID NO: 158846 - DNA, 22 bp, Artificial Sequence
  chemically synthesized
tctggtgagtaagaacccccga

SEQ ID NO: 158847 - DNA, 22 bp, Artificial Sequence
  chemically synthesized
ctggtgagtaagaacccccgaa

SEQ ID NO: 158848 - DNA, 22 bp, Artificial Sequence
  chemically synthesized
tggtgagtaagaacccccgaac

SEQ ID NO: 158849 - DNA, 22 bp, Artificial Sequence
  chemically synthesized
gtgagtaagaacccccgaaccc

SEQ ID NO: 158850 - DNA, 22 bp, Artificial Sequence
  chemically synthesized
ccctccgtgtctgtactctttc

SEQ ID NO: 158851 - DNA, 22 bp, Artificial Sequence
  chemically synthesized
cctccgtgtctgtactctttct

SEQ ID NO: 158852 - DNA, 22 bp, Artificial Sequence
  chemically synthesized
cgtgtctgtactctttcttttc

SEQ ID NO: 158853 - DNA, 22 bp, Artificial Sequence
  chemically synthesized
tactctttcttttctctgggct

SEQ ID NO: 158854 - DNA, 22 bp, Artificial Sequence
  chemically synthesized
tttcttttctctgggcttgcct

SEQ ID NO: 158855 - DNA, 22 bp, Artificial Sequence
  chemically synthesized
tcttttctctgggcttgcctcc

SEQ ID NO: 158856 - DNA, 22 bp, Artificial Sequence
  chemically synthesized
cttttctctgggcttgcctcct

SEQ ID NO: 158857 - DNA, 22 bp, Artificial Sequence
  chemically synthesized
ttttctctgggcttgcctcctt

SEQ ID NO: 158858 - DNA, 22 bp, Artificial Sequence
  chemically synthesized
ttctctgggcttgcctccttca

SEQ ID NO: 158859 - DNA, 22 bp, Artificial Sequence
  chemically synthesized
tctctgggcttgcctccttcac

SEQ ID NO: 158860 - DNA, 22 bp, Artificial Sequence
  chemically synthesized
ctctgggcttgcctccttcact

SEQ ID NO: 158861 - DNA, 22 bp, Artificial Sequence
  chemically synthesized
tctgggcttgcctccttcacta

SEQ ID NO: 158862 - DNA, 22 bp, Artificial Sequence
  chemically synthesized
tgggcttgcctccttcactagg

SEQ ID NO: 158863 - DNA, 22 bp, Artificial Sequence
  chemically synthesized
ggcttgcctccttcactagggg

SEQ ID NO: 158864 - DNA, 22 bp, Artificial Sequence
  chemically synthesized
gcctccttcactaggggcaacc

SEQ ID NO: 158865 - DNA, 22 bp, Artificial Sequence
  chemically synthesized
cctccttcactaggggcaacct

SEQ ID NO: 158866 - DNA, 22 bp, Artificial Sequence
  chemically synthesized
cttcactaggggcaaccttcca

SEQ ID NO: 158867 - DNA, 22 bp, Artificial Sequence
  chemically synthesized
cactaggggcaaccttccaccc

SEQ ID NO: 158868 - DNA, 22 bp, Artificial Sequence
  chemically synthesized
actaggggcaaccttccaccct

SEQ ID NO: 158869 - DNA, 22 bp, Artificial Sequence
  chemically synthesized
ggggcaaccttccaccctccat

SEQ ID NO: 158870 - DNA, 22 bp, Artificial Sequence
  chemically synthesized
ccaccctccattcctccctctc

SEQ ID NO: 158871 - DNA, 22 bp, Artificial Sequence
  chemically synthesized
caccctccattcctccctctcc

SEQ ID NO: 158872 - DNA, 22 bp, Artificial Sequence
  chemically synthesized
cattcctccctctcccttagcc

SEQ ID NO: 158873 - DNA, 22 bp, Artificial Sequence
  chemically synthesized
ctccctctcccttagcctgtgc

SEQ ID NO: 158874 - DNA, 22 bp, Artificial Sequence
  chemically synthesized
cctctcccttagcctgtgctct

SEQ ID NO: 158875 - DNA, 22 bp, Artificial Sequence
  chemically synthesized
tcccttagcctgtgctctcaag

SEQ ID NO: 158876 - DNA, 22 bp, Artificial Sequence
  chemically synthesized
ccttagcctgtgctctcaagaa

SEQ ID NO: 158877 - DNA, 22 bp, Artificial Sequence
  chemically synthesized
agcctgtgctctcaagaactta

SEQ ID NO: 158878 - DNA, 22 bp, Artificial Sequence
  chemically synthesized
gcctgtgctctcaagaacttaa

SEQ ID NO: 158879 - DNA, 22 bp, Artificial Sequence
  chemically synthesized
tgctctcaagaacttaaaacct

SEQ ID NO: 158880 - DNA, 22 bp, Artificial Sequence
  chemically synthesized
tcaagaacttaaaacctcttca

SEQ ID NO: 158881 - DNA, 22 bp, Artificial Sequence
  chemically synthesized
aagaacttaaaacctcttcaac

SEQ ID NO: 158882 - DNA, 22 bp, Artificial Sequence
  chemically synthesized
aaaacctcttcaactcacacct

SEQ ID NO: 158883 - DNA, 22 bp, Artificial Sequence
  chemically synthesized
aaacctcttcaactcacacctg

SEQ ID NO: 158884 - DNA, 22 bp, Artificial Sequence
  chemically synthesized
ttcaactcacacctgacctaaa

SEQ ID NO: 158885 - DNA, 22 bp, Artificial Sequence
  chemically synthesized
caactcacacctgacctaaaac

SEQ ID NO: 158886 - DNA, 22 bp, Artificial Sequence
  chemically synthesized
aactcacacctgacctaaaacc

SEQ ID NO: 158887 - DNA, 22 bp, Artificial Sequence
  chemically synthesized
acacctgacctaaaacctaaat

SEQ ID NO: 158888 - DNA, 22 bp, Artificial Sequence
  chemically synthesized
acctaaaacctaaatgccttat

SEQ ID NO: 158889 - DNA, 22 bp, Artificial Sequence
  chemically synthesized
aaacctaaatgccttattttct

SEQ ID NO: 158890 - DNA, 22 bp, Artificial Sequence
  chemically synthesized
aatgccttattttcttctgcaa

SEQ ID NO: 158891 - DNA, 22 bp, Artificial Sequence
  chemically synthesized
attttcttctgcaaggccgctt

SEQ ID NO: 158892 - DNA, 22 bp, Artificial Sequence
  chemically synthesized
ttttcttctgcaaggccgcttg

SEQ ID NO: 158893 - DNA, 22 bp, Artificial Sequence
  chemically synthesized
tcttctgcaaggccgcttgact

SEQ ID NO: 158894 - DNA, 22 bp, Artificial Sequence
  chemically synthesized
cttctgcaaggccgcttgactc

SEQ ID NO: 158895 - DNA, 22 bp, Artificial Sequence
  chemically synthesized
ttctgcaaggccgcttgactcc

SEQ ID NO: 158896 - DNA, 22 bp, Artificial Sequence
  chemically synthesized
ctgcaaggccgcttgactccaa

SEQ ID NO: 158897 - DNA, 22 bp, Artificial Sequence
  chemically synthesized
tgcaaggccgcttgactccaat

SEQ ID NO: 158898 - DNA, 22 bp, Artificial Sequence
  chemically synthesized
caaggccgcttgactccaatac

SEQ ID NO: 158899 - DNA, 22 bp, Artificial Sequence
  chemically synthesized
gactccaatacaaactcgacag

SEQ ID NO: 158900 - DNA, 22 bp, Artificial Sequence
  chemically synthesized
actccaatacaaactcgacagt

SEQ ID NO: 158901 - DNA, 22 bp, Artificial Sequence
  chemically synthesized
caatacaaactcgacagtggtt

SEQ ID NO: 158902 - DNA, 22 bp, Artificial Sequence
  chemically synthesized
gacagtggttccaaatagccag

SEQ ID NO: 158903 - DNA, 22 bp, Artificial Sequence
  chemically synthesized
caaatagccagaaaatggcact

SEQ ID NO: 158904 - DNA, 22 bp, Artificial Sequence
  chemically synthesized
tcaatttttccattcttcaaga

SEQ ID NO: 158905 - DNA, 22 bp, Artificial Sequence
  chemically synthesized
caatttttccattcttcaagat

SEQ ID NO: 158906 - DNA, 22 bp, Artificial Sequence
  chemically synthesized
aatttttccattcttcaagatc

SEQ ID NO: 158907 - DNA, 22 bp, Artificial Sequence
  chemically synthesized
ttccattcttcaagatctaaat

SEQ ID NO: 158908 - DNA, 22 bp, Artificial Sequence
  chemically synthesized
tccattcttcaagatctaaata

SEQ ID NO: 158909 - DNA, 22 bp, Artificial Sequence
  chemically synthesized
ccattcttcaagatctaaataa

SEQ ID NO: 158910 - DNA, 22 bp, Artificial Sequence
  chemically synthesized
cattcttcaagatctaaataat

SEQ ID NO: 158911 - DNA, 22 bp, Artificial Sequence
  chemically synthesized
ttcaagatctaaataatttttg

SEQ ID NO: 158912 - DNA, 22 bp, Artificial Sequence
  chemically synthesized
caagatctaaataatttttgtc

SEQ ID NO: 158913 - DNA, 22 bp, Artificial Sequence
  chemically synthesized
aagatctaaataatttttgtcg

SEQ ID NO: 158914 - DNA, 22 bp, Artificial Sequence
  chemically synthesized
aataatttttgtcgtaaaacag

SEQ ID NO: 158915 - DNA, 22 bp, Artificial Sequence
  chemically synthesized
ttgtcgtaaaacaggcaaacag

SEQ ID NO: 158916 - DNA, 22 bp, Artificial Sequence
  chemically synthesized
tgtcgtaaaacaggcaaacagt

SEQ ID NO: 158917 - DNA, 22 bp, Artificial Sequence
  chemically synthesized
gtcgtaaaacaggcaaacagtc

SEQ ID NO: 158918 - DNA, 22 bp, Artificial Sequence
  chemically synthesized
tcgtaaaacaggcaaacagtct

SEQ ID NO: 158919 - DNA, 22 bp, Artificial Sequence
  chemically synthesized
aggtgcctgacgtccaggcatt

SEQ ID NO: 158920 - DNA, 22 bp, Artificial Sequence
  chemically synthesized
acgtccaggcattcttttacac

SEQ ID NO: 158921 - DNA, 22 bp, Artificial Sequence
  chemically synthesized
ttttacacattggtccctccct

SEQ ID NO: 158922 - DNA, 22 bp, Artificial Sequence
  chemically synthesized
ttacacattggtccctccctag

SEQ ID NO: 158923 - DNA, 22 bp, Artificial Sequence
  chemically synthesized
tacacattggtccctccctagt

SEQ ID NO: 158924 - DNA, 22 bp, Artificial Sequence
  chemically synthesized
acacattggtccctccctagtc

SEQ ID NO: 158925 - DNA, 22 bp, Artificial Sequence
  chemically synthesized
cacattggtccctccctagtct

SEQ ID NO: 158926 - DNA, 22 bp, Artificial Sequence
  chemically synthesized
gtccctccctagtctcttccca

SEQ ID NO: 158927 - DNA, 22 bp, Artificial Sequence
  chemically synthesized
cctagtctcttcccaatgcaac

SEQ ID NO: 158928 - DNA, 22 bp, Artificial Sequence
  chemically synthesized
gtctcttcccaatgcaacttgt

SEQ ID NO: 158929 - DNA, 22 bp, Artificial Sequence
  chemically synthesized
ttcccaatgcaacttgtcccaa

SEQ ID NO: 158930 - DNA, 22 bp, Artificial Sequence
  chemically synthesized
cccaatgcaacttgtcccaaat

SEQ ID NO: 158931 - DNA, 22 bp, Artificial Sequence
  chemically synthesized
ccaatgcaacttgtcccaaatc

SEQ ID NO: 158932 - DNA, 22 bp, Artificial Sequence
  chemically synthesized
gtcccaaatcttccttctttcc

SEQ ID NO: 158933 - DNA, 22 bp, Artificial Sequence
  chemically synthesized
tcccaaatcttccttctttccc

SEQ ID NO: 158934 - DNA, 22 bp, Artificial Sequence
  chemically synthesized
ccttctttccctcccgcctgtc

SEQ ID NO: 158935 - DNA, 22 bp, Artificial Sequence
  chemically synthesized
cttctttccctcccgcctgtcc

SEQ ID NO: 158936 - DNA, 22 bp, Artificial Sequence
  chemically synthesized
ctttccctcccgcctgtcccct

SEQ ID NO: 158937 - DNA, 22 bp, Artificial Sequence
  chemically synthesized
tttccctcccgcctgtcccctc

SEQ ID NO: 158938 - DNA, 22 bp, Artificial Sequence
  chemically synthesized
tccctcccgcctgtcccctcag

SEQ ID NO: 158939 - DNA, 22 bp, Artificial Sequence
  chemically synthesized
ccctcccgcctgtcccctcagt

SEQ ID NO: 158940 - DNA, 22 bp, Artificial Sequence
  chemically synthesized
cctcccgcctgtcccctcagtc

SEQ ID NO: 158941 - DNA, 22 bp, Artificial Sequence
  chemically synthesized
ccgcctgtcccctcagtcccaa

SEQ ID NO: 158942 - DNA, 22 bp, Artificial Sequence
  chemically synthesized
tcccctcagtcccaactccaag

SEQ ID NO: 158943 - DNA, 22 bp, Artificial Sequence
  chemically synthesized
agtcccaactccaagcgtcgct

SEQ ID NO: 158944 - DNA, 22 bp, Artificial Sequence
  chemically synthesized
caagcgtcgctgagtctttcta

SEQ ID NO: 158945 - DNA, 22 bp, Artificial Sequence
  chemically synthesized
agtctttctaatcttccttttc

SEQ ID NO: 158946 - DNA, 22 bp, Artificial Sequence
  chemically synthesized
tctaatcttccttttctacaga

SEQ ID NO: 158947 - DNA, 22 bp, Artificial Sequence
  chemically synthesized
ctaatcttccttttctacagac

SEQ ID NO: 158948 - DNA, 22 bp, Artificial Sequence
  chemically synthesized
taatcttccttttctacagacc

SEQ ID NO: 158949 - DNA, 22 bp, Artificial Sequence
  chemically synthesized
atcttccttttctacagaccca

SEQ ID NO: 158950 - DNA, 22 bp, Artificial Sequence
  chemically synthesized
ccttttctacagacccatctga

SEQ ID NO: 158951 - DNA, 22 bp, Artificial Sequence
  chemically synthesized
cttttctacagacccatctgac

SEQ ID NO: 158952 - DNA, 22 bp, Artificial Sequence
  chemically synthesized
ttctacagacccatctgacgtc

SEQ ID NO: 158953 - DNA, 22 bp, Artificial Sequence
  chemically synthesized
tctacagacccatctgacgtct

SEQ ID NO: 158954 - DNA, 22 bp, Artificial Sequence
  chemically synthesized
ctacagacccatctgacgtctc

SEQ ID NO: 158955 - DNA, 22 bp, Artificial Sequence
  chemically synthesized
tacagacccatctgacgtctcc

SEQ ID NO: 158956 - DNA, 22 bp, Artificial Sequence
  chemically synthesized
cagacccatctgacgtctcccc

SEQ ID NO: 158957 - DNA, 22 bp, Artificial Sequence
  chemically synthesized
acgtctcccctcctccccaggc

SEQ ID NO: 158958 - DNA, 22 bp, Artificial Sequence
  chemically synthesized
ccctcctccccaggctgctcct

SEQ ID NO: 158959 - DNA, 22 bp, Artificial Sequence
  chemically synthesized
ctccccaggctgctccttgcca

SEQ ID NO: 158960 - DNA, 22 bp, Artificial Sequence
  chemically synthesized
cccaggctgctccttgccaggc

SEQ ID NO: 158961 - DNA, 22 bp, Artificial Sequence
  chemically synthesized
ctccttgccaggccgagctagg

SEQ ID NO: 158962 - DNA, 22 bp, Artificial Sequence
  chemically synthesized
cttgccaggccgagctaggtcc

SEQ ID NO: 158963 - DNA, 22 bp, Artificial Sequence
  chemically synthesized
gccaggccgagctaggtcccaa

SEQ ID NO: 158964 - DNA, 22 bp, Artificial Sequence
  chemically synthesized
ccaggccgagctaggtcccaaa

SEQ ID NO: 158965 - DNA, 22 bp, Artificial Sequence
  chemically synthesized
ggtcccaaatcttcctcagcct

SEQ ID NO: 158966 - DNA, 22 bp, Artificial Sequence
  chemically synthesized
cctcagcctcagctcctccacc

SEQ ID NO: 158967 - DNA, 22 bp, Artificial Sequence
  chemically synthesized
ctcagcctcagctcctccaccc

SEQ ID NO: 158968 - DNA, 22 bp, Artificial Sequence
  chemically synthesized
agcctcagctcctccaccctgt

SEQ ID NO: 158969 - DNA, 22 bp, Artificial Sequence
  chemically synthesized
agctcctccaccctgtaatctt

SEQ ID NO: 158970 - DNA, 22 bp, Artificial Sequence
  chemically synthesized
ctccaccctgtaatctttttat

SEQ ID NO: 158971 - DNA, 22 bp, Artificial Sequence
  chemically synthesized
caccctgtaatctttttatcac

SEQ ID NO: 158972 - DNA, 22 bp, Artificial Sequence
  chemically synthesized
taatctttttatcacctcccct

SEQ ID NO: 158973 - DNA, 22 bp, Artificial Sequence
  chemically synthesized
tttatcacctcccctcctcaca

SEQ ID NO: 158974 - DNA, 22 bp, Artificial Sequence
  chemically synthesized
ttatcacctcccctcctcacac

SEQ ID NO: 158975 - DNA, 22 bp, Artificial Sequence
  chemically synthesized
tatcacctcccctcctcacacc

SEQ ID NO: 158976 - DNA, 22 bp, Artificial Sequence
  chemically synthesized
atcacctcccctcctcacaccc

SEQ ID NO: 158977 - DNA, 22 bp, Artificial Sequence
  chemically synthesized
tcacctcccctcctcacacccg

SEQ ID NO: 158978 - DNA, 22 bp, Artificial Sequence
  chemically synthesized
ccctcctcacacccggtccggt

SEQ ID NO: 158979 - DNA, 22 bp, Artificial Sequence
  chemically synthesized
ctcacacccggtccggtttaca

SEQ ID NO: 158980 - DNA, 22 bp, Artificial Sequence
  chemically synthesized
acacccggtccggtttacagtt

SEQ ID NO: 158981 - DNA, 22 bp, Artificial Sequence
  chemically synthesized
acagtttcattccgtgactagc

SEQ ID NO: 158982 - DNA, 22 bp, Artificial Sequence
  chemically synthesized
cagtttcattccgtgactagcc

SEQ ID NO: 158983 - DNA, 22 bp, Artificial Sequence
  chemically synthesized
cattccgtgactagccctcccc

SEQ ID NO: 158984 - DNA, 22 bp, Artificial Sequence
  chemically synthesized
attccgtgactagccctcccca

SEQ ID NO: 158985 - DNA, 22 bp, Artificial Sequence
  chemically synthesized
cgtgactagccctccccaacct

SEQ ID NO: 158986 - DNA, 22 bp, Artificial Sequence
  chemically synthesized
gccctccccaacctgcccagca

SEQ ID NO: 158987 - DNA, 22 bp, Artificial Sequence
  chemically synthesized
cccaacctgcccagcaatttcc

SEQ ID NO: 158988 - DNA, 22 bp, Artificial Sequence
  chemically synthesized
cccagcaatttcctattaagaa

SEQ ID NO: 158989 - DNA, 22 bp, Artificial Sequence
  chemically synthesized
cctattaagaaggtggctgaag

SEQ ID NO: 158990 - DNA, 22 bp, Artificial Sequence
  chemically synthesized
ctattaagaaggtggctgaagc

SEQ ID NO: 158991 - DNA, 22 bp, Artificial Sequence
  chemically synthesized
ttaagaaggtggctgaagctaa

SEQ ID NO: 158992 - DNA, 22 bp, Artificial Sequence
  chemically synthesized
agaaggtggctgaagctaaagg

SEQ ID NO: 158993 - DNA, 22 bp, Artificial Sequence
  chemically synthesized
aagctaaaggcgtagtcaaggt

SEQ ID NO: 158994 - DNA, 22 bp, Artificial Sequence
  chemically synthesized
aaggcgtagtcaaggttaatgc

SEQ ID NO: 158995 - DNA, 22 bp, Artificial Sequence
  chemically synthesized
atgctcctttttctttatccga

SEQ ID NO: 158996 - DNA, 22 bp, Artificial Sequence
  chemically synthesized
ctttttctttatccgacctctc

SEQ ID NO: 158997 - DNA, 22 bp, Artificial Sequence
  chemically synthesized
tttctttatccgacctctcccg

SEQ ID NO: 158998 - DNA, 22 bp, Artificial Sequence
  chemically synthesized
ttctttatccgacctctcccga

SEQ ID NO: 158999 - DNA, 22 bp, Artificial Sequence
  chemically synthesized
tctttatccgacctctcccgaa

SEQ ID NO: 159000 - DNA, 22 bp, Artificial Sequence
  chemically synthesized
ctttatccgacctctcccgaat

SEQ ID NO: 159001 - DNA, 22 bp, Artificial Sequence
  chemically synthesized
tttatccgacctctcccgaatc

SEQ ID NO: 159002 - DNA, 22 bp, Artificial Sequence
  chemically synthesized
tatccgacctctcccgaatcag

SEQ ID NO: 159003 - DNA, 22 bp, Artificial Sequence
  chemically synthesized
atccgacctctcccgaatcaga

SEQ ID NO: 159004 - DNA, 22 bp, Artificial Sequence
  chemically synthesized
tccgacctctcccgaatcagag

SEQ ID NO: 159005 - DNA, 22 bp, Artificial Sequence
  chemically synthesized
tcccgaatcagagcgtttaggc

SEQ ID NO: 159006 - DNA, 22 bp, Artificial Sequence
  chemically synthesized
ccgaatcagagcgtttaggctc

SEQ ID NO: 159007 - DNA, 22 bp, Artificial Sequence
  chemically synthesized
aggctctttcatcaaatatgaa

SEQ ID NO: 159008 - DNA, 22 bp, Artificial Sequence
  chemically synthesized
ggctctttcatcaaatatgaaa

SEQ ID NO: 159009 - DNA, 22 bp, Artificial Sequence
  chemically synthesized
tttcatcaaatatgaaaaaccc

SEQ ID NO: 159010 - DNA, 22 bp, Artificial Sequence
  chemically synthesized
tcatcaaatatgaaaaacccag

SEQ ID NO: 159011 - DNA, 22 bp, Artificial Sequence
  chemically synthesized
catcaaatatgaaaaacccagc

SEQ ID NO: 159012 - DNA, 22 bp, Artificial Sequence
  chemically synthesized
atcaaatatgaaaaacccagcc

SEQ ID NO: 159013 - DNA, 22 bp, Artificial Sequence
  chemically synthesized
atggctcgttcggcagcaaccc

SEQ ID NO: 159014 - DNA, 22 bp, Artificial Sequence
  chemically synthesized
gttcggcagcaaccctgagacg

SEQ ID NO: 159015 - DNA, 22 bp, Artificial Sequence
  chemically synthesized
ggcagcaaccctgagacgcttt

SEQ ID NO: 159016 - DNA, 22 bp, Artificial Sequence
  chemically synthesized
agacgctttacagccctagacc

SEQ ID NO: 159017 - DNA, 22 bp, Artificial Sequence
  chemically synthesized
tacagccctagaccctaaaagg

SEQ ID NO: 159018 - DNA, 22 bp, Artificial Sequence
  chemically synthesized
acagccctagaccctaaaagga

SEQ ID NO: 159019 - DNA, 22 bp, Artificial Sequence
  chemically synthesized
cagccctagaccctaaaaggac

SEQ ID NO: 159020 - DNA, 22 bp, Artificial Sequence
  chemically synthesized
gaccctaaaaggacaaaaggcc

SEQ ID NO: 159021 - DNA, 22 bp, Artificial Sequence
  chemically synthesized
aaaggacaaaaggccactttat

SEQ ID NO: 159022 - DNA, 22 bp, Artificial Sequence
  chemically synthesized
tattctcaatatacattttatt

SEQ ID NO: 159023 - DNA, 22 bp, Artificial Sequence
  chemically synthesized
attctcaatatacattttatta

SEQ ID NO: 159024 - DNA, 22 bp, Artificial Sequence
  chemically synthesized
ttctcaatatacattttattac

SEQ ID NO: 159025 - DNA, 22 bp, Artificial Sequence
  chemically synthesized
tcaatatacattttattaccca

SEQ ID NO: 159026 - DNA, 22 bp, Artificial Sequence
  chemically synthesized
aatatacattttattacccaat

SEQ ID NO: 159027 - DNA, 22 bp, Artificial Sequence
  chemically synthesized
tattacccaatctgctcctgac

SEQ ID NO: 159028 - DNA, 22 bp, Artificial Sequence
  chemically synthesized
attacccaatctgctcctgaca

SEQ ID NO: 159029 - DNA, 22 bp, Artificial Sequence
  chemically synthesized
ttacccaatctgctcctgacat

SEQ ID NO: 159030 - DNA, 22 bp, Artificial Sequence
  chemically synthesized
cccaatctgctcctgacattaa

SEQ ID NO: 159031 - DNA, 22 bp, Artificial Sequence
  chemically synthesized
ctcctgacattaaataaaactc

SEQ ID NO: 159032 - DNA, 22 bp, Artificial Sequence
  chemically synthesized
ctgacattaaataaaactccaa

SEQ ID NO: 159033 - DNA, 22 bp, Artificial Sequence
  chemically synthesized
acattaaataaaactccaaaaa

SEQ ID NO: 159034 - DNA, 22 bp, Artificial Sequence
  chemically synthesized
aataaaactccaaaaattaaat

SEQ ID NO: 159035 - DNA, 22 bp, Artificial Sequence
  chemically synthesized
caaaaattaaattctggacctc

SEQ ID NO: 159036 - DNA, 22 bp, Artificial Sequence
  chemically synthesized
aattctggacctcaaaccccac

SEQ ID NO: 159037 - DNA, 22 bp, Artificial Sequence
  chemically synthesized
tggacctcaaaccccacaacag

SEQ ID NO: 159038 - DNA, 22 bp, Artificial Sequence
  chemically synthesized
gacctcaaaccccacaacagga

SEQ ID NO: 159039 - DNA, 22 bp, Artificial Sequence
  chemically synthesized
aaaccccacaacaggactcaat

SEQ ID NO: 159040 - DNA, 22 bp, Artificial Sequence
  chemically synthesized
aattaacctcaccttcaaggtg

SEQ ID NO: 159041 - DNA, 22 bp, Artificial Sequence
  chemically synthesized
acctcaccttcaaggtgtacaa

SEQ ID NO: 159042 - DNA, 22 bp, Artificial Sequence
  chemically synthesized
accttcaaggtgtacaataata

SEQ ID NO: 159043 - DNA, 22 bp, Artificial Sequence
  chemically synthesized
caaggtgtacaataatagagta

SEQ ID NO: 159044 - DNA, 22 bp, Artificial Sequence
  chemically synthesized
aaggtgtacaataatagagtag

SEQ ID NO: 159045 - DNA, 22 bp, Artificial Sequence
  chemically synthesized
ttgagttgcaattccttgcctc

SEQ ID NO: 159046 - DNA, 22 bp, Artificial Sequence
  chemically synthesized
tgagttgcaattccttgcctcc

SEQ ID NO: 159047 - DNA, 22 bp, Artificial Sequence
  chemically synthesized
gagttgcaattccttgcctcca

SEQ ID NO: 159048 - DNA, 22 bp, Artificial Sequence
  chemically synthesized
agttgcaattccttgcctccac

SEQ ID NO: 159049 - DNA, 22 bp, Artificial Sequence
  chemically synthesized
caattccttgcctccactgtga

SEQ ID NO: 159050 - DNA, 22 bp, Artificial Sequence
  chemically synthesized
cttgcctccactgtgagacaaa

SEQ ID NO: 159051 - DNA, 22 bp, Artificial Sequence
  chemically synthesized
gcctccactgtgagacaaaccc

SEQ ID NO: 159052 - DNA, 22 bp, Artificial Sequence
  chemically synthesized
cctccactgtgagacaaacccc

SEQ ID NO: 159053 - DNA, 22 bp, Artificial Sequence
  chemically synthesized
cactgtgagacaaaccccagcc

SEQ ID NO: 159054 - DNA, 22 bp, Artificial Sequence
  chemically synthesized
tgagacaaaccccagccacatc

SEQ ID NO: 159055 - DNA, 22 bp, Artificial Sequence
  chemically synthesized
cagcacacaagaacttccaaat

SEQ ID NO: 159056 - DNA, 22 bp, Artificial Sequence
  chemically synthesized
ccaaatgcctaaaccgcagtgg

SEQ ID NO: 159057 - DNA, 22 bp, Artificial Sequence
  chemically synthesized
caaatgcctaaaccgcagtggc

SEQ ID NO: 159058 - DNA, 22 bp, Artificial Sequence
  chemically synthesized
aaccgcagtggccaggcgttcc

SEQ ID NO: 159059 - DNA, 22 bp, Artificial Sequence
  chemically synthesized
ctccggaaccacctcccccagg

SEQ ID NO: 159060 - DNA, 22 bp, Artificial Sequence
  chemically synthesized
cggaaccacctcccccaggagc

SEQ ID NO: 159061 - DNA, 22 bp, Artificial Sequence
  chemically synthesized
ccccaggagcttgctacaagtg

SEQ ID NO: 159062 - DNA, 22 bp, Artificial Sequence
  chemically synthesized
gctacaagtgccagaaatctgg

SEQ ID NO: 159063 - DNA, 22 bp, Artificial Sequence
  chemically synthesized
ctacaagtgccagaaatctggc

SEQ ID NO: 159064 - DNA, 22 bp, Artificial Sequence
  chemically synthesized
caagtgccagaaatctggccac

SEQ ID NO: 159065 - DNA, 22 bp, Artificial Sequence
  chemically synthesized
gccaccaggccaaggaatgccc

SEQ ID NO: 159066 - DNA, 22 bp, Artificial Sequence
  chemically synthesized
ctcctaagccgtgtcccatctg

SEQ ID NO: 159067 - DNA, 22 bp, Artificial Sequence
  chemically synthesized
ctaagccgtgtcccatctgtgc

SEQ ID NO: 159068 - DNA, 22 bp, Artificial Sequence
  chemically synthesized
agccgtgtcccatctgtgcagg

SEQ ID NO: 159069 - DNA, 22 bp, Artificial Sequence
  chemically synthesized
tgcaggaccccactagaaatcg

SEQ ID NO: 159070 - DNA, 22 bp, Artificial Sequence
  chemically synthesized
gaaatcggactgttcaactcac

SEQ ID NO: 159071 - DNA, 22 bp, Artificial Sequence
  chemically synthesized
ttcaactcacctggcagccact

SEQ ID NO: 159072 - DNA, 22 bp, Artificial Sequence
  chemically synthesized
aactcacctggcagccactcct

SEQ ID NO: 159073 - DNA, 22 bp, Artificial Sequence
  chemically synthesized
acctggcagccactcctagagc

SEQ ID NO: 159074 - DNA, 22 bp, Artificial Sequence
  chemically synthesized
gcagccactcctagagcccctg

SEQ ID NO: 159075 - DNA, 22 bp, Artificial Sequence
  chemically synthesized
ctagagcccctggaactctggc

SEQ ID NO: 159076 - DNA, 22 bp, Artificial Sequence
  chemically synthesized
gagcccctggaactctggccca

SEQ ID NO: 159077 - DNA, 22 bp, Artificial Sequence
  chemically synthesized
gaactctggcccaaggctccct

SEQ ID NO: 159078 - DNA, 22 bp, Artificial Sequence
  chemically synthesized
tggcccaaggctccctgactga

SEQ ID NO: 159079 - DNA, 22 bp, Artificial Sequence
  chemically synthesized
gcccaaggctccctgactgact

SEQ ID NO: 159080 - DNA, 22 bp, Artificial Sequence
  chemically synthesized
cctgactgactccttcccagat

SEQ ID NO: 159081 - DNA, 22 bp, Artificial Sequence
  chemically synthesized
actgactccttcccagatcttc

SEQ ID NO: 159082 - DNA, 22 bp, Artificial Sequence
  chemically synthesized
actccttcccagatcttctcgg

SEQ ID NO: 159083 - DNA, 22 bp, Artificial Sequence
  chemically synthesized
cttcccagatcttctcggcttt

SEQ ID NO: 159084 - DNA, 22 bp, Artificial Sequence
  chemically synthesized
cccagatcttctcggctttgca

SEQ ID NO: 159085 - DNA, 22 bp, Artificial Sequence
  chemically synthesized
ccagatcttctcggctttgcag

SEQ ID NO: 159086 - DNA, 22 bp, Artificial Sequence
  chemically synthesized
ctcggctttgcagctgaagact

SEQ ID NO: 159087 - DNA, 22 bp, Artificial Sequence
  chemically synthesized
tcggctttgcagctgaagactg

SEQ ID NO: 159088 - DNA, 22 bp, Artificial Sequence
  chemically synthesized
ggctttgcagctgaagactgcc

SEQ ID NO: 159089 - DNA, 22 bp, Artificial Sequence
  chemically synthesized
tgcagctgaagactgccactgc

SEQ ID NO: 159090 - DNA, 22 bp, Artificial Sequence
  chemically synthesized
gcagctgaagactgccactgcc

SEQ ID NO: 159091 - DNA, 22 bp, Artificial Sequence
  chemically synthesized
cagctgaagactgccactgcct

SEQ ID NO: 159092 - DNA, 22 bp, Artificial Sequence
  chemically synthesized
aagactgccactgcctgatcgc

SEQ ID NO: 159093 - DNA, 22 bp, Artificial Sequence
  chemically synthesized
ccactgcctgatcgcctcggaa

SEQ ID NO: 159094 - DNA, 22 bp, Artificial Sequence
  chemically synthesized
cctgatcgcctcggaagccctg

SEQ ID NO: 159095 - DNA, 22 bp, Artificial Sequence
  chemically synthesized
atcgcctcggaagccctgtaga

SEQ ID NO: 159096 - DNA, 22 bp, Artificial Sequence
  chemically synthesized
ggaagccctgtagaccatcaca

SEQ ID NO: 159097 - DNA, 22 bp, Artificial Sequence
  chemically synthesized
tagaccatcacagacaccgagc

SEQ ID NO: 159098 - DNA, 22 bp, Artificial Sequence
  chemically synthesized
taggtaattctcacagtggagg

SEQ ID NO: 159099 - DNA, 22 bp, Artificial Sequence
  chemically synthesized
aggtaattctcacagtggaggg

SEQ ID NO: 159100 - DNA, 22 bp, Artificial Sequence
  chemically synthesized
ggtaattctcacagtggagggt

SEQ ID NO: 159101 - DNA, 22 bp, Artificial Sequence
  chemically synthesized
tcacagtggagggtaagtctgt

SEQ ID NO: 159102 - DNA, 22 bp, Artificial Sequence
  chemically synthesized
acagtggagggtaagtctgtac

SEQ ID NO: 159103 - DNA, 22 bp, Artificial Sequence
  chemically synthesized
tacccttcttaatcagtatgga

SEQ ID NO: 159104 - DNA, 22 bp, Artificial Sequence
  chemically synthesized
cttaatcagtatggaggctacc

SEQ ID NO: 159105 - DNA, 22 bp, Artificial Sequence
  chemically synthesized
ttaatcagtatggaggctaccc

SEQ ID NO: 159106 - DNA, 22 bp, Artificial Sequence
  chemically synthesized
aatcagtatggaggctacccac

SEQ ID NO: 159107 - DNA, 22 bp, Artificial Sequence
  chemically synthesized
atcagtatggaggctacccact

SEQ ID NO: 159108 - DNA, 22 bp, Artificial Sequence
  chemically synthesized
cccactccacattaccttcttt

SEQ ID NO: 159109 - DNA, 22 bp, Artificial Sequence
  chemically synthesized
cacattaccttcttttcaaagg

SEQ ID NO: 159110 - DNA, 22 bp, Artificial Sequence
  chemically synthesized
ccttcttttcaaaggcctgttt

SEQ ID NO: 159111 - DNA, 22 bp, Artificial Sequence
  chemically synthesized
cttttcaaaggcctgtttccct

SEQ ID NO: 159112 - DNA, 22 bp, Artificial Sequence
  chemically synthesized
ttttcaaaggcctgtttccctt

SEQ ID NO: 159113 - DNA, 22 bp, Artificial Sequence
  chemically synthesized
ttcaaaggcctgtttcccttgc

SEQ ID NO: 159114 - DNA, 22 bp, Artificial Sequence
  chemically synthesized
tcaaaggcctgtttcccttgcc

SEQ ID NO: 159115 - DNA, 22 bp, Artificial Sequence
  chemically synthesized
caaaggcctgtttcccttgcct

SEQ ID NO: 159116 - DNA, 22 bp, Artificial Sequence
  chemically synthesized
aaaggcctgtttcccttgcctc

SEQ ID NO: 159117 - DNA, 22 bp, Artificial Sequence
  chemically synthesized
tttcccttgcctccataactgt

SEQ ID NO: 159118 - DNA, 22 bp, Artificial Sequence
  chemically synthesized
cccttgcctccataactgttgt

SEQ ID NO: 159119 - DNA, 22 bp, Artificial Sequence
  chemically synthesized
ccttgcctccataactgttgta

SEQ ID NO: 159120 - DNA, 22 bp, Artificial Sequence
  chemically synthesized
gcctccataactgttgtaggta

SEQ ID NO: 159121 - DNA, 22 bp, Artificial Sequence
  chemically synthesized
cctccataactgttgtaggtat

SEQ ID NO: 159122 - DNA, 22 bp, Artificial Sequence
  chemically synthesized
cataactgttgtaggtattgat

SEQ ID NO: 159123 - DNA, 22 bp, Artificial Sequence
  chemically synthesized
ttgtaggtattgatggccaggc

SEQ ID NO: 159124 - DNA, 22 bp, Artificial Sequence
  chemically synthesized
taggtattgatggccaggcttc

SEQ ID NO: 159125 - DNA, 22 bp, Artificial Sequence
  chemically synthesized
atggccaggcttctaaacctct

SEQ ID NO: 159126 - DNA, 22 bp, Artificial Sequence
  chemically synthesized
ctaaacctcttaaaattcccca

SEQ ID NO: 159127 - DNA, 22 bp, Artificial Sequence
  chemically synthesized
taaacctcttaaaattccccaa

SEQ ID NO: 159128 - DNA, 22 bp, Artificial Sequence
  chemically synthesized
aacctcttaaaattccccaact

SEQ ID NO: 159129 - DNA, 22 bp, Artificial Sequence
  chemically synthesized
ttaaaattccccaactctggtg

SEQ ID NO: 159130 - DNA, 22 bp, Artificial Sequence
  chemically synthesized
aaaattccccaactctggtgct

SEQ ID NO: 159131 - DNA, 22 bp, Artificial Sequence
  chemically synthesized
aaattccccaactctggtgcta

SEQ ID NO: 159132 - DNA, 22 bp, Artificial Sequence
  chemically synthesized
cccaactctggtgctaaccgag

SEQ ID NO: 159133 - DNA, 22 bp, Artificial Sequence
  chemically synthesized
tggtgctaaccgagacgatact

SEQ ID NO: 159134 - DNA, 22 bp, Artificial Sequence
  chemically synthesized
gtgctaaccgagacgatactct

SEQ ID NO: 159135 - DNA, 22 bp, Artificial Sequence
  chemically synthesized
accgagacgatactcttttaag

SEQ ID NO: 159136 - DNA, 22 bp, Artificial Sequence
  chemically synthesized
ttttaagcactcctttttcatt

SEQ ID NO: 159137 - DNA, 22 bp, Artificial Sequence
  chemically synthesized
ttaagcactcctttttcattat

SEQ ID NO: 159138 - DNA, 22 bp, Artificial Sequence
  chemically synthesized
taagcactcctttttcattatc

SEQ ID NO: 159139 - DNA, 22 bp, Artificial Sequence
  chemically synthesized
aagcactcctttttcattatcc

SEQ ID NO: 159140 - DNA, 22 bp, Artificial Sequence
  chemically synthesized
agcactcctttttcattatccc

SEQ ID NO: 159141 - DNA, 22 bp, Artificial Sequence
  chemically synthesized
ctttttcattatccccacctgc

SEQ ID NO: 159142 - DNA, 22 bp, Artificial Sequence
  chemically synthesized
tttcattatccccacctgccag

SEQ ID NO: 159143 - DNA, 22 bp, Artificial Sequence
  chemically synthesized
ttcattatccccacctgccagt

SEQ ID NO: 159144 - DNA, 22 bp, Artificial Sequence
  chemically synthesized
tcattatccccacctgccagtt

SEQ ID NO: 159145 - DNA, 22 bp, Artificial Sequence
  chemically synthesized
cattatccccacctgccagttc

SEQ ID NO: 159146 - DNA, 22 bp, Artificial Sequence
  chemically synthesized
attatccccacctgccagttcc

SEQ ID NO: 159147 - DNA, 22 bp, Artificial Sequence
  chemically synthesized
tccccacctgccagttccctta

SEQ ID NO: 159148 - DNA, 22 bp, Artificial Sequence
  chemically synthesized
ccagttcccttattaggccgag

SEQ ID NO: 159149 - DNA, 22 bp, Artificial Sequence
  chemically synthesized
ccttattaggccgagacacttt

SEQ ID NO: 159150 - DNA, 22 bp, Artificial Sequence
  chemically synthesized
attaggccgagacactttaact

SEQ ID NO: 159151 - DNA, 22 bp, Artificial Sequence
  chemically synthesized
ttaggccgagacactttaacta

SEQ ID NO: 159152 - DNA, 22 bp, Artificial Sequence
  chemically synthesized
ggccgagacactttaactaaat

SEQ ID NO: 159153 - DNA, 22 bp, Artificial Sequence
  chemically synthesized
taactaaattatctgcttccct

SEQ ID NO: 159154 - DNA, 22 bp, Artificial Sequence
  chemically synthesized
aactaaattatctgcttccctg

SEQ ID NO: 159155 - DNA, 22 bp, Artificial Sequence
  chemically synthesized
actaaattatctgcttccctga

SEQ ID NO: 159156 - DNA, 22 bp, Artificial Sequence
  chemically synthesized
aattatctgcttccctgactat

SEQ ID NO: 159157 - DNA, 22 bp, Artificial Sequence
  chemically synthesized
tctgcttccctgactattcctg

SEQ ID NO: 159158 - DNA, 22 bp, Artificial Sequence
  chemically synthesized
cttccctgactattcctgggct

SEQ ID NO: 159159 - DNA, 22 bp, Artificial Sequence
  chemically synthesized
ccctgactattcctgggctaca

SEQ ID NO: 159160 - DNA, 22 bp, Artificial Sequence
  chemically synthesized
cctgactattcctgggctacag

SEQ ID NO: 159161 - DNA, 22 bp, Artificial Sequence
  chemically synthesized
actattcctgggctacagccat

SEQ ID NO: 159162 - DNA, 22 bp, Artificial Sequence
  chemically synthesized
ttcctgggctacagccatacct

SEQ ID NO: 159163 - DNA, 22 bp, Artificial Sequence
  chemically synthesized
ctgggctacagccatacctcat

SEQ ID NO: 159164 - DNA, 22 bp, Artificial Sequence
  chemically synthesized
ggctacagccatacctcattgc

SEQ ID NO: 159165 - DNA, 22 bp, Artificial Sequence
  chemically synthesized
cagccatacctcattgccatgt

SEQ ID NO: 159166 - DNA, 22 bp, Artificial Sequence
  chemically synthesized
attgccatgttttcccccagtt

SEQ ID NO: 159167 - DNA, 22 bp, Artificial Sequence
  chemically synthesized
ccatgttttcccccagttcaaa

SEQ ID NO: 159168 - DNA, 22 bp, Artificial Sequence
  chemically synthesized
tcccccagttcaaagcctcctt

SEQ ID NO: 159169 - DNA, 22 bp, Artificial Sequence
  chemically synthesized
cccccagttcaaagcctccttc

SEQ ID NO: 159170 - DNA, 22 bp, Artificial Sequence
  chemically synthesized
ccccagttcaaagcctccttca

SEQ ID NO: 159171 - DNA, 22 bp, Artificial Sequence
  chemically synthesized
aaagcctccttcacatcctccc

SEQ ID NO: 159172 - DNA, 22 bp, Artificial Sequence
  chemically synthesized
cttcacatcctccccttgtatc

SEQ ID NO: 159173 - DNA, 22 bp, Artificial Sequence
  chemically synthesized
cacatcctccccttgtatctcc

SEQ ID NO: 159174 - DNA, 22 bp, Artificial Sequence
  chemically synthesized
acatcctccccttgtatctccc

SEQ ID NO: 159175 - DNA, 22 bp, Artificial Sequence
  chemically synthesized
cccttgtatctccccaccttaa

SEQ ID NO: 159176 - DNA, 22 bp, Artificial Sequence
  chemically synthesized
gtatctccccaccttaatccac

SEQ ID NO: 159177 - DNA, 22 bp, Artificial Sequence
  chemically synthesized
tatctccccaccttaatccaca

SEQ ID NO: 159178 - DNA, 22 bp, Artificial Sequence
  chemically synthesized
cccaccttaatccacaagtata

SEQ ID NO: 159179 - DNA, 22 bp, Artificial Sequence
  chemically synthesized
aatccacaagtataagacacct

SEQ ID NO: 159180 - DNA, 22 bp, Artificial Sequence
  chemically synthesized
atccacaagtataagacacctc

SEQ ID NO: 159181 - DNA, 22 bp, Artificial Sequence
  chemically synthesized
tacttcctccttcgcgaccgat

SEQ ID NO: 159182 - DNA, 22 bp, Artificial Sequence
  chemically synthesized
cttcctccttcgcgaccgatca

SEQ ID NO: 159183 - DNA, 22 bp, Artificial Sequence
  chemically synthesized
cctccttcgcgaccgatcatgc

SEQ ID NO: 159184 - DNA, 22 bp, Artificial Sequence
  chemically synthesized
ctccttcgcgaccgatcatgcg

SEQ ID NO: 159185 - DNA, 22 bp, Artificial Sequence
  chemically synthesized
cttcgcgaccgatcatgcgccc

SEQ ID NO: 159186 - DNA, 22 bp, Artificial Sequence
  chemically synthesized
cgcgaccgatcatgcgcccctt

SEQ ID NO: 159187 - DNA, 22 bp, Artificial Sequence
  chemically synthesized
gcgaccgatcatgcgcccctta

SEQ ID NO: 159188 - DNA, 22 bp, Artificial Sequence
  chemically synthesized
accatcccattaaaacctaatc

SEQ ID NO: 159189 - DNA, 22 bp, Artificial Sequence
  chemically synthesized
ccatcccattaaaacctaatca

SEQ ID NO: 159190 - DNA, 22 bp, Artificial Sequence
  chemically synthesized
aaacctaatcactcttaccccg

SEQ ID NO: 159191 - DNA, 22 bp, Artificial Sequence
  chemically synthesized
atcactcttaccccgctcaatg

SEQ ID NO: 159192 - DNA, 22 bp, Artificial Sequence
  chemically synthesized
ttaccccgctcaatgccagtat

SEQ ID NO: 159193 - DNA, 22 bp, Artificial Sequence
  chemically synthesized
accccgctcaatgccagtatcc

SEQ ID NO: 159194 - DNA, 22 bp, Artificial Sequence
  chemically synthesized
ccccgctcaatgccagtatccc

SEQ ID NO: 159195 - DNA, 22 bp, Artificial Sequence
  chemically synthesized
aatgccagtatcccatcccaca

SEQ ID NO: 159196 - DNA, 22 bp, Artificial Sequence
  chemically synthesized
tgaaaggattaaagcctgttat

SEQ ID NO: 159197 - DNA, 22 bp, Artificial Sequence
  chemically synthesized
gaaaggattaaagcctgttatt

SEQ ID NO: 159198 - DNA, 22 bp, Artificial Sequence
  chemically synthesized
aaaggattaaagcctgttatta

SEQ ID NO: 159199 - DNA, 22 bp, Artificial Sequence
  chemically synthesized
aagcctgttattacttgcctgt

SEQ ID NO: 159200 - DNA, 22 bp, Artificial Sequence
  chemically synthesized
ttattacttgcctgttacagca

SEQ ID NO: 159201 - DNA, 22 bp, Artificial Sequence
  chemically synthesized
ttacttgcctgttacagcatgg

SEQ ID NO: 159202 - DNA, 22 bp, Artificial Sequence
  chemically synthesized
cttgcctgttacagcatggcct

SEQ ID NO: 159203 - DNA, 22 bp, Artificial Sequence
  chemically synthesized
gcctgttacagcatggcctttt

SEQ ID NO: 159204 - DNA, 22 bp, Artificial Sequence
  chemically synthesized
cctgttacagcatggcctttta

SEQ ID NO: 159205 - DNA, 22 bp, Artificial Sequence
  chemically synthesized
ttacagcatggccttttaaagc

SEQ ID NO: 159206 - DNA, 22 bp, Artificial Sequence
  chemically synthesized
cagcatggccttttaaagccta

SEQ ID NO: 159207 - DNA, 22 bp, Artificial Sequence
  chemically synthesized
ttaaagcctataaactctcctt

SEQ ID NO: 159208 - DNA, 22 bp, Artificial Sequence
  chemically synthesized
taaagcctataaactctcctta

SEQ ID NO: 159209 - DNA, 22 bp, Artificial Sequence
  chemically synthesized
aaagcctataaactctccttac

SEQ ID NO: 159210 - DNA, 22 bp, Artificial Sequence
  chemically synthesized
aagcctataaactctccttacc

SEQ ID NO: 159211 - DNA, 22 bp, Artificial Sequence
  chemically synthesized
taaactctccttaccattcccc

SEQ ID NO: 159212 - DNA, 22 bp, Artificial Sequence
  chemically synthesized
tccttaccattcccccatttta

SEQ ID NO: 159213 - DNA, 22 bp, Artificial Sequence
  chemically synthesized
cttaccattcccccattttacc

SEQ ID NO: 159214 - DNA, 22 bp, Artificial Sequence
  chemically synthesized
accattcccccattttacctgt

SEQ ID NO: 159215 - DNA, 22 bp, Artificial Sequence
  chemically synthesized
ccattcccccattttacctgtc

SEQ ID NO: 159216 - DNA, 22 bp, Artificial Sequence
  chemically synthesized
ccccattttacctgtcctaaaa

SEQ ID NO: 159217 - DNA, 22 bp, Artificial Sequence
  chemically synthesized
tacctgtcctaaaaccagacaa

SEQ ID NO: 159218 - DNA, 22 bp, Artificial Sequence
  chemically synthesized
acctgtcctaaaaccagacaag

SEQ ID NO: 159219 - DNA, 22 bp, Artificial Sequence
  chemically synthesized
cctgtcctaaaaccagacaagc

SEQ ID NO: 159220 - DNA, 22 bp, Artificial Sequence
  chemically synthesized
tcctaaaaccagacaagcctta

SEQ ID NO: 159221 - DNA, 22 bp, Artificial Sequence
  chemically synthesized
aaaccagacaagccttacaggt

SEQ ID NO: 159222 - DNA, 22 bp, Artificial Sequence
  chemically synthesized
acaggttagttcagaatctgca

SEQ ID NO: 159223 - DNA, 22 bp, Artificial Sequence
  chemically synthesized
caggttagttcagaatctgcat

SEQ ID NO: 159224 - DNA, 22 bp, Artificial Sequence
  chemically synthesized
gttcagaatctgcatcttatca

SEQ ID NO: 159225 - DNA, 22 bp, Artificial Sequence
  chemically synthesized
agaatctgcatcttatcaacca

SEQ ID NO: 159226 - DNA, 22 bp, Artificial Sequence
  chemically synthesized
catcttatcaaccaaattgttt

SEQ ID NO: 159227 - DNA, 22 bp, Artificial Sequence
  chemically synthesized
atcaaccaaattgttttgccta

SEQ ID NO: 159228 - DNA, 22 bp, Artificial Sequence
  chemically synthesized
tcaaccaaattgttttgcctat

SEQ ID NO: 159229 - DNA, 22 bp, Artificial Sequence
  chemically synthesized
ttttgcctatccaccccatggt

SEQ ID NO: 159230 - DNA, 22 bp, Artificial Sequence
  chemically synthesized
tgcctatccaccccatggtgcc

SEQ ID NO: 159231 - DNA, 22 bp, Artificial Sequence
  chemically synthesized
gcctatccaccccatggtgcca

SEQ ID NO: 159232 - DNA, 22 bp, Artificial Sequence
  chemically synthesized
cctatccaccccatggtgccaa

SEQ ID NO: 159233 - DNA, 22 bp, Artificial Sequence
  chemically synthesized
tccaccccatggtgccaaaccc

SEQ ID NO: 159234 - DNA, 22 bp, Artificial Sequence
  chemically synthesized
tcctatcctcaatacctccatc

SEQ ID NO: 159235 - DNA, 22 bp, Artificial Sequence
  chemically synthesized
ctatcctcaatacctccatcta

SEQ ID NO: 159236 - DNA, 22 bp, Artificial Sequence
  chemically synthesized
tcctcaatacctccatctataa

SEQ ID NO: 159237 - DNA, 22 bp, Artificial Sequence
  chemically synthesized
aatacctccatctataacccat

SEQ ID NO: 159238 - DNA, 22 bp, Artificial Sequence
  chemically synthesized
catctataacccattattctgt

SEQ ID NO: 159239 - DNA, 22 bp, Artificial Sequence
  chemically synthesized
taacccattattctgttctgga

SEQ ID NO: 159240 - DNA, 22 bp, Artificial Sequence
  chemically synthesized
ttctgttctggatctcaaacat

SEQ ID NO: 159241 - DNA, 22 bp, Artificial Sequence
  chemically synthesized
tgttctggatctcaaacatgct

SEQ ID NO: 159242 - DNA, 22 bp, Artificial Sequence
  chemically synthesized
ttctggatctcaaacatgcttt

SEQ ID NO: 159243 - DNA, 22 bp, Artificial Sequence
  chemically synthesized
tggatctcaaacatgctttctt

SEQ ID NO: 159244 - DNA, 22 bp, Artificial Sequence
  chemically synthesized
gatctcaaacatgctttcttta

SEQ ID NO: 159245 - DNA, 22 bp, Artificial Sequence
  chemically synthesized
aaacatgctttctttactattc

SEQ ID NO: 159246 - DNA, 22 bp, Artificial Sequence
  chemically synthesized
tctttactattcctttgcaccc

SEQ ID NO: 159247 - DNA, 22 bp, Artificial Sequence
  chemically synthesized
ctttactattcctttgcaccct

SEQ ID NO: 159248 - DNA, 22 bp, Artificial Sequence
  chemically synthesized
tttactattcctttgcaccctt

SEQ ID NO: 159249 - DNA, 22 bp, Artificial Sequence
  chemically synthesized
tactattcctttgcacccttca

SEQ ID NO: 159250 - DNA, 22 bp, Artificial Sequence
  chemically synthesized
actattcctttgcacccttcat

SEQ ID NO: 159251 - DNA, 22 bp, Artificial Sequence
  chemically synthesized
ctattcctttgcacccttcatt

SEQ ID NO: 159252 - DNA, 22 bp, Artificial Sequence
  chemically synthesized
ttcctttgcacccttcattcca

SEQ ID NO: 159253 - DNA, 22 bp, Artificial Sequence
  chemically synthesized
ctttgcacccttcattccagcc

SEQ ID NO: 159254 - DNA, 22 bp, Artificial Sequence
  chemically synthesized
tgcacccttcattccagcctct

SEQ ID NO: 159255 - DNA, 22 bp, Artificial Sequence
  chemically synthesized
gcacccttcattccagcctctc

SEQ ID NO: 159256 - DNA, 22 bp, Artificial Sequence
  chemically synthesized
cacccttcattccagcctctct

SEQ ID NO: 159257 - DNA, 22 bp, Artificial Sequence
  chemically synthesized
cattccagcctctcttcgcttt

SEQ ID NO: 159258 - DNA, 22 bp, Artificial Sequence
  chemically synthesized
attccagcctctcttcgctttc

SEQ ID NO: 159259 - DNA, 22 bp, Artificial Sequence
  chemically synthesized
cagcctctcttcgctttcactt

SEQ ID NO: 159260 - DNA, 22 bp, Artificial Sequence
  chemically synthesized
tcttcgctttcacttggactga

SEQ ID NO: 159261 - DNA, 22 bp, Artificial Sequence
  chemically synthesized
ttcgctttcacttggactgaca

SEQ ID NO: 159262 - DNA, 22 bp, Artificial Sequence
  chemically synthesized
cgctttcacttggactgacact

SEQ ID NO: 159263 - DNA, 22 bp, Artificial Sequence
  chemically synthesized
gctttcacttggactgacactg

SEQ ID NO: 159264 - DNA, 22 bp, Artificial Sequence
  chemically synthesized
tcacttggactgacactgacac

SEQ ID NO: 159265 - DNA, 22 bp, Artificial Sequence
  chemically synthesized
cacttggactgacactgacacc

SEQ ID NO: 159266 - DNA, 22 bp, Artificial Sequence
  chemically synthesized
acttggactgacactgacaccc

SEQ ID NO: 159267 - DNA, 22 bp, Artificial Sequence
  chemically synthesized
ggactgacactgacacccatta

SEQ ID NO: 159268 - DNA, 22 bp, Artificial Sequence
  chemically synthesized
gactgacactgacacccattag

SEQ ID NO: 159269 - DNA, 22 bp, Artificial Sequence
  chemically synthesized
acactgacacccattaggctca

SEQ ID NO: 159270 - DNA, 22 bp, Artificial Sequence
  chemically synthesized
acacccattaggctcagcaaat

SEQ ID NO: 159271 - DNA, 22 bp, Artificial Sequence
  chemically synthesized
ggctcagcaaattacctgggct

SEQ ID NO: 159272 - DNA, 22 bp, Artificial Sequence
  chemically synthesized
agcaaattacctgggctgtact

SEQ ID NO: 159273 - DNA, 22 bp, Artificial Sequence
  chemically synthesized
cctgggctgtactgctgcaagg

SEQ ID NO: 159274 - DNA, 22 bp, Artificial Sequence
  chemically synthesized
ggctgtactgctgcaaggcttc

SEQ ID NO: 159275 - DNA, 22 bp, Artificial Sequence
  chemically synthesized
tactgctgcaaggcttcacaga

SEQ ID NO: 159276 - DNA, 22 bp, Artificial Sequence
  chemically synthesized
ctgcaaggcttcacagacagac

SEQ ID NO: 159277 - DNA, 22 bp, Artificial Sequence
  chemically synthesized
caaggcttcacagacagacccc

SEQ ID NO: 159278 - DNA, 22 bp, Artificial Sequence
  chemically synthesized
cacagacagaccccattacttc

SEQ ID NO: 159279 - DNA, 22 bp, Artificial Sequence
  chemically synthesized
acagacagaccccattacttca

SEQ ID NO: 159280 - DNA, 22 bp, Artificial Sequence
  chemically synthesized
cttcagtcaagcccaaatttca

SEQ ID NO: 159281 - DNA, 22 bp, Artificial Sequence
  chemically synthesized
cagtcaagcccaaatttcatcc

SEQ ID NO: 159282 - DNA, 22 bp, Artificial Sequence
  chemically synthesized
agtcaagcccaaatttcatcct

SEQ ID NO: 159283 - DNA, 22 bp, Artificial Sequence
  chemically synthesized
catcctcatgtgttacctatct

SEQ ID NO: 159284 - DNA, 22 bp, Artificial Sequence
  chemically synthesized
atcctcatgtgttacctatctc

SEQ ID NO: 159285 - DNA, 22 bp, Artificial Sequence
  chemically synthesized
atgtgttacctatctcggcata

SEQ ID NO: 159286 - DNA, 22 bp, Artificial Sequence
  chemically synthesized
cctatctcggcataattctcat

SEQ ID NO: 159287 - DNA, 22 bp, Artificial Sequence
  chemically synthesized
tctcggcataattctcataaaa

SEQ ID NO: 159288 - DNA, 22 bp, Artificial Sequence
  chemically synthesized
ggcataattctcataaaaacac

SEQ ID NO: 159289 - DNA, 22 bp, Artificial Sequence
  chemically synthesized
tcataaaaacacacgtgctctc

SEQ ID NO: 159290 - DNA, 22 bp, Artificial Sequence
  chemically synthesized
ataaaaacacacgtgctctccc

SEQ ID NO: 159291 - DNA, 22 bp, Artificial Sequence
  chemically synthesized
tccctgctgattgtgtccgatt

SEQ ID NO: 159292 - DNA, 22 bp, Artificial Sequence
  chemically synthesized
cctgctgattgtgtccgattaa

SEQ ID NO: 159293 - DNA, 22 bp, Artificial Sequence
  chemically synthesized
ctgattgtgtccgattaatctc

SEQ ID NO: 159294 - DNA, 22 bp, Artificial Sequence
  chemically synthesized
attgtgtccgattaatctccca

SEQ ID NO: 159295 - DNA, 22 bp, Artificial Sequence
  chemically synthesized
tgtccgattaatctcccaaacc

SEQ ID NO: 159296 - DNA, 22 bp, Artificial Sequence
  chemically synthesized
atctcccaaacctcaatccctt

SEQ ID NO: 159297 - DNA, 22 bp, Artificial Sequence
  chemically synthesized
ccaaacctcaatcccttctaca

SEQ ID NO: 159298 - DNA, 22 bp, Artificial Sequence
  chemically synthesized
aatcccttctacaaaacaacaa

SEQ ID NO: 159299 - DNA, 22 bp, Artificial Sequence
  chemically synthesized
ctacaaaacaacaactcctttc

SEQ ID NO: 159300 - DNA, 22 bp, Artificial Sequence
  chemically synthesized
tacaaaacaacaactcctttcc

SEQ ID NO: 159301 - DNA, 22 bp, Artificial Sequence
  chemically synthesized
caaaacaacaactcctttcctt

SEQ ID NO: 159302 - DNA, 22 bp, Artificial Sequence
  chemically synthesized
ctttccttcctaggcatagtta

SEQ ID NO: 159303 - DNA, 22 bp, Artificial Sequence
  chemically synthesized
tccttcctaggcatagttagtg

SEQ ID NO: 159304 - DNA, 22 bp, Artificial Sequence
  chemically synthesized
ccttcctaggcatagttagtgc

SEQ ID NO: 159305 - DNA, 22 bp, Artificial Sequence
  chemically synthesized
cttcctaggcatagttagtgcg

SEQ ID NO: 159306 - DNA, 22 bp, Artificial Sequence
  chemically synthesized
cctaggcatagttagtgcggtc

SEQ ID NO: 159307 - DNA, 22 bp, Artificial Sequence
  chemically synthesized
ctaggcatagttagtgcggtca

SEQ ID NO: 159308 - DNA, 22 bp, Artificial Sequence
  chemically synthesized
ggcatagttagtgcggtcagaa

SEQ ID NO: 159309 - DNA, 22 bp, Artificial Sequence
  chemically synthesized
gtgcggtcagaattcttacaca

SEQ ID NO: 159310 - DNA, 22 bp, Artificial Sequence
  chemically synthesized
ttacacaagatccaggactgca

SEQ ID NO: 159311 - DNA, 22 bp, Artificial Sequence
  chemically synthesized
acacaagatccaggactgcacc

SEQ ID NO: 159312 - DNA, 22 bp, Artificial Sequence
  chemically synthesized
cacaagatccaggactgcaccc

SEQ ID NO: 159313 - DNA, 22 bp, Artificial Sequence
  chemically synthesized
caccctgtagcctttctgtcca

SEQ ID NO: 159314 - DNA, 22 bp, Artificial Sequence
  chemically synthesized
tagcctttctgtccaaataact

SEQ ID NO: 159315 - DNA, 22 bp, Artificial Sequence
  chemically synthesized
tctgtccaaataacttgacctt

SEQ ID NO: 159316 - DNA, 22 bp, Artificial Sequence
  chemically synthesized
ctgtccaaataacttgacctta

SEQ ID NO: 159317 - DNA, 22 bp, Artificial Sequence
  chemically synthesized
tgtccaaataacttgaccttac

SEQ ID NO: 159318 - DNA, 22 bp, Artificial Sequence
  chemically synthesized
tccaaataacttgaccttactg

SEQ ID NO: 159319 - DNA, 22 bp, Artificial Sequence
  chemically synthesized
gaccttactgttttagcctagc

SEQ ID NO: 159320 - DNA, 22 bp, Artificial Sequence
  chemically synthesized
accttactgttttagcctagcc

SEQ ID NO: 159321 - DNA, 22 bp, Artificial Sequence
  chemically synthesized
actgttttagcctagccctcag

SEQ ID NO: 159322 - DNA, 22 bp, Artificial Sequence
  chemically synthesized
ctgttttagcctagccctcagg

SEQ ID NO: 159323 - DNA, 22 bp, Artificial Sequence
  chemically synthesized
ttttagcctagccctcaggtct

SEQ ID NO: 159324 - DNA, 22 bp, Artificial Sequence
  chemically synthesized
tagcctagccctcaggtctgca

SEQ ID NO: 159325 - DNA, 22 bp, Artificial Sequence
  chemically synthesized
agcctagccctcaggtctgcat

SEQ ID NO: 159326 - DNA, 22 bp, Artificial Sequence
  chemically synthesized
gcctagccctcaggtctgcatg

SEQ ID NO: 159327 - DNA, 22 bp, Artificial Sequence
  chemically synthesized
gccctcaggtctgcatgcagtg

SEQ ID NO: 159328 - DNA, 22 bp, Artificial Sequence
  chemically synthesized
aggtctgcatgcagtggctgcc

SEQ ID NO: 159329 - DNA, 22 bp, Artificial Sequence
  chemically synthesized
catgcagtggctgccgctgctt

SEQ ID NO: 159330 - DNA, 22 bp, Artificial Sequence
  chemically synthesized
ccgctgctttaatacttttaga

SEQ ID NO: 159331 - DNA, 22 bp, Artificial Sequence
  chemically synthesized
ctttaatacttttagaggccct

SEQ ID NO: 159332 - DNA, 22 bp, Artificial Sequence
  chemically synthesized
taatacttttagaggccctaaa

SEQ ID NO: 159333 - DNA, 22 bp, Artificial Sequence
  chemically synthesized
aatacttttagaggccctaaaa

SEQ ID NO: 159334 - DNA, 22 bp, Artificial Sequence
  chemically synthesized
atacttttagaggccctaaaaa

SEQ ID NO: 159335 - DNA, 22 bp, Artificial Sequence
  chemically synthesized
ttagaggccctaaaaatcacaa

SEQ ID NO: 159336 - DNA, 22 bp, Artificial Sequence
  chemically synthesized
tagaggccctaaaaatcacaaa

SEQ ID NO: 159337 - DNA, 22 bp, Artificial Sequence
  chemically synthesized
agaggccctaaaaatcacaaac

SEQ ID NO: 159338 - DNA, 22 bp, Artificial Sequence
  chemically synthesized
gaggccctaaaaatcacaaact

SEQ ID NO: 159339 - DNA, 22 bp, Artificial Sequence
  chemically synthesized
aaaatcacaaactatgcttagc

SEQ ID NO: 159340 - DNA, 22 bp, Artificial Sequence
  chemically synthesized
tgcttagctcactcttcacatt

SEQ ID NO: 159341 - DNA, 22 bp, Artificial Sequence
  chemically synthesized
agctcactcttcacatttctca

SEQ ID NO: 159342 - DNA, 22 bp, Artificial Sequence
  chemically synthesized
gctcactcttcacatttctcat

SEQ ID NO: 159343 - DNA, 22 bp, Artificial Sequence
  chemically synthesized
actcttcacatttctcataact

SEQ ID NO: 159344 - DNA, 22 bp, Artificial Sequence
  chemically synthesized
ttcacatttctcataacttcta

SEQ ID NO: 159345 - DNA, 22 bp, Artificial Sequence
  chemically synthesized
cacatttctcataacttctaaa

SEQ ID NO: 159346 - DNA, 22 bp, Artificial Sequence
  chemically synthesized
acatttctcataacttctaaaa

SEQ ID NO: 159347 - DNA, 22 bp, Artificial Sequence
  chemically synthesized
ctcataacttctaaaatctatt

SEQ ID NO: 159348 - DNA, 22 bp, Artificial Sequence
  chemically synthesized
tcataacttctaaaatctattt

SEQ ID NO: 159349 - DNA, 22 bp, Artificial Sequence
  chemically synthesized
ataacttctaaaatctattttc

SEQ ID NO: 159350 - DNA, 22 bp, Artificial Sequence
  chemically synthesized
ctaaaatctattttcttcctca

SEQ ID NO: 159351 - DNA, 22 bp, Artificial Sequence
  chemically synthesized
taaaatctattttcttcctcat

SEQ ID NO: 159352 - DNA, 22 bp, Artificial Sequence
  chemically synthesized
aaatctattttcttcctcatac

SEQ ID NO: 159353 - DNA, 22 bp, Artificial Sequence
  chemically synthesized
ttttcttcctcatacctgatgc

SEQ ID NO: 159354 - DNA, 22 bp, Artificial Sequence
  chemically synthesized
tcttcctcatacctgatgcata

SEQ ID NO: 159355 - DNA, 22 bp, Artificial Sequence
  chemically synthesized
cttcctcatacctgatgcatat

SEQ ID NO: 159356 - DNA, 22 bp, Artificial Sequence
  chemically synthesized
ttcctcatacctgatgcatata

SEQ ID NO: 159357 - DNA, 22 bp, Artificial Sequence
  chemically synthesized
cctcatacctgatgcatatact

SEQ ID NO: 159358 - DNA, 22 bp, Artificial Sequence
  chemically synthesized
ctcatacctgatgcatatactt

SEQ ID NO: 159359 - DNA, 22 bp, Artificial Sequence
  chemically synthesized
atacctgatgcatatactttct

SEQ ID NO: 159360 - DNA, 22 bp, Artificial Sequence
  chemically synthesized
atgcatatactttctgatcccc

SEQ ID NO: 159361 - DNA, 22 bp, Artificial Sequence
  chemically synthesized
tctgatccccggctccttcagc

SEQ ID NO: 159362 - DNA, 22 bp, Artificial Sequence
  chemically synthesized
ctgatccccggctccttcagct

SEQ ID NO: 159363 - DNA, 22 bp, Artificial Sequence
  chemically synthesized
tgatccccggctccttcagctg

SEQ ID NO: 159364 - DNA, 22 bp, Artificial Sequence
  chemically synthesized
atccccggctccttcagctgta

SEQ ID NO: 159365 - DNA, 22 bp, Artificial Sequence
  chemically synthesized
cttcagctgtactcactctttg

SEQ ID NO: 159366 - DNA, 22 bp, Artificial Sequence
  chemically synthesized
cagctgtactcactctttgtta

SEQ ID NO: 159367 - DNA, 22 bp, Artificial Sequence
  chemically synthesized
agctgtactcactctttgttaa

SEQ ID NO: 159368 - DNA, 22 bp, Artificial Sequence
  chemically synthesized
tactcactctttgttaagtccc

SEQ ID NO: 159369 - DNA, 22 bp, Artificial Sequence
  chemically synthesized
actctttgttaagtcccacaat

SEQ ID NO: 159370 - DNA, 22 bp, Artificial Sequence
  chemically synthesized
tttgttaagtcccacaattacc

SEQ ID NO: 159371 - DNA, 22 bp, Artificial Sequence
  chemically synthesized
tgttaagtcccacaattaccat

SEQ ID NO: 159372 - DNA, 22 bp, Artificial Sequence
  chemically synthesized
gttaagtcccacaattaccatt

SEQ ID NO: 159373 - DNA, 22 bp, Artificial Sequence
  chemically synthesized
ttaagtcccacaattaccattg

SEQ ID NO: 159374 - DNA, 22 bp, Artificial Sequence
  chemically synthesized
agtcccacaattaccattggtc

SEQ ID NO: 159375 - DNA, 22 bp, Artificial Sequence
  chemically synthesized
ccattggtcctggcccggactt

SEQ ID NO: 159376 - DNA, 22 bp, Artificial Sequence
  chemically synthesized
gtcctggcccggacttcaatcc

SEQ ID NO: 159377 - DNA, 22 bp, Artificial Sequence
  chemically synthesized
gcccggacttcaatccggcctc

SEQ ID NO: 159378 - DNA, 22 bp, Artificial Sequence
  chemically synthesized
caatccggcctcccacattatt

SEQ ID NO: 159379 - DNA, 22 bp, Artificial Sequence
  chemically synthesized
aatccggcctcccacattattc

SEQ ID NO: 159380 - DNA, 22 bp, Artificial Sequence
  chemically synthesized
ccacattattcctgataccaca

SEQ ID NO: 159381 - DNA, 22 bp, Artificial Sequence
  chemically synthesized
ttcctgataccacacctgaccc

SEQ ID NO: 159382 - DNA, 22 bp, Artificial Sequence
  chemically synthesized
ctgataccacacctgaccccca

SEQ ID NO: 159383 - DNA, 22 bp, Artificial Sequence
  chemically synthesized
ataccacacctgacccccatga

SEQ ID NO: 159384 - DNA, 22 bp, Artificial Sequence
  chemically synthesized
acccccatgattgtatctctct

SEQ ID NO: 159385 - DNA, 22 bp, Artificial Sequence
  chemically synthesized
tatctctctgatccacctgaca

SEQ ID NO: 159386 - DNA, 22 bp, Artificial Sequence
  chemically synthesized
tctgatccacctgacattcacc

SEQ ID NO: 159387 - DNA, 22 bp, Artificial Sequence
  chemically synthesized
tgatccacctgacattcacccc

SEQ ID NO: 159388 - DNA, 22 bp, Artificial Sequence
  chemically synthesized
atccacctgacattcaccccat

SEQ ID NO: 159389 - DNA, 22 bp, Artificial Sequence
  chemically synthesized
acattcaccccatttccccata

SEQ ID NO: 159390 - DNA, 22 bp, Artificial Sequence
  chemically synthesized
accccatttccccatatttcct

SEQ ID NO: 159391 - DNA, 22 bp, Artificial Sequence
  chemically synthesized
ccccatatttccttctttcctt

SEQ ID NO: 159392 - DNA, 22 bp, Artificial Sequence
  chemically synthesized
cccatatttccttctttccttc

SEQ ID NO: 159393 - DNA, 22 bp, Artificial Sequence
  chemically synthesized
ccttctttccttctttcctgtt

SEQ ID NO: 159394 - DNA, 22 bp, Artificial Sequence
  chemically synthesized
cttctttccttctttcctgttc

SEQ ID NO: 159395 - DNA, 22 bp, Artificial Sequence
  chemically synthesized
ctttccttctttcctgttcctc

SEQ ID NO: 159396 - DNA, 22 bp, Artificial Sequence
  chemically synthesized
tttccttctttcctgttcctca

SEQ ID NO: 159397 - DNA, 22 bp, Artificial Sequence
  chemically synthesized
tccttctttcctgttcctcacc

SEQ ID NO: 159398 - DNA, 22 bp, Artificial Sequence
  chemically synthesized
ccttctttcctgttcctcaccc

SEQ ID NO: 159399 - DNA, 22 bp, Artificial Sequence
  chemically synthesized
cttctttcctgttcctcaccct

SEQ ID NO: 159400 - DNA, 22 bp, Artificial Sequence
  chemically synthesized
ctttcctgttcctcaccctgat

SEQ ID NO: 159401 - DNA, 22 bp, Artificial Sequence
  chemically synthesized
tttcctgttcctcaccctgatc

SEQ ID NO: 159402 - DNA, 22 bp, Artificial Sequence
  chemically synthesized
tcctgttcctcaccctgatcac

SEQ ID NO: 159403 - DNA, 22 bp, Artificial Sequence
  chemically synthesized
cctgttcctcaccctgatcaca

SEQ ID NO: 159404 - DNA, 22 bp, Artificial Sequence
  chemically synthesized
ctgttcctcaccctgatcacac

SEQ ID NO: 159405 - DNA, 22 bp, Artificial Sequence
  chemically synthesized
ttcctcaccctgatcacacttg

SEQ ID NO: 159406 - DNA, 22 bp, Artificial Sequence
  chemically synthesized
ctcaccctgatcacacttgatt

SEQ ID NO: 159407 - DNA, 22 bp, Artificial Sequence
  chemically synthesized
accctgatcacacttgatttat

SEQ ID NO: 159408 - DNA, 22 bp, Artificial Sequence
  chemically synthesized
atcacacttgatttattgatgg

SEQ ID NO: 159409 - DNA, 22 bp, Artificial Sequence
  chemically synthesized
gatttattgatggccgttccac

SEQ ID NO: 159410 - DNA, 22 bp, Artificial Sequence
  chemically synthesized
atttattgatggccgttccacc

SEQ ID NO: 159411 - DNA, 22 bp, Artificial Sequence
  chemically synthesized
attgatggccgttccaccaggc

SEQ ID NO: 159412 - DNA, 22 bp, Artificial Sequence
  chemically synthesized
ttgatggccgttccaccaggcc

SEQ ID NO: 159413 - DNA, 22 bp, Artificial Sequence
  chemically synthesized
atggccgttccaccaggcctaa

SEQ ID NO: 159414 - DNA, 22 bp, Artificial Sequence
  chemically synthesized
caccaggcctaatagccacaca

SEQ ID NO: 159415 - DNA, 22 bp, Artificial Sequence
  chemically synthesized
atagccacacaccagcaaaggc

SEQ ID NO: 159416 - DNA, 22 bp, Artificial Sequence
  chemically synthesized
tgctatagtacaaaccactagc

SEQ ID NO: 159417 - DNA, 22 bp, Artificial Sequence
  chemically synthesized
tagtacaaaccactagcctgcc

SEQ ID NO: 159418 - DNA, 22 bp, Artificial Sequence
  chemically synthesized
gcctgcctcttcgaacctctca

SEQ ID NO: 159419 - DNA, 22 bp, Artificial Sequence
  chemically synthesized
cctcttcgaacctctcatttcc

SEQ ID NO: 159420 - DNA, 22 bp, Artificial Sequence
  chemically synthesized
ttcgaacctctcatttcctttc

SEQ ID NO: 159421 - DNA, 22 bp, Artificial Sequence
  chemically synthesized
cgaacctctcatttcctttcca

SEQ ID NO: 159422 - DNA, 22 bp, Artificial Sequence
  chemically synthesized
gaacctctcatttcctttccat

SEQ ID NO: 159423 - DNA, 22 bp, Artificial Sequence
  chemically synthesized
tcatttcctttccatcgtagaa

SEQ ID NO: 159424 - DNA, 22 bp, Artificial Sequence
  chemically synthesized
atttcctttccatcgtagaaat

SEQ ID NO: 159425 - DNA, 22 bp, Artificial Sequence
  chemically synthesized
cctttccatcgtagaaatctat

SEQ ID NO: 159426 - DNA, 22 bp, Artificial Sequence
  chemically synthesized
ctttccatcgtagaaatctatc

SEQ ID NO: 159427 - DNA, 22 bp, Artificial Sequence
  chemically synthesized
tccatcgtagaaatctatcctc

SEQ ID NO: 159428 - DNA, 22 bp, Artificial Sequence
  chemically synthesized
ccatcgtagaaatctatcctca

SEQ ID NO: 159429 - DNA, 22 bp, Artificial Sequence
  chemically synthesized
catcgtagaaatctatcctcaa

SEQ ID NO: 159430 - DNA, 22 bp, Artificial Sequence
  chemically synthesized
tcctcaaagaaataacttctca

SEQ ID NO: 159431 - DNA, 22 bp, Artificial Sequence
  chemically synthesized
aaagaaataacttctcagtgtt

SEQ ID NO: 159432 - DNA, 22 bp, Artificial Sequence
  chemically synthesized
ctcagtgttccatctgctattc

SEQ ID NO: 159433 - DNA, 22 bp, Artificial Sequence
  chemically synthesized
tcagtgttccatctgctattct

SEQ ID NO: 159434 - DNA, 22 bp, Artificial Sequence
  chemically synthesized
agtgttccatctgctattctgc

SEQ ID NO: 159435 - DNA, 22 bp, Artificial Sequence
  chemically synthesized
catctgctattctgctactcct

SEQ ID NO: 159436 - DNA, 22 bp, Artificial Sequence
  chemically synthesized
ctattctgctactcctcaggga

SEQ ID NO: 159437 - DNA, 22 bp, Artificial Sequence
  chemically synthesized
ttctgctactcctcagggatta

SEQ ID NO: 159438 - DNA, 22 bp, Artificial Sequence
  chemically synthesized
tgctactcctcagggattattc

SEQ ID NO: 159439 - DNA, 22 bp, Artificial Sequence
  chemically synthesized
ctactcctcagggattattcag

SEQ ID NO: 159440 - DNA, 22 bp, Artificial Sequence
  chemically synthesized
ctcctcagggattattcaggcc

SEQ ID NO: 159441 - DNA, 22 bp, Artificial Sequence
  chemically synthesized
ctcagggattattcaggccccc

SEQ ID NO: 159442 - DNA, 22 bp, Artificial Sequence
  chemically synthesized
agggattattcaggccccctcc

SEQ ID NO: 159443 - DNA, 22 bp, Artificial Sequence
  chemically synthesized
ttcaggccccctcccttcccta

SEQ ID NO: 159444 - DNA, 22 bp, Artificial Sequence
  chemically synthesized
aggccccctcccttccctacac

SEQ ID NO: 159445 - DNA, 22 bp, Artificial Sequence
  chemically synthesized
ccttccctacacatcaagctcg

SEQ ID NO: 159446 - DNA, 22 bp, Artificial Sequence
  chemically synthesized
ccctacacatcaagctcgagga

SEQ ID NO: 159447 - DNA, 22 bp, Artificial Sequence
  chemically synthesized
cctacacatcaagctcgaggat

SEQ ID NO: 159448 - DNA, 22 bp, Artificial Sequence
  chemically synthesized
cacatcaagctcgaggatttgc

SEQ ID NO: 159449 - DNA, 22 bp, Artificial Sequence
  chemically synthesized
gaggatttgcccccacccagga

SEQ ID NO: 159450 - DNA, 22 bp, Artificial Sequence
  chemically synthesized
gcccccacccaggactggcaaa

SEQ ID NO: 159451 - DNA, 22 bp, Artificial Sequence
  chemically synthesized
cccccacccaggactggcaaat

SEQ ID NO: 159452 - DNA, 22 bp, Artificial Sequence
  chemically synthesized
gcaaattagatttactcaacat

SEQ ID NO: 159453 - DNA, 22 bp, Artificial Sequence
  chemically synthesized
gatttactcaacatgccctgag

SEQ ID NO: 159454 - DNA, 22 bp, Artificial Sequence
  chemically synthesized
actcaacatgccctgagtcaga

SEQ ID NO: 159455 - DNA, 22 bp, Artificial Sequence
  chemically synthesized
ctcaacatgccctgagtcagat

SEQ ID NO: 159456 - DNA, 22 bp, Artificial Sequence
  chemically synthesized
aacatgccctgagtcagataac

SEQ ID NO: 159457 - DNA, 22 bp, Artificial Sequence
  chemically synthesized
agtcagataactaaaatacctc

SEQ ID NO: 159458 - DNA, 22 bp, Artificial Sequence
  chemically synthesized
aaatacctcttagtctaggtag

SEQ ID NO: 159459 - DNA, 22 bp, Artificial Sequence
  chemically synthesized
ttagtctaggtagacactttca

SEQ ID NO: 159460 - DNA, 22 bp, Artificial Sequence
  chemically synthesized
agtctaggtagacactttcact

SEQ ID NO: 159461 - DNA, 22 bp, Artificial Sequence
  chemically synthesized
gtctaggtagacactttcactg

SEQ ID NO: 159462 - DNA, 22 bp, Artificial Sequence
  chemically synthesized
ggtagacactttcactggataa

SEQ ID NO: 159463 - DNA, 22 bp, Artificial Sequence
  chemically synthesized
tcactggataagtagaggtctt

SEQ ID NO: 159464 - DNA, 22 bp, Artificial Sequence
  chemically synthesized
cactggataagtagaggtcttt

SEQ ID NO: 159465 - DNA, 22 bp, Artificial Sequence
  chemically synthesized
actggataagtagaggtctttc

SEQ ID NO: 159466 - DNA, 22 bp, Artificial Sequence
  chemically synthesized
gataagtagaggtctttcctac

SEQ ID NO: 159467 - DNA, 22 bp, Artificial Sequence
  chemically synthesized
tcctacagggtctgagaaggcc

SEQ ID NO: 159468 - DNA, 22 bp, Artificial Sequence
  chemically synthesized
cctacagggtctgagaaggcca

SEQ ID NO: 159469 - DNA, 22 bp, Artificial Sequence
  chemically synthesized
ctacagggtctgagaaggccac

SEQ ID NO: 159470 - DNA, 22 bp, Artificial Sequence
  chemically synthesized
cagggtctgagaaggccaccgc

SEQ ID NO: 159471 - DNA, 22 bp, Artificial Sequence
  chemically synthesized
agaaggccaccgcagtcatttc

SEQ ID NO: 159472 - DNA, 22 bp, Artificial Sequence
  chemically synthesized
cttcccttctgtcagacataat

SEQ ID NO: 159473 - DNA, 22 bp, Artificial Sequence
  chemically synthesized
ttcccttctgtcagacataatt

SEQ ID NO: 159474 - DNA, 22 bp, Artificial Sequence
  chemically synthesized
cccttctgtcagacataattcc

SEQ ID NO: 159475 - DNA, 22 bp, Artificial Sequence
  chemically synthesized
ccttctgtcagacataattcct

SEQ ID NO: 159476 - DNA, 22 bp, Artificial Sequence
  chemically synthesized
ctgtcagacataattcctcagt

SEQ ID NO: 159477 - DNA, 22 bp, Artificial Sequence
  chemically synthesized
tgtcagacataattcctcagtt

SEQ ID NO: 159478 - DNA, 22 bp, Artificial Sequence
  chemically synthesized
tcagacataattcctcagttta

SEQ ID NO: 159479 - DNA, 22 bp, Artificial Sequence
  chemically synthesized
ctcagtttagccttcctacctc

SEQ ID NO: 159480 - DNA, 22 bp, Artificial Sequence
  chemically synthesized
agtttagccttcctacctctat

SEQ ID NO: 159481 - DNA, 22 bp, Artificial Sequence
  chemically synthesized
agccttcctacctctatacagt

SEQ ID NO: 159482 - DNA, 22 bp, Artificial Sequence
  chemically synthesized
gccttcctacctctatacagtc

SEQ ID NO: 159483 - DNA, 22 bp, Artificial Sequence
  chemically synthesized
cctacctctatacagtctgata

SEQ ID NO: 159484 - DNA, 22 bp, Artificial Sequence
  chemically synthesized
ctacctctatacagtctgataa

SEQ ID NO: 159485 - DNA, 22 bp, Artificial Sequence
  chemically synthesized
cctctatacagtctgataacag

SEQ ID NO: 159486 - DNA, 22 bp, Artificial Sequence
  chemically synthesized
tatacagtctgataacagacca

SEQ ID NO: 159487 - DNA, 22 bp, Artificial Sequence
  chemically synthesized
tacagtctgataacagaccagc

SEQ ID NO: 159488 - DNA, 22 bp, Artificial Sequence
  chemically synthesized
ataacagaccagcctttattag

SEQ ID NO: 159489 - DNA, 22 bp, Artificial Sequence
  chemically synthesized
tattagtcaaatcagccaagca

SEQ ID NO: 159490 - DNA, 22 bp, Artificial Sequence
  chemically synthesized
attagtcaaatcagccaagcag

SEQ ID NO: 159491 - DNA, 22 bp, Artificial Sequence
  chemically synthesized
ttagtcaaatcagccaagcagt

SEQ ID NO: 159492 - DNA, 22 bp, Artificial Sequence
  chemically synthesized
gtcaaatcagccaagcagtttt

SEQ ID NO: 159493 - DNA, 22 bp, Artificial Sequence
  chemically synthesized
ttcaggctcttagtattcagta

SEQ ID NO: 159494 - DNA, 22 bp, Artificial Sequence
  chemically synthesized
tcaggctcttagtattcagtaa

SEQ ID NO: 159495 - DNA, 22 bp, Artificial Sequence
  chemically synthesized
caggctcttagtattcagtaaa

SEQ ID NO: 159496 - DNA, 22 bp, Artificial Sequence
  chemically synthesized
aggctcttagtattcagtaaaa

SEQ ID NO: 159497 - DNA, 22 bp, Artificial Sequence
  chemically synthesized
ttagtattcagtaaaaccttta

SEQ ID NO: 159498 - DNA, 22 bp, Artificial Sequence
  chemically synthesized
agtattcagtaaaacctttata

SEQ ID NO: 159499 - DNA, 22 bp, Artificial Sequence
  chemically synthesized
gtattcagtaaaacctttatat

SEQ ID NO: 159500 - DNA, 22 bp, Artificial Sequence
  chemically synthesized
agtaaaacctttatatccctta

SEQ ID NO: 159501 - DNA, 22 bp, Artificial Sequence
  chemically synthesized
tatatcccttacggtcctccgt

SEQ ID NO: 159502 - DNA, 22 bp, Artificial Sequence
  chemically synthesized
atatcccttacggtcctccgtc

SEQ ID NO: 159503 - DNA, 22 bp, Artificial Sequence
  chemically synthesized
tatcccttacggtcctccgtct

SEQ ID NO: 159504 - DNA, 22 bp, Artificial Sequence
  chemically synthesized
acggtcctccgtcttcaggaaa

SEQ ID NO: 159505 - DNA, 22 bp, Artificial Sequence
  chemically synthesized
cggtcctccgtcttcaggaaaa

SEQ ID NO: 159506 - DNA, 22 bp, Artificial Sequence
  chemically synthesized
cgtcttcaggaaaagtagaacg

SEQ ID NO: 159507 - DNA, 22 bp, Artificial Sequence
  chemically synthesized
caggaaaagtagaacggactaa

SEQ ID NO: 159508 - DNA, 22 bp, Artificial Sequence
  chemically synthesized
aggaaaagtagaacggactaaa

SEQ ID NO: 159509 - DNA, 22 bp, Artificial Sequence
  chemically synthesized
aatgtcttttaaaaacacacct

SEQ ID NO: 159510 - DNA, 22 bp, Artificial Sequence
  chemically synthesized
ttaaaaacacacctcaccaagc

SEQ ID NO: 159511 - DNA, 22 bp, Artificial Sequence
  chemically synthesized
taaaaacacacctcaccaagct

SEQ ID NO: 159512 - DNA, 22 bp, Artificial Sequence
  chemically synthesized
aaaaacacacctcaccaagctc

SEQ ID NO: 159513 - DNA, 22 bp, Artificial Sequence
  chemically synthesized
aaaacacacctcaccaagctca

SEQ ID NO: 159514 - DNA, 22 bp, Artificial Sequence
  chemically synthesized
accaagctcagccaccaactta

SEQ ID NO: 159515 - DNA, 22 bp, Artificial Sequence
  chemically synthesized
agccaccaacttaaaaaggact

SEQ ID NO: 159516 - DNA, 22 bp, Artificial Sequence
  chemically synthesized
aaaaaggactggacaatacttt

SEQ ID NO: 159517 - DNA, 22 bp, Artificial Sequence
  chemically synthesized
aaaaggactggacaatactttt

SEQ ID NO: 159518 - DNA, 22 bp, Artificial Sequence
  chemically synthesized
gacaatacttttaccacttttc

SEQ ID NO: 159519 - DNA, 22 bp, Artificial Sequence
  chemically synthesized
ttaccacttttctttctcagaa

SEQ ID NO: 159520 - DNA, 22 bp, Artificial Sequence
  chemically synthesized
taccacttttctttctcagaag

SEQ ID NO: 159521 - DNA, 22 bp, Artificial Sequence
  chemically synthesized
accacttttctttctcagaagt

SEQ ID NO: 159522 - DNA, 22 bp, Artificial Sequence
  chemically synthesized
ccacttttctttctcagaagtc

SEQ ID NO: 159523 - DNA, 22 bp, Artificial Sequence
  chemically synthesized
ttctttctcagaagtcagacct

SEQ ID NO: 159524 - DNA, 22 bp, Artificial Sequence
  chemically synthesized
tctttctcagaagtcagacctg

SEQ ID NO: 159525 - DNA, 22 bp, Artificial Sequence
  chemically synthesized
ctttctcagaagtcagacctgt

SEQ ID NO: 159526 - DNA, 22 bp, Artificial Sequence
  chemically synthesized
tttctcagaagtcagacctgtc

SEQ ID NO: 159527 - DNA, 22 bp, Artificial Sequence
  chemically synthesized
tctcagaagtcagacctgtcct

SEQ ID NO: 159528 - DNA, 22 bp, Artificial Sequence
  chemically synthesized
ctcagaagtcagacctgtcctc

SEQ ID NO: 159529 - DNA, 22 bp, Artificial Sequence
  chemically synthesized
tcagaagtcagacctgtcctca

SEQ ID NO: 159530 - DNA, 22 bp, Artificial Sequence
  chemically synthesized
agaagtcagacctgtcctcaga

SEQ ID NO: 159531 - DNA, 22 bp, Artificial Sequence
  chemically synthesized
tcctcagaatgctacagggtac

SEQ ID NO: 159532 - DNA, 22 bp, Artificial Sequence
  chemically synthesized
agaatgctacagggtacagccc

SEQ ID NO: 159533 - DNA, 22 bp, Artificial Sequence
  chemically synthesized
cagggtacagcccatttgagct

SEQ ID NO: 159534 - DNA, 22 bp, Artificial Sequence
  chemically synthesized
gagctcctgtatagatttgcct

SEQ ID NO: 159535 - DNA, 22 bp, Artificial Sequence
  chemically synthesized
agctcctgtatagatttgcctt

SEQ ID NO: 159536 - DNA, 22 bp, Artificial Sequence
  chemically synthesized
ctgtatagatttgcctttttat

SEQ ID NO: 159537 - DNA, 22 bp, Artificial Sequence
  chemically synthesized
tatagatttgcctttttattag

SEQ ID NO: 159538 - DNA, 22 bp, Artificial Sequence
  chemically synthesized
gcctttttattaggccccagtc

SEQ ID NO: 159539 - DNA, 22 bp, Artificial Sequence
  chemically synthesized
cctttttattaggccccagtct

SEQ ID NO: 159540 - DNA, 22 bp, Artificial Sequence
  chemically synthesized
tttattaggccccagtctaatt

SEQ ID NO: 159541 - DNA, 22 bp, Artificial Sequence
  chemically synthesized
ttattaggccccagtctaattc

SEQ ID NO: 159542 - DNA, 22 bp, Artificial Sequence
  chemically synthesized
tattaggccccagtctaattcc

SEQ ID NO: 159543 - DNA, 22 bp, Artificial Sequence
  chemically synthesized
attaggccccagtctaattcca

SEQ ID NO: 159544 - DNA, 22 bp, Artificial Sequence
  chemically synthesized
ttaggccccagtctaattccag

SEQ ID NO: 159545 - DNA, 22 bp, Artificial Sequence
  chemically synthesized
ggccccagtctaattccagaca

SEQ ID NO: 159546 - DNA, 22 bp, Artificial Sequence
  chemically synthesized
attccagacaccagaccaactt

SEQ ID NO: 159547 - DNA, 22 bp, Artificial Sequence
  chemically synthesized
cagacaccagaccaacttagaa

SEQ ID NO: 159548 - DNA, 22 bp, Artificial Sequence
  chemically synthesized
agaatgtgccccaaaaaaactt

SEQ ID NO: 159549 - DNA, 22 bp, Artificial Sequence
  chemically synthesized
gaatgtgccccaaaaaaacttg

SEQ ID NO: 159550 - DNA, 22 bp, Artificial Sequence
  chemically synthesized
gtcatccctgctatcttctgtc

SEQ ID NO: 159551 - DNA, 22 bp, Artificial Sequence
  chemically synthesized
tcatccctgctatcttctgtct

SEQ ID NO: 159552 - DNA, 22 bp, Artificial Sequence
  chemically synthesized
ctatcttctgtctagtcatact

SEQ ID NO: 159553 - DNA, 22 bp, Artificial Sequence
  chemically synthesized
tcttctgtctagtcatactcct

SEQ ID NO: 159554 - DNA, 22 bp, Artificial Sequence
  chemically synthesized
ctgtctagtcatactcctattc

SEQ ID NO: 159555 - DNA, 22 bp, Artificial Sequence
  chemically synthesized
tgtctagtcatactcctattca

SEQ ID NO: 159556 - DNA, 22 bp, Artificial Sequence
  chemically synthesized
tctagtcatactcctattcacc

SEQ ID NO: 159557 - DNA, 22 bp, Artificial Sequence
  chemically synthesized
gtcatactcctattcaccattc

SEQ ID NO: 159558 - DNA, 22 bp, Artificial Sequence
  chemically synthesized
ctattcaccattctcaactact

SEQ ID NO: 159559 - DNA, 22 bp, Artificial Sequence
  chemically synthesized
ttcaccattctcaactactcat

SEQ ID NO: 159560 - DNA, 22 bp, Artificial Sequence
  chemically synthesized
accattctcaactactcataca

SEQ ID NO: 159561 - DNA, 22 bp, Artificial Sequence
  chemically synthesized
tcaactactcatacatgccctg

SEQ ID NO: 159562 - DNA, 22 bp, Artificial Sequence
  chemically synthesized
aactactcatacatgccctgct

SEQ ID NO: 159563 - DNA, 22 bp, Artificial Sequence
  chemically synthesized
ctcatacatgccctgctcttgt

SEQ ID NO: 159564 - DNA, 22 bp, Artificial Sequence
  chemically synthesized
atacatgccctgctcttgttta

SEQ ID NO: 159565 - DNA, 22 bp, Artificial Sequence
  chemically synthesized
ctcttgtttacactgccggttt

SEQ ID NO: 159566 - DNA, 22 bp, Artificial Sequence
  chemically synthesized
ttgtttacactgccggtttaca

SEQ ID NO: 159567 - DNA, 22 bp, Artificial Sequence
  chemically synthesized
gtttacactgccggtttacact

SEQ ID NO: 159568 - DNA, 22 bp, Artificial Sequence
  chemically synthesized
tttacactgccggtttacactg

SEQ ID NO: 159569 - DNA, 22 bp, Artificial Sequence
  chemically synthesized
acactgccggtttacactgttt

SEQ ID NO: 159570 - DNA, 22 bp, Artificial Sequence
  chemically synthesized
cactgccggtttacactgtttt

SEQ ID NO: 159571 - DNA, 22 bp, Artificial Sequence
  chemically synthesized
ccggtttacactgtttttccaa

SEQ ID NO: 159572 - DNA, 22 bp, Artificial Sequence
  chemically synthesized
acactgtttttccaagccatca

SEQ ID NO: 159573 - DNA, 22 bp, Artificial Sequence
  chemically synthesized
cactgtttttccaagccatcac

SEQ ID NO: 159574 - DNA, 22 bp, Artificial Sequence
  chemically synthesized
tttttccaagccatcacagctg

SEQ ID NO: 159575 - DNA, 22 bp, Artificial Sequence
  chemically synthesized
ttccaagccatcacagctgata

SEQ ID NO: 159576 - DNA, 22 bp, Artificial Sequence
  chemically synthesized
tccaagccatcacagctgatat

SEQ ID NO: 159577 - DNA, 22 bp, Artificial Sequence
  chemically synthesized
ccaagccatcacagctgatatc

SEQ ID NO: 159578 - DNA, 22 bp, Artificial Sequence
  chemically synthesized
caagccatcacagctgatatct

SEQ ID NO: 159579 - DNA, 22 bp, Artificial Sequence
  chemically synthesized
atatctcctggtgctatcccca

SEQ ID NO: 159580 - DNA, 22 bp, Artificial Sequence
  chemically synthesized
ctggtgctatccccaaactgcc

SEQ ID NO: 159581 - DNA, 22 bp, Artificial Sequence
  chemically synthesized
gtgctatccccaaactgccact

SEQ ID NO: 159582 - DNA, 22 bp, Artificial Sequence
  chemically synthesized
tccccaaactgccactcttaac

SEQ ID NO: 159583 - DNA, 22 bp, Artificial Sequence
  chemically synthesized
ccactcttaactcttgaagtaa

SEQ ID NO: 159584 - DNA, 22 bp, Artificial Sequence
  chemically synthesized
ttaactcttgaagtaaataaat

SEQ ID NO: 159585 - DNA, 22 bp, Artificial Sequence
  chemically synthesized
aactcttgaagtaaataaataa

SEQ ID NO: 159586 - DNA, 22 bp, Artificial Sequence
  chemically synthesized
actcttgaagtaaataaataat

SEQ ID NO: 159587 - DNA, 22 bp, Artificial Sequence
  chemically synthesized
ttgaagtaaataaataatcttt

SEQ ID NO: 159588 - DNA, 22 bp, Artificial Sequence
  chemically synthesized
gaagtaaataaataatctttgc

SEQ ID NO: 159589 - DNA, 22 bp, Artificial Sequence
  chemically synthesized
aagtaaataaataatctttgct

SEQ ID NO: 159590 - DNA, 22 bp, Artificial Sequence
  chemically synthesized
tgctggcaggactatgttgaat

SEQ ID NO: 159591 - DNA, 22 bp, Artificial Sequence
  chemically synthesized
gctggcaggactatgttgaatc

SEQ ID NO: 159592 - DNA, 22 bp, Artificial Sequence
  chemically synthesized
ctggcaggactatgttgaatct

SEQ ID NO: 159593 - DNA, 22 bp, Artificial Sequence
  chemically synthesized
gcaggactatgttgaatctcct

SEQ ID NO: 159594 - DNA, 22 bp, Artificial Sequence
  chemically synthesized
tgttgaatctccttaggcactc

SEQ ID NO: 159595 - DNA, 22 bp, Artificial Sequence
  chemically synthesized
aatctccttaggcactctttaa

SEQ ID NO: 159596 - DNA, 22 bp, Artificial Sequence
  chemically synthesized
cttaggcactctttaatcagat

SEQ ID NO: 159597 - DNA, 22 bp, Artificial Sequence
  chemically synthesized
aggcactctttaatcagatgtc

SEQ ID NO: 159598 - DNA, 22 bp, Artificial Sequence
  chemically synthesized
ggcactctttaatcagatgtcc

SEQ ID NO: 159599 - DNA, 22 bp, Artificial Sequence
  chemically synthesized
tttaatcagatgtcctaggtcc

SEQ ID NO: 159600 - DNA, 22 bp, Artificial Sequence
  chemically synthesized
taatcagatgtcctaggtcctc

SEQ ID NO: 159601 - DNA, 22 bp, Artificial Sequence
  chemically synthesized
aatcagatgtcctaggtcctcc

SEQ ID NO: 159602 - DNA, 22 bp, Artificial Sequence
  chemically synthesized
atcagatgtcctaggtcctccc

SEQ ID NO: 159603 - DNA, 22 bp, Artificial Sequence
  chemically synthesized
ggtcctcccacttcttagtcct

SEQ ID NO: 159604 - DNA, 22 bp, Artificial Sequence
  chemically synthesized
ccacttcttagtcctttaatac

SEQ ID NO: 159605 - DNA, 22 bp, Artificial Sequence
  chemically synthesized
cttagtcctttaatacctgttt

SEQ ID NO: 159606 - DNA, 22 bp, Artificial Sequence
  chemically synthesized
ttagtcctttaatacctgtttt

SEQ ID NO: 159607 - DNA, 22 bp, Artificial Sequence
  chemically synthesized
agtcctttaatacctgtttttc

SEQ ID NO: 159608 - DNA, 22 bp, Artificial Sequence
  chemically synthesized
gtcctttaatacctgtttttct

SEQ ID NO: 159609 - DNA, 22 bp, Artificial Sequence
  chemically synthesized
taatacctgtttttctccttct

SEQ ID NO: 159610 - DNA, 22 bp, Artificial Sequence
  chemically synthesized
aatacctgtttttctccttctc

SEQ ID NO: 159611 - DNA, 22 bp, Artificial Sequence
  chemically synthesized
atacctgtttttctccttctct

SEQ ID NO: 159612 - DNA, 22 bp, Artificial Sequence
  chemically synthesized
tttttctccttctcttattcca

SEQ ID NO: 159613 - DNA, 22 bp, Artificial Sequence
  chemically synthesized
ttctccttctcttattccattt

SEQ ID NO: 159614 - DNA, 22 bp, Artificial Sequence
  chemically synthesized
tctccttctcttattccatttg

SEQ ID NO: 159615 - DNA, 22 bp, Artificial Sequence
  chemically synthesized
ctccttctcttattccatttgg

SEQ ID NO: 159616 - DNA, 22 bp, Artificial Sequence
  chemically synthesized
tccttctcttattccatttggt

SEQ ID NO: 159617 - DNA, 22 bp, Artificial Sequence
  chemically synthesized
cttctcttattccatttggttt

SEQ ID NO: 159618 - DNA, 22 bp, Artificial Sequence
  chemically synthesized
ctcttattccatttggtttttc

SEQ ID NO: 159619 - DNA, 22 bp, Artificial Sequence
  chemically synthesized
tcttattccatttggtttttca

SEQ ID NO: 159620 - DNA, 22 bp, Artificial Sequence
  chemically synthesized
ttattccatttggtttttcaat

SEQ ID NO: 159621 - DNA, 22 bp, Artificial Sequence
  chemically synthesized
attccatttggtttttcaatcc

SEQ ID NO: 159622 - DNA, 22 bp, Artificial Sequence
  chemically synthesized
ttccatttggtttttcaatcca

SEQ ID NO: 159623 - DNA, 22 bp, Artificial Sequence
  chemically synthesized
catttggtttttcaatccatac

SEQ ID NO: 159624 - DNA, 22 bp, Artificial Sequence
  chemically synthesized
ggtttttcaatccatacaaaac

SEQ ID NO: 159625 - DNA, 22 bp, Artificial Sequence
  chemically synthesized
gtttttcaatccatacaaaacc

SEQ ID NO: 159626 - DNA, 22 bp, Artificial Sequence
  chemically synthesized
ttcaatccatacaaaaccgtat

SEQ ID NO: 159627 - DNA, 22 bp, Artificial Sequence
  chemically synthesized
tcaatccatacaaaaccgtatc

SEQ ID NO: 159628 - DNA, 22 bp, Artificial Sequence
  chemically synthesized
caatccatacaaaaccgtatcc

SEQ ID NO: 159629 - DNA, 22 bp, Artificial Sequence
  chemically synthesized
aatccatacaaaaccgtatcca

SEQ ID NO: 159630 - DNA, 22 bp, Artificial Sequence
  chemically synthesized
tacatgacaaatgtttcttcta

SEQ ID NO: 159631 - DNA, 22 bp, Artificial Sequence
  chemically synthesized
catgacaaatgtttcttctaac

SEQ ID NO: 159632 - DNA, 22 bp, Artificial Sequence
  chemically synthesized
cttctaacaaccccacaatatc

SEQ ID NO: 159633 - DNA, 22 bp, Artificial Sequence
  chemically synthesized
ttctaacaaccccacaatatca

SEQ ID NO: 159634 - DNA, 22 bp, Artificial Sequence
  chemically synthesized
ctaacaaccccacaatatcacc

SEQ ID NO: 159635 - DNA, 22 bp, Artificial Sequence
  chemically synthesized
taacaaccccacaatatcaccc

SEQ ID NO: 159636 - DNA, 22 bp, Artificial Sequence
  chemically synthesized
acaaccccacaatatcacccct

SEQ ID NO: 159637 - DNA, 22 bp, Artificial Sequence
  chemically synthesized
accacaaaatcttccttcagct

SEQ ID NO: 159638 - DNA, 22 bp, Artificial Sequence
  chemically synthesized
ccacaaaatcttccttcagctt

SEQ ID NO: 159639 - DNA, 22 bp, Artificial Sequence
  chemically synthesized
ccttcagcttaatctctcccac

SEQ ID NO: 159640 - DNA, 22 bp, Artificial Sequence
  chemically synthesized
cttcagcttaatctctcccact

SEQ ID NO: 159641 - DNA, 22 bp, Artificial Sequence
  chemically synthesized
cagcttaatctctcccactcta

SEQ ID NO: 159642 - DNA, 22 bp, Artificial Sequence
  chemically synthesized
agcttaatctctcccactctag

SEQ ID NO: 159643 - DNA, 22 bp, Artificial Sequence
  chemically synthesized
aatctctcccactctaggttcc

SEQ ID NO: 159644 - DNA, 22 bp, Artificial Sequence
  chemically synthesized
atctctcccactctaggttccc

SEQ ID NO: 159645 - DNA, 22 bp, Artificial Sequence
  chemically synthesized
tcccactctaggttcccacgcc

SEQ ID NO: 159646 - DNA, 22 bp, Artificial Sequence
  chemically synthesized
ccactctaggttcccacgccgc

SEQ ID NO: 159647 - DNA, 22 bp, Artificial Sequence
  chemically synthesized
taggttcccacgccgcccctaa

SEQ ID NO: 159648 - DNA, 22 bp, Artificial Sequence
  chemically synthesized
ggttcccacgccgcccctaatc

SEQ ID NO: 159649 - DNA, 22 bp, Artificial Sequence
  chemically synthesized
ccacgccgcccctaatcccgct

SEQ ID NO: 159650 - DNA, 22 bp, Artificial Sequence
  chemically synthesized
atcccgctcgaagcagccctga

SEQ ID NO: 159651 - DNA, 22 bp, Artificial Sequence
  chemically synthesized
gaagcagccctgagaaatatcg

SEQ ID NO: 159652 - DNA, 22 bp, Artificial Sequence
  chemically synthesized
agaaatatcgcccattatctct

SEQ ID NO: 159653 - DNA, 22 bp, Artificial Sequence
  chemically synthesized
tctctccataccatcccccaaa

SEQ ID NO: 159654 - DNA, 22 bp, Artificial Sequence
  chemically synthesized
tccataccatcccccaaaattt

SEQ ID NO: 159655 - DNA, 22 bp, Artificial Sequence
  chemically synthesized
cataccatcccccaaaattttc

SEQ ID NO: 159656 - DNA, 22 bp, Artificial Sequence
  chemically synthesized
tcgctgccccaacacttcaaca

SEQ ID NO: 159657 - DNA, 22 bp, Artificial Sequence
  chemically synthesized
cgctgccccaacacttcaacac

SEQ ID NO: 159658 - DNA, 22 bp, Artificial Sequence
  chemically synthesized
gctgccccaacacttcaacact

SEQ ID NO: 159659 - DNA, 22 bp, Artificial Sequence
  chemically synthesized
ccccaacacttcaacactatta

SEQ ID NO: 159660 - DNA, 22 bp, Artificial Sequence
  chemically synthesized
caacactattatgttttatttt

SEQ ID NO: 159661 - DNA, 22 bp, Artificial Sequence
  chemically synthesized
aacactattatgttttattttt

SEQ ID NO: 159662 - DNA, 22 bp, Artificial Sequence
  chemically synthesized
ttatgttttatttttcttatta

SEQ ID NO: 159663 - DNA, 22 bp, Artificial Sequence
  chemically synthesized
tgttttatttttcttattaata

SEQ ID NO: 159664 - DNA, 22 bp, Artificial Sequence
  chemically synthesized
tatttttcttattaatataaga

SEQ ID NO: 159665 - DNA, 22 bp, Artificial Sequence
  chemically synthesized
atttttcttattaatataagaa

SEQ ID NO: 159666 - DNA, 22 bp, Artificial Sequence
  chemically synthesized
tttttcttattaatataagaag

SEQ ID NO: 159667 - DNA, 22 bp, Artificial Sequence
  chemically synthesized
ttcttattaatataagaagaca

SEQ ID NO: 159668 - DNA, 22 bp, Artificial Sequence
  chemically synthesized
tcttattaatataagaagacag

SEQ ID NO: 159669 - DNA, 22 bp, Artificial Sequence
  chemically synthesized
cttattaatataagaagacagg

SEQ ID NO: 159670 - DNA, 22 bp, Artificial Sequence
  chemically synthesized
ttattaatataagaagacagga

SEQ ID NO: 159671 - DNA, 22 bp, Artificial Sequence
  chemically synthesized
attaatataagaagacaggaat

SEQ ID NO: 159672 - DNA, 22 bp, Artificial Sequence
  chemically synthesized
ttaatataagaagacaggaatg

SEQ ID NO: 159673 - DNA, 22 bp, Artificial Sequence
  chemically synthesized
atataagaagacaggaatgtca

SEQ ID NO: 159674 - DNA, 22 bp, Artificial Sequence
  chemically synthesized
tgagcccaagctaagccatcat

SEQ ID NO: 159675 - DNA, 22 bp, Artificial Sequence
  chemically synthesized
agcccaagctaagccatcatgt

SEQ ID NO: 159676 - DNA, 22 bp, Artificial Sequence
  chemically synthesized
agccatcatgtcccctgtgacc

SEQ ID NO: 159677 - DNA, 22 bp, Artificial Sequence
  chemically synthesized
tgacctgcaggtacacatacag

SEQ ID NO: 159678 - DNA, 22 bp, Artificial Sequence
  chemically synthesized
caggtacacatacagatggcca

SEQ ID NO: 159679 - DNA, 22 bp, Artificial Sequence
  chemically synthesized
ctgccttaactgatgacattcc

SEQ ID NO: 159680 - DNA, 22 bp, Artificial Sequence
  chemically synthesized
ccttaactgatgacattccacc

SEQ ID NO: 159681 - DNA, 22 bp, Artificial Sequence
  chemically synthesized
aactgatgacattccaccacaa

SEQ ID NO: 159682 - DNA, 22 bp, Artificial Sequence
  chemically synthesized
actgatgacattccaccacaaa

SEQ ID NO: 159683 - DNA, 22 bp, Artificial Sequence
  chemically synthesized
atgacattccaccacaaaagaa

SEQ ID NO: 159684 - DNA, 22 bp, Artificial Sequence
  chemically synthesized
caccacaaaagaagtgaaaatg

SEQ ID NO: 159685 - DNA, 22 bp, Artificial Sequence
  chemically synthesized
ttcctgccttaactgatgacat

SEQ ID NO: 159686 - DNA, 22 bp, Artificial Sequence
  chemically synthesized
ctgccttaactgatgacattgt

SEQ ID NO: 159687 - DNA, 22 bp, Artificial Sequence
  chemically synthesized
ccttaactgatgacattgtctt

SEQ ID NO: 159688 - DNA, 22 bp, Artificial Sequence
  chemically synthesized
aactgatgacattgtcttgtga

SEQ ID NO: 159689 - DNA, 22 bp, Artificial Sequence
  chemically synthesized
actgatgacattgtcttgtgaa

SEQ ID NO: 159690 - DNA, 22 bp, Artificial Sequence
  chemically synthesized
atgacattgtcttgtgaaagtc

SEQ ID NO: 159691 - DNA, 22 bp, Artificial Sequence
  chemically synthesized
tcttgtgaaagtccttctcctg

SEQ ID NO: 159692 - DNA, 22 bp, Artificial Sequence
  chemically synthesized
gtgaaagtccttctcctggctc

SEQ ID NO: 159693 - DNA, 22 bp, Artificial Sequence
  chemically synthesized
tgaaagtccttctcctggctca

SEQ ID NO: 159694 - DNA, 22 bp, Artificial Sequence
  chemically synthesized
ctcctggctcatcctggctcaa

SEQ ID NO: 159695 - DNA, 22 bp, Artificial Sequence
  chemically synthesized
tcctggctcatcctggctcaaa

SEQ ID NO: 159696 - DNA, 22 bp, Artificial Sequence
  chemically synthesized
ctggctcatcctggctcaaaag

SEQ ID NO: 159697 - DNA, 22 bp, Artificial Sequence
  chemically synthesized
gctcatcctggctcaaaagctc

SEQ ID NO: 159698 - DNA, 22 bp, Artificial Sequence
  chemically synthesized
atcctggctcaaaagctcccct

SEQ ID NO: 159699 - DNA, 22 bp, Artificial Sequence
  chemically synthesized
gctcaaaagctcccctactgag

SEQ ID NO: 159700 - DNA, 22 bp, Artificial Sequence
  chemically synthesized
aaaagctcccctactgagcacc

SEQ ID NO: 159701 - DNA, 22 bp, Artificial Sequence
  chemically synthesized
ccctactgagcaccttgtgacc

SEQ ID NO: 159702 - DNA, 22 bp, Artificial Sequence
  chemically synthesized
ctgagcaccttgtgacccccca

SEQ ID NO: 159703 - DNA, 22 bp, Artificial Sequence
  chemically synthesized
agcaccttgtgaccccccactc

SEQ ID NO: 159704 - DNA, 22 bp, Artificial Sequence
  chemically synthesized
gtgaccccccactcctgcccgc

SEQ ID NO: 159705 - DNA, 22 bp, Artificial Sequence
  chemically synthesized
tgaccccccactcctgcccgcc

SEQ ID NO: 159706 - DNA, 22 bp, Artificial Sequence
  chemically synthesized
ctgcccgccagagaacaacccc

SEQ ID NO: 159707 - DNA, 22 bp, Artificial Sequence
  chemically synthesized
cccgccagagaacaacccccct

SEQ ID NO: 159708 - DNA, 22 bp, Artificial Sequence
  chemically synthesized
tgactgtaattttcctttacct

SEQ ID NO: 159709 - DNA, 22 bp, Artificial Sequence
  chemically synthesized
gactgtaattttcctttaccta

SEQ ID NO: 159710 - DNA, 22 bp, Artificial Sequence
  chemically synthesized
actgtaattttcctttacctac

SEQ ID NO: 159711 - DNA, 22 bp, Artificial Sequence
  chemically synthesized
taattttcctttacctacccaa

SEQ ID NO: 159712 - DNA, 22 bp, Artificial Sequence
  chemically synthesized
tcctttacctacccaaatctta

SEQ ID NO: 159713 - DNA, 22 bp, Artificial Sequence
  chemically synthesized
cctttacctacccaaatcttat

SEQ ID NO: 159714 - DNA, 22 bp, Artificial Sequence
  chemically synthesized
ctttacctacccaaatcttata

SEQ ID NO: 159715 - DNA, 22 bp, Artificial Sequence
  chemically synthesized
tacctacccaaatcttataaaa

SEQ ID NO: 159716 - DNA, 22 bp, Artificial Sequence
  chemically synthesized
acctacccaaatcttataaaac

SEQ ID NO: 159717 - DNA, 22 bp, Artificial Sequence
  chemically synthesized
cctacccaaatcttataaaaca

SEQ ID NO: 159718 - DNA, 22 bp, Artificial Sequence
  chemically synthesized
cccaaatcttataaaacagccc

SEQ ID NO: 159719 - DNA, 22 bp, Artificial Sequence
  chemically synthesized
ataaaacagccccactcctatc

SEQ ID NO: 159720 - DNA, 22 bp, Artificial Sequence
  chemically synthesized
taaaacagccccactcctatct

SEQ ID NO: 159721 - DNA, 22 bp, Artificial Sequence
  chemically synthesized
ctatctccctttgctgactctc

SEQ ID NO: 159722 - DNA, 22 bp, Artificial Sequence
  chemically synthesized
tctccctttgctgactctcttt

SEQ ID NO: 159723 - DNA, 22 bp, Artificial Sequence
  chemically synthesized
cctttgctgactctcttttcgg

SEQ ID NO: 159724 - DNA, 22 bp, Artificial Sequence
  chemically synthesized
tgctgactctcttttcggactc

SEQ ID NO: 159725 - DNA, 22 bp, Artificial Sequence
  chemically synthesized
gctgactctcttttcggactca

SEQ ID NO: 159726 - DNA, 22 bp, Artificial Sequence
  chemically synthesized
ctgactctcttttcggactcag

SEQ ID NO: 159727 - DNA, 22 bp, Artificial Sequence
  chemically synthesized
actctcttttcggactcagccc

SEQ ID NO: 159728 - DNA, 22 bp, Artificial Sequence
  chemically synthesized
tcttttcggactcagcccgcct

SEQ ID NO: 159729 - DNA, 22 bp, Artificial Sequence
  chemically synthesized
ttttcggactcagcccgcctgc

SEQ ID NO: 159730 - DNA, 22 bp, Artificial Sequence
  chemically synthesized
ttcggactcagcccgcctgcac

SEQ ID NO: 159731 - DNA, 22 bp, Artificial Sequence
  chemically synthesized
tcggactcagcccgcctgcacc

SEQ ID NO: 159732 - DNA, 22 bp, Artificial Sequence
  chemically synthesized
cggactcagcccgcctgcaccc

SEQ ID NO: 159733 - DNA, 22 bp, Artificial Sequence
  chemically synthesized
ggactcagcccgcctgcaccca

SEQ ID NO: 159734 - DNA, 22 bp, Artificial Sequence
  chemically synthesized
agcccgcctgcacccaggtgat

SEQ ID NO: 159735 - DNA, 22 bp, Artificial Sequence
  chemically synthesized
cacccaggtgataaaaagcttt

SEQ ID NO: 159736 - DNA, 22 bp, Artificial Sequence
  chemically synthesized
tattgctcacacaaagcctgtt

SEQ ID NO: 159737 - DNA, 22 bp, Artificial Sequence
  chemically synthesized
attgctcacacaaagcctgttt

SEQ ID NO: 159738 - DNA, 22 bp, Artificial Sequence
  chemically synthesized
ttgctcacacaaagcctgtttg

SEQ ID NO: 159739 - DNA, 22 bp, Artificial Sequence
  chemically synthesized
ctcacacaaagcctgtttggta

SEQ ID NO: 159740 - DNA, 22 bp, Artificial Sequence
  chemically synthesized
acacaaagcctgtttggtagtc

SEQ ID NO: 159741 - DNA, 22 bp, Artificial Sequence
  chemically synthesized
tttggtagtctcctcacaggga

SEQ ID NO: 159742 - DNA, 22 bp, Artificial Sequence
  chemically synthesized
ggtagtctcctcacagggatgc

SEQ ID NO: 159743 - DNA, 22 bp, Artificial Sequence
  chemically synthesized
gtagtctcctcacagggatgcg

SEQ ID NO: 159744 - DNA, 22 bp, Artificial Sequence
  chemically synthesized
ctcacagggatgcgcatgaaac

SEQ ID NO: 159745 - DNA, 22 bp, Artificial Sequence
  chemically synthesized
acagggatgcgcatgaaactga

SEQ ID NO: 159746 - DNA, 22 bp, Artificial Sequence
  chemically synthesized
aataaccaatgagtcactaaag

SEQ ID NO: 159747 - DNA, 22 bp, Artificial Sequence
  chemically synthesized
aagaaattaagaaggaaatttt

SEQ ID NO: 159748 - DNA, 22 bp, Artificial Sequence
  chemically synthesized
agaaggaaattttaaaacttct

SEQ ID NO: 159749 - DNA, 22 bp, Artificial Sequence
  chemically synthesized
taaaacttcttgaaacaagtga

SEQ ID NO: 159750 - DNA, 22 bp, Artificial Sequence
  chemically synthesized
aaaacttcttgaaacaagtgaa

SEQ ID NO: 159751 - DNA, 22 bp, Artificial Sequence
  chemically synthesized
aaacttcttgaaacaagtgaaa

SEQ ID NO: 159752 - DNA, 22 bp, Artificial Sequence
  chemically synthesized
cttgaaacaagtgaaaatggaa

SEQ ID NO: 159753 - DNA, 22 bp, Artificial Sequence
  chemically synthesized
ttgaaacaagtgaaaatggaaa

SEQ ID NO: 159754 - DNA, 22 bp, Artificial Sequence
  chemically synthesized
gaaacaagtgaaaatggaaata

SEQ ID NO: 159755 - DNA, 22 bp, Artificial Sequence
  chemically synthesized
aaacaagtgaaaatggaaatac

SEQ ID NO: 159756 - DNA, 22 bp, Artificial Sequence
  chemically synthesized
caggatatggcaaaagcagtac

SEQ ID NO: 159757 - DNA, 22 bp, Artificial Sequence
  chemically synthesized
agagggaagttcatagcaataa

SEQ ID NO: 159758 - DNA, 22 bp, Artificial Sequence
  chemically synthesized
gagggaagttcatagcaataaa

SEQ ID NO: 159759 - DNA, 22 bp, Artificial Sequence
  chemically synthesized
atagcaataaacacctatatcc

SEQ ID NO: 159760 - DNA, 22 bp, Artificial Sequence
  chemically synthesized
tatccaaaaaagtagaaaggct

SEQ ID NO: 159761 - DNA, 22 bp, Artificial Sequence
  chemically synthesized
caactaagcaaccaaacaatgt

SEQ ID NO: 159762 - DNA, 22 bp, Artificial Sequence
  chemically synthesized
aactaagcaaccaaacaatgta

SEQ ID NO: 159763 - DNA, 22 bp, Artificial Sequence
  chemically synthesized
agcaaccaaacaatgtacctca

SEQ ID NO: 159764 - DNA, 22 bp, Artificial Sequence
  chemically synthesized
aaggaaataggaaagcaagaac

SEQ ID NO: 159765 - DNA, 22 bp, Artificial Sequence
  chemically synthesized
atagaaggggagaaataagaaa

SEQ ID NO: 159766 - DNA, 22 bp, Artificial Sequence
  chemically synthesized
agaccaaaaaatacagaaaatc

SEQ ID NO: 159767 - DNA, 22 bp, Artificial Sequence
  chemically synthesized
aaaacaaacagttgctttcttg

SEQ ID NO: 159768 - DNA, 22 bp, Artificial Sequence
  chemically synthesized
ctttcttggaaaggtaaacaaa

SEQ ID NO: 159769 - DNA, 22 bp, Artificial Sequence
  chemically synthesized
tcttggaaaggtaaacaaaatc

SEQ ID NO: 159770 - DNA, 22 bp, Artificial Sequence
  chemically synthesized
cttggaaaggtaaacaaaatca

SEQ ID NO: 159771 - DNA, 22 bp, Artificial Sequence
  chemically synthesized
ttggaaaggtaaacaaaatcaa

SEQ ID NO: 159772 - DNA, 22 bp, Artificial Sequence
  chemically synthesized
ggaaaggtaaacaaaatcaaca

SEQ ID NO: 159773 - DNA, 22 bp, Artificial Sequence
  chemically synthesized
gaaaggtaaacaaaatcaacaa

SEQ ID NO: 159774 - DNA, 22 bp, Artificial Sequence
  chemically synthesized
taagaaaaaagagtcaaataaa

SEQ ID NO: 159775 - DNA, 22 bp, Artificial Sequence
  chemically synthesized
aagaaaaaagagtcaaataaaa

SEQ ID NO: 159776 - DNA, 22 bp, Artificial Sequence
  chemically synthesized
agaaaaaagagtcaaataaaat

SEQ ID NO: 159777 - DNA, 22 bp, Artificial Sequence
  chemically synthesized
gaaaatgaaaaagaggatataa

SEQ ID NO: 159778 - DNA, 22 bp, Artificial Sequence
  chemically synthesized
agacctcagcaacacaaagact

SEQ ID NO: 159779 - DNA, 22 bp, Artificial Sequence
  chemically synthesized
agcaacacaaagactcattaga

SEQ ID NO: 159780 - DNA, 22 bp, Artificial Sequence
  chemically synthesized
attagatactattatgaacaac

SEQ ID NO: 159781 - DNA, 22 bp, Artificial Sequence
  chemically synthesized
gatactattatgaacaactgta

SEQ ID NO: 159782 - DNA, 22 bp, Artificial Sequence
  chemically synthesized
ttatgaacaactgtattccaac

SEQ ID NO: 159783 - DNA, 22 bp, Artificial Sequence
  chemically synthesized
tgaacaactgtattccaacaaa

SEQ ID NO: 159784 - DNA, 22 bp, Artificial Sequence
  chemically synthesized
tattccaacaaattggaaaatc

SEQ ID NO: 159785 - DNA, 22 bp, Artificial Sequence
  chemically synthesized
caacaaattggaaaatctagaa

SEQ ID NO: 159786 - DNA, 22 bp, Artificial Sequence
  chemically synthesized
gaaaatctagaataaatggata

SEQ ID NO: 159787 - DNA, 22 bp, Artificial Sequence
  chemically synthesized
gaataaatggataaattcctgg

SEQ ID NO: 159788 - DNA, 22 bp, Artificial Sequence
  chemically synthesized
ctggacacatacagcctagcaa

SEQ ID NO: 159789 - DNA, 22 bp, Artificial Sequence
  chemically synthesized
gacacatacagcctagcaagac

SEQ ID NO: 159790 - DNA, 22 bp, Artificial Sequence
  chemically synthesized
gcaagactgaagcatgtagaaa

SEQ ID NO: 159791 - DNA, 22 bp, Artificial Sequence
  chemically synthesized
aagcatgtagaaacagaaaacc

SEQ ID NO: 159792 - DNA, 22 bp, Artificial Sequence
  chemically synthesized
aatagaacaataatgaataaca

SEQ ID NO: 159793 - DNA, 22 bp, Artificial Sequence
  chemically synthesized
aagttgtaatataaagtttcct

SEQ ID NO: 159794 - DNA, 22 bp, Artificial Sequence
  chemically synthesized
taatataaagtttcctattaaa

SEQ ID NO: 159795 - DNA, 22 bp, Artificial Sequence
  chemically synthesized
cctattaaagaaaagcccagga

SEQ ID NO: 159796 - DNA, 22 bp, Artificial Sequence
  chemically synthesized
ctattaaagaaaagcccaggac

SEQ ID NO: 159797 - DNA, 22 bp, Artificial Sequence
  chemically synthesized
ttaaagaaaagcccaggactcg

SEQ ID NO: 159798 - DNA, 22 bp, Artificial Sequence
  chemically synthesized
aagaaaagcccaggactcgatg

SEQ ID NO: 159799 - DNA, 22 bp, Artificial Sequence
  chemically synthesized
gatgggctaccaaacatttcaa

SEQ ID NO: 159800 - DNA, 22 bp, Artificial Sequence
  chemically synthesized
ccaaacatttcaagtagaacta

SEQ ID NO: 159801 - DNA, 22 bp, Artificial Sequence
  chemically synthesized
caagtagaactaatactaatcg

SEQ ID NO: 159802 - DNA, 22 bp, Artificial Sequence
  chemically synthesized
aagtagaactaatactaatcgt

SEQ ID NO: 159803 - DNA, 22 bp, Artificial Sequence
  chemically synthesized
atactaatcgtactcaaattcc

SEQ ID NO: 159804 - DNA, 22 bp, Artificial Sequence
  chemically synthesized
atcgtactcaaattcctcaaac

SEQ ID NO: 159805 - DNA, 22 bp, Artificial Sequence
  chemically synthesized
aaattcctcaaacaaacaaaca

SEQ ID NO: 159806 - DNA, 22 bp, Artificial Sequence
  chemically synthesized
ctcaaacaaacaaacaaataaa

SEQ ID NO: 159807 - DNA, 22 bp, Artificial Sequence
  chemically synthesized
aaacaaacaaacaaataaaaac

SEQ ID NO: 159808 - DNA, 22 bp, Artificial Sequence
  chemically synthesized
aaaagaagggcctacttctaaa

SEQ ID NO: 159809 - DNA, 22 bp, Artificial Sequence
  chemically synthesized
cttctaaacttattctatgagg

SEQ ID NO: 159810 - DNA, 22 bp, Artificial Sequence
  chemically synthesized
ctaaacttattctatgaggcaa

SEQ ID NO: 159811 - DNA, 22 bp, Artificial Sequence
  chemically synthesized
taaacttattctatgaggcaag

SEQ ID NO: 159812 - DNA, 22 bp, Artificial Sequence
  chemically synthesized
aacttattctatgaggcaagca

SEQ ID NO: 159813 - DNA, 22 bp, Artificial Sequence
  chemically synthesized
attctatgaggcaagcattact

SEQ ID NO: 159814 - DNA, 22 bp, Artificial Sequence
  chemically synthesized
ttctatgaggcaagcattactc

SEQ ID NO: 159815 - DNA, 22 bp, Artificial Sequence
  chemically synthesized
tatgaggcaagcattactctaa

SEQ ID NO: 159816 - DNA, 22 bp, Artificial Sequence
  chemically synthesized
tgaggcaagcattactctaata

SEQ ID NO: 159817 - DNA, 22 bp, Artificial Sequence
  chemically synthesized
ctctaatatacccaaaccagac

SEQ ID NO: 159818 - DNA, 22 bp, Artificial Sequence
  chemically synthesized
taatatacccaaaccagaccag

SEQ ID NO: 159819 - DNA, 22 bp, Artificial Sequence
  chemically synthesized
atatacccaaaccagaccagga

SEQ ID NO: 159820 - DNA, 22 bp, Artificial Sequence
  chemically synthesized
aaaggaggtacagtaggaacat

SEQ ID NO: 159821 - DNA, 22 bp, Artificial Sequence
  chemically synthesized
aaaataataaaaaccatatagg

SEQ ID NO: 159822 - DNA, 22 bp, Artificial Sequence
  chemically synthesized
acattatgctgaacagagaaac

SEQ ID NO: 159823 - DNA, 22 bp, Artificial Sequence
  chemically synthesized
tgctgaacagagaaacattgaa

SEQ ID NO: 159824 - DNA, 22 bp, Artificial Sequence
  chemically synthesized
aacagagaaacattgaaggcct

SEQ ID NO: 159825 - DNA, 22 bp, Artificial Sequence
  chemically synthesized
aaggcctttcctctaaggactg

SEQ ID NO: 159826 - DNA, 22 bp, Artificial Sequence
  chemically synthesized
tcctctaaggactgaaataagg

SEQ ID NO: 159827 - DNA, 22 bp, Artificial Sequence
  chemically synthesized
cctctaaggactgaaataaggc

SEQ ID NO: 159828 - DNA, 22 bp, Artificial Sequence
  chemically synthesized
ctctaaggactgaaataaggca

SEQ ID NO: 159829 - DNA, 22 bp, Artificial Sequence
  chemically synthesized
taaggactgaaataaggcaaga

SEQ ID NO: 159830 - DNA, 22 bp, Artificial Sequence
  chemically synthesized
aggactgaaataaggcaagaat

SEQ ID NO: 159831 - DNA, 22 bp, Artificial Sequence
  chemically synthesized
aaataaggcaagaatgctcact

SEQ ID NO: 159832 - DNA, 22 bp, Artificial Sequence
  chemically synthesized
actttcattgccattatttaac

SEQ ID NO: 159833 - DNA, 22 bp, Artificial Sequence
  chemically synthesized
tcattgccattatttaacataa

SEQ ID NO: 159834 - DNA, 22 bp, Artificial Sequence
  chemically synthesized
cattgccattatttaacataat

SEQ ID NO: 159835 - DNA, 22 bp, Artificial Sequence
  chemically synthesized
attgccattatttaacataata

SEQ ID NO: 159836 - DNA, 22 bp, Artificial Sequence
  chemically synthesized
ccattatttaacataatattgg

SEQ ID NO: 159837 - DNA, 22 bp, Artificial Sequence
  chemically synthesized
tttaacataatattggaagtct

SEQ ID NO: 159838 - DNA, 22 bp, Artificial Sequence
  chemically synthesized
aacataatattggaagtcttgg

SEQ ID NO: 159839 - DNA, 22 bp, Artificial Sequence
  chemically synthesized
acataatattggaagtcttgga

SEQ ID NO: 159840 - DNA, 22 bp, Artificial Sequence
  chemically synthesized
gaagtcttggaaagagaaattc

SEQ ID NO: 159841 - DNA, 22 bp, Artificial Sequence
  chemically synthesized
ggaaagagaaattcaggaagag

SEQ ID NO: 159842 - DNA, 22 bp, Artificial Sequence
  chemically synthesized
gaaagagaaattcaggaagaga

SEQ ID NO: 159843 - DNA, 22 bp, Artificial Sequence
  chemically synthesized
aggaagagaaagaaagtgcatc

SEQ ID NO: 159844 - DNA, 22 bp, Artificial Sequence
  chemically synthesized
gaaaggaagaagttaaattagc

SEQ ID NO: 159845 - DNA, 22 bp, Artificial Sequence
  chemically synthesized
aattagcctagtttgtagatga

SEQ ID NO: 159846 - DNA, 22 bp, Artificial Sequence
  chemically synthesized
gcctagtttgtagatgacatga

SEQ ID NO: 159847 - DNA, 22 bp, Artificial Sequence
  chemically synthesized
gtttgtagatgacatgatctta

SEQ ID NO: 159848 - DNA, 22 bp, Artificial Sequence
  chemically synthesized
gtagatgacatgatcttatact

SEQ ID NO: 159849 - DNA, 22 bp, Artificial Sequence
  chemically synthesized
tagatgacatgatcttatactt

SEQ ID NO: 159850 - DNA, 22 bp, Artificial Sequence
  chemically synthesized
atacttagaaaaaacctaaaaa

SEQ ID NO: 159851 - DNA, 22 bp, Artificial Sequence
  chemically synthesized
tacttagaaaaaacctaaaaac

SEQ ID NO: 159852 - DNA, 22 bp, Artificial Sequence
  chemically synthesized
agaaaaaacctaaaaacttcac

SEQ ID NO: 159853 - DNA, 22 bp, Artificial Sequence
  chemically synthesized
gaaaaaacctaaaaacttcact

SEQ ID NO: 159854 - DNA, 22 bp, Artificial Sequence
  chemically synthesized
aaaacttcactaaatactatta

SEQ ID NO: 159855 - DNA, 22 bp, Artificial Sequence
  chemically synthesized
cactaaatactattaaaacgat

SEQ ID NO: 159856 - DNA, 22 bp, Artificial Sequence
  chemically synthesized
actaaatactattaaaacgatt

SEQ ID NO: 159857 - DNA, 22 bp, Artificial Sequence
  chemically synthesized
aatactattaaaacgatttaaa

SEQ ID NO: 159858 - DNA, 22 bp, Artificial Sequence
  chemically synthesized
ttaaaacgatttaaaaaaatca

SEQ ID NO: 159859 - DNA, 22 bp, Artificial Sequence
  chemically synthesized
aaacgatttaaaaaaatcaata

SEQ ID NO: 159860 - DNA, 22 bp, Artificial Sequence
  chemically synthesized
aaaaaaatcaataaagttacag

SEQ ID NO: 159861 - DNA, 22 bp, Artificial Sequence
  chemically synthesized
aaaaaatcaataaagttacagg

SEQ ID NO: 159862 - DNA, 22 bp, Artificial Sequence
  chemically synthesized
caggatatgaaataaaaataca

SEQ ID NO: 159863 - DNA, 22 bp, Artificial Sequence
  chemically synthesized
catatataaaaagttatcaatc

SEQ ID NO: 159864 - DNA, 22 bp, Artificial Sequence
  chemically synthesized
atatataaaaagttatcaatct

SEQ ID NO: 159865 - DNA, 22 bp, Artificial Sequence
  chemically synthesized
tcaatctgcaaaaaaaatcaat

SEQ ID NO: 159866 - DNA, 22 bp, Artificial Sequence
  chemically synthesized
caaaaaaaatcaataaaacaat

SEQ ID NO: 159867 - DNA, 22 bp, Artificial Sequence
  chemically synthesized
atttacaatagcaataaaaata

SEQ ID NO: 159868 - DNA, 22 bp, Artificial Sequence
  chemically synthesized
tttacaatagcaataaaaatat

SEQ ID NO: 159869 - DNA, 22 bp, Artificial Sequence
  chemically synthesized
acaatagcaataaaaatataaa

SEQ ID NO: 159870 - DNA, 22 bp, Artificial Sequence
  chemically synthesized
caatagcaataaaaatataaaa

SEQ ID NO: 159871 - DNA, 22 bp, Artificial Sequence
  chemically synthesized
acccaagaagtaaaagatctct

SEQ ID NO: 159872 - DNA, 22 bp, Artificial Sequence
  chemically synthesized
tataagaaaaattataaaactc

SEQ ID NO: 159873 - DNA, 22 bp, Artificial Sequence
  chemically synthesized
taagaaaaattataaaactctg

SEQ ID NO: 159874 - DNA, 22 bp, Artificial Sequence
  chemically synthesized
taaaactctggtgaaagaaata

SEQ ID NO: 159875 - DNA, 22 bp, Artificial Sequence
  chemically synthesized
tggtgaaagaaatagaagaggg

SEQ ID NO: 159876 - DNA, 22 bp, Artificial Sequence
  chemically synthesized
gtgaaagaaatagaagagggca

SEQ ID NO: 159877 - DNA, 22 bp, Artificial Sequence
  chemically synthesized
catgctcatgaactagaagaat

SEQ ID NO: 159878 - DNA, 22 bp, Artificial Sequence
  chemically synthesized
atgaactagaagaattaatatt

SEQ ID NO: 159879 - DNA, 22 bp, Artificial Sequence
  chemically synthesized
gaagaattaatattaaaatgac

SEQ ID NO: 159880 - DNA, 22 bp, Artificial Sequence
  chemically synthesized
atattaaaatgacaatactacc

SEQ ID NO: 159881 - DNA, 22 bp, Artificial Sequence
  chemically synthesized
aaatgacaatactacccaaagc

SEQ ID NO: 159882 - DNA, 22 bp, Artificial Sequence
  chemically synthesized
cccaaagcaatgtacagattca

SEQ ID NO: 159883 - DNA, 22 bp, Artificial Sequence
  chemically synthesized
agtgcaatttctgtcaaaatac

SEQ ID NO: 159884 - DNA, 22 bp, Artificial Sequence
  chemically synthesized
ctgtcaaaataccaatggcatt

SEQ ID NO: 159885 - DNA, 22 bp, Artificial Sequence
  chemically synthesized
tgtcaaaataccaatggcattc

SEQ ID NO: 159886 - DNA, 22 bp, Artificial Sequence
  chemically synthesized
tcaaaataccaatggcattcac

SEQ ID NO: 159887 - DNA, 22 bp, Artificial Sequence
  chemically synthesized
acagaaatagaaaaacaatcct

SEQ ID NO: 159888 - DNA, 22 bp, Artificial Sequence
  chemically synthesized
atatttatatggaaccacaaaa

SEQ ID NO: 159889 - DNA, 22 bp, Artificial Sequence
  chemically synthesized
atatggaaccacaaaagatccc

SEQ ID NO: 159890 - DNA, 22 bp, Artificial Sequence
  chemically synthesized
tatggaaccacaaaagatcccc

SEQ ID NO: 159891 - DNA, 22 bp, Artificial Sequence
  chemically synthesized
aagcaatcctgagcaaaaagaa

SEQ ID NO: 159892 - DNA, 22 bp, Artificial Sequence
  chemically synthesized
agcaaaaagaacaaaaccaaag

SEQ ID NO: 159893 - DNA, 22 bp, Artificial Sequence
  chemically synthesized
tcacactatatgacttcaaaat

SEQ ID NO: 159894 - DNA, 22 bp, Artificial Sequence
  chemically synthesized
tatgacttcaaaatctactaca

SEQ ID NO: 159895 - DNA, 22 bp, Artificial Sequence
  chemically synthesized
caaaatctactacaaagctaca

SEQ ID NO: 159896 - DNA, 22 bp, Artificial Sequence
  chemically synthesized
aaaatctactacaaagctacag

SEQ ID NO: 159897 - DNA, 22 bp, Artificial Sequence
  chemically synthesized
ctacaaagctacagtagccaaa

SEQ ID NO: 159898 - DNA, 22 bp, Artificial Sequence
  chemically synthesized
caaagctacagtagccaaacag

SEQ ID NO: 159899 - DNA, 22 bp, Artificial Sequence
  chemically synthesized
cagtagccaaacagcacagtac

SEQ ID NO: 159900 - DNA, 22 bp, Artificial Sequence
  chemically synthesized
cataaagacagacatacagccc

SEQ ID NO: 159901 - DNA, 22 bp, Artificial Sequence
  chemically synthesized
aacaaccaagtcatctttaaca

SEQ ID NO: 159902 - DNA, 22 bp, Artificial Sequence
  chemically synthesized
acaaccaagtcatctttaacaa

SEQ ID NO: 159903 - DNA, 22 bp, Artificial Sequence
  chemically synthesized
taacaaaggcatcaagaacata

SEQ ID NO: 159904 - DNA, 22 bp, Artificial Sequence
  chemically synthesized
aacaaaggcatcaagaacataa

SEQ ID NO: 159905 - DNA, 22 bp, Artificial Sequence
  chemically synthesized
acaaaggcatcaagaacataaa

SEQ ID NO: 159906 - DNA, 22 bp, Artificial Sequence
  chemically synthesized
acacctgtaatcccagcacttt

SEQ ID NO: 159907 - DNA, 22 bp, Artificial Sequence
  chemically synthesized
taatcccagcactttgtgaggc

SEQ ID NO: 159908 - DNA, 22 bp, Artificial Sequence
  chemically synthesized
tgtgaggctgaggtggggggat

SEQ ID NO: 159909 - DNA, 22 bp, Artificial Sequence
  chemically synthesized
gtgaggctgaggtggggggatc

SEQ ID NO: 159910 - DNA, 22 bp, Artificial Sequence
  chemically synthesized
tgaggctgaggtggggggatca

SEQ ID NO: 159911 - DNA, 22 bp, Artificial Sequence
  chemically synthesized
aggtggggggatcacgaggtca

SEQ ID NO: 159912 - DNA, 22 bp, Artificial Sequence
  chemically synthesized
aagaccagcctgaccaacgtgg

SEQ ID NO: 159913 - DNA, 22 bp, Artificial Sequence
  chemically synthesized
accaacgtggtgacactccgtc

SEQ ID NO: 159914 - DNA, 22 bp, Artificial Sequence
  chemically synthesized
cgtctctactaaaaatacaaaa

SEQ ID NO: 159915 - DNA, 22 bp, Artificial Sequence
  chemically synthesized
tactaaaaatacaaaaattagc

SEQ ID NO: 159916 - DNA, 22 bp, Artificial Sequence
  chemically synthesized
ctaaaaatacaaaaattagcca

SEQ ID NO: 159917 - DNA, 22 bp, Artificial Sequence
  chemically synthesized
aaaatacaaaaattagccaggc

SEQ ID NO: 159918 - DNA, 22 bp, Artificial Sequence
  chemically synthesized
gccaggcatggtggggcgctcc

SEQ ID NO: 159919 - DNA, 22 bp, Artificial Sequence
  chemically synthesized
ctgtaatcccagatactcagga

SEQ ID NO: 159920 - DNA, 22 bp, Artificial Sequence
  chemically synthesized
taatcccagatactcaggaggc

SEQ ID NO: 159921 - DNA, 22 bp, Artificial Sequence
  chemically synthesized
aggaggctgaggcaggagaatc

SEQ ID NO: 159922 - DNA, 22 bp, Artificial Sequence
  chemically synthesized
aggcaggagaatcgcttgaacc

SEQ ID NO: 159923 - DNA, 22 bp, Artificial Sequence
  chemically synthesized
gaacctgggaggcagaagttgc

SEQ ID NO: 159924 - DNA, 22 bp, Artificial Sequence
  chemically synthesized
aacctgggaggcagaagttgca

SEQ ID NO: 159925 - DNA, 22 bp, Artificial Sequence
  chemically synthesized
ggaggcagaagttgcagtgatc

SEQ ID NO: 159926 - DNA, 22 bp, Artificial Sequence
  chemically synthesized
cagtgatccaagattgtgctgc

SEQ ID NO: 159927 - DNA, 22 bp, Artificial Sequence
  chemically synthesized
tgctgccactgcactccagcct

SEQ ID NO: 159928 - DNA, 22 bp, Artificial Sequence
  chemically synthesized
ccactgcactccagcctgggca

SEQ ID NO: 159929 - DNA, 22 bp, Artificial Sequence
  chemically synthesized
cactccagcctgggcaacagtg

SEQ ID NO: 159930 - DNA, 22 bp, Artificial Sequence
  chemically synthesized
cagcctgggcaacagtgagact

SEQ ID NO: 159931 - DNA, 22 bp, Artificial Sequence
  chemically synthesized
ggcaacagtgagactccatctc

SEQ ID NO: 159932 - DNA, 22 bp, Artificial Sequence
  chemically synthesized
catctcaaaaaaaaaaaaaaaa

SEQ ID NO: 159933 - DNA, 22 bp, Artificial Sequence
  chemically synthesized
aaaaaaaaaaaaaaaaaaggta

SEQ ID NO: 159934 - DNA, 22 bp, Artificial Sequence
  chemically synthesized
ttcaagaaacagtgctaggaaa

SEQ ID NO: 159935 - DNA, 22 bp, Artificial Sequence
  chemically synthesized
tcaagaaacagtgctaggaaaa

SEQ ID NO: 159936 - DNA, 22 bp, Artificial Sequence
  chemically synthesized
caagaaacagtgctaggaaaac

SEQ ID NO: 159937 - DNA, 22 bp, Artificial Sequence
  chemically synthesized
aagaaacagtgctaggaaaact

SEQ ID NO: 159938 - DNA, 22 bp, Artificial Sequence
  chemically synthesized
ggaaaactggatatccatttgc

SEQ ID NO: 159939 - DNA, 22 bp, Artificial Sequence
  chemically synthesized
gatatccatttgcaaaagagta

SEQ ID NO: 159940 - DNA, 22 bp, Artificial Sequence
  chemically synthesized
gcaaaagagtaaaatcggaccc

SEQ ID NO: 159941 - DNA, 22 bp, Artificial Sequence
  chemically synthesized
caaaagagtaaaatcggacccc

SEQ ID NO: 159942 - DNA, 22 bp, Artificial Sequence
  chemically synthesized
tctctcactatatacaaaaatc

SEQ ID NO: 159943 - DNA, 22 bp, Artificial Sequence
  chemically synthesized
tcactatatacaaaaatcaaat

SEQ ID NO: 159944 - DNA, 22 bp, Artificial Sequence
  chemically synthesized
actatatacaaaaatcaaatca

SEQ ID NO: 159945 - DNA, 22 bp, Artificial Sequence
  chemically synthesized
tatacaaaaatcaaatcaagat

SEQ ID NO: 159946 - DNA, 22 bp, Artificial Sequence
  chemically synthesized
aagacttgaatccaatacctga

SEQ ID NO: 159947 - DNA, 22 bp, Artificial Sequence
  chemically synthesized
gaatccaatacctgaaattatg

SEQ ID NO: 159948 - DNA, 22 bp, Artificial Sequence
  chemically synthesized
aatccaatacctgaaattatga

SEQ ID NO: 159949 - DNA, 22 bp, Artificial Sequence
  chemically synthesized
aaattatgaaactactggaaga

SEQ ID NO: 159950 - DNA, 22 bp, Artificial Sequence
  chemically synthesized
tgaaactactggaagaaaacag

SEQ ID NO: 159951 - DNA, 22 bp, Artificial Sequence
  chemically synthesized
ctggaagaaaacagtggggaaa

SEQ ID NO: 159952 - DNA, 22 bp, Artificial Sequence
  chemically synthesized
gaagaaaacagtggggaaaccc

SEQ ID NO: 159953 - DNA, 22 bp, Artificial Sequence
  chemically synthesized
cagggcattcattgatttgggc

SEQ ID NO: 159954 - DNA, 22 bp, Artificial Sequence
  chemically synthesized
attgatttgggcaaatactgtc

SEQ ID NO: 159955 - DNA, 22 bp, Artificial Sequence
  chemically synthesized
atttgggcaaatactgtctatg

SEQ ID NO: 159956 - DNA, 22 bp, Artificial Sequence
  chemically synthesized
gggcaaatactgtctatgagac

SEQ ID NO: 159957 - DNA, 22 bp, Artificial Sequence
  chemically synthesized
ggcaaatactgtctatgagact

SEQ ID NO: 159958 - DNA, 22 bp, Artificial Sequence
  chemically synthesized
tctatgagacttcaaaagcaca

SEQ ID NO: 159959 - DNA, 22 bp, Artificial Sequence
  chemically synthesized
tgagacttcaaaagcacaaata

SEQ ID NO: 159960 - DNA, 22 bp, Artificial Sequence
  chemically synthesized
caaaagcacaaataaccaaaac

SEQ ID NO: 159961 - DNA, 22 bp, Artificial Sequence
  chemically synthesized
aaaagcacaaataaccaaaaca

SEQ ID NO: 159962 - DNA, 22 bp, Artificial Sequence
  chemically synthesized
ggattgtttgaagctctgcaca

SEQ ID NO: 159963 - DNA, 22 bp, Artificial Sequence
  chemically synthesized
tttgaagctctgcacagcaaag

SEQ ID NO: 159964 - DNA, 22 bp, Artificial Sequence
  chemically synthesized
gaagctctgcacagcaaagaaa

SEQ ID NO: 159965 - DNA, 22 bp, Artificial Sequence
  chemically synthesized
aagctctgcacagcaaagaaaa

SEQ ID NO: 159966 - DNA, 22 bp, Artificial Sequence
  chemically synthesized
tgcacagcaaagaaaataataa

SEQ ID NO: 159967 - DNA, 22 bp, Artificial Sequence
  chemically synthesized
cacagcaaagaaaataataaag

SEQ ID NO: 159968 - DNA, 22 bp, Artificial Sequence
  chemically synthesized
gcaaactatatattttacaagg

SEQ ID NO: 159969 - DNA, 22 bp, Artificial Sequence
  chemically synthesized
caaactatatattttacaagga

SEQ ID NO: 159970 - DNA, 22 bp, Artificial Sequence
  chemically synthesized
tatattttacaaggaattgata

SEQ ID NO: 159971 - DNA, 22 bp, Artificial Sequence
  chemically synthesized
tacaaggaattgataaccagaa

SEQ ID NO: 159972 - DNA, 22 bp, Artificial Sequence
  chemically synthesized
acaaggaattgataaccagaat

SEQ ID NO: 159973 - DNA, 22 bp, Artificial Sequence
  chemically synthesized
caaggaattgataaccagaata

SEQ ID NO: 159974 - DNA, 22 bp, Artificial Sequence
  chemically synthesized
ataaccagaatatgcaagaaac

SEQ ID NO: 159975 - DNA, 22 bp, Artificial Sequence
  chemically synthesized
aagcaactcaacagaaaataaa

SEQ ID NO: 159976 - DNA, 22 bp, Artificial Sequence
  chemically synthesized
aacagaaaataaataaataaat

SEQ ID NO: 159977 - DNA, 22 bp, Artificial Sequence
  chemically synthesized
aatagatatttctcaaaagaag

SEQ ID NO: 159978 - DNA, 22 bp, Artificial Sequence
  chemically synthesized
ctcaaaagaagccatacaaatg

SEQ ID NO: 159979 - DNA, 22 bp, Artificial Sequence
  chemically synthesized
tcaaaagaagccatacaaatgg

SEQ ID NO: 159980 - DNA, 22 bp, Artificial Sequence
  chemically synthesized
aaaagaagccatacaaatggcc

SEQ ID NO: 159981 - DNA, 22 bp, Artificial Sequence
  chemically synthesized
gaaaaaatgttcaatatcacta

SEQ ID NO: 159982 - DNA, 22 bp, Artificial Sequence
  chemically synthesized
aaaaaatgttcaatatcactaa

SEQ ID NO: 159983 - DNA, 22 bp, Artificial Sequence
  chemically synthesized
aatatcactaatcaccagataa

SEQ ID NO: 159984 - DNA, 22 bp, Artificial Sequence
  chemically synthesized
atcaccagataaatcaaaacca

SEQ ID NO: 159985 - DNA, 22 bp, Artificial Sequence
  chemically synthesized
accttagttaaaatagcttata

SEQ ID NO: 159986 - DNA, 22 bp, Artificial Sequence
  chemically synthesized
agttaaaatagcttataacaaa

SEQ ID NO: 159987 - DNA, 22 bp, Artificial Sequence
  chemically synthesized
gttaaaatagcttataacaaaa

SEQ ID NO: 159988 - DNA, 22 bp, Artificial Sequence
  chemically synthesized
aaatagcttataacaaaacaaa

SEQ ID NO: 159989 - DNA, 22 bp, Artificial Sequence
  chemically synthesized
ataacaaaacaaaaggaaataa

SEQ ID NO: 159990 - DNA, 22 bp, Artificial Sequence
  chemically synthesized
taacaaaacaaaaggaaataac

SEQ ID NO: 159991 - DNA, 22 bp, Artificial Sequence
  chemically synthesized
gtgtggatgtggacaaagggaa

SEQ ID NO: 159992 - DNA, 22 bp, Artificial Sequence
  chemically synthesized
tgtggatgtggacaaagggaaa

SEQ ID NO: 159993 - DNA, 22 bp, Artificial Sequence
  chemically synthesized
ttacactgttggtgggagtaca

SEQ ID NO: 159994 - DNA, 22 bp, Artificial Sequence
  chemically synthesized
acactgttggtgggagtacaaa

SEQ ID NO: 159995 - DNA, 22 bp, Artificial Sequence
  chemically synthesized
cactgttggtgggagtacaaat

SEQ ID NO: 159996 - DNA, 22 bp, Artificial Sequence
  chemically synthesized
ttggtgggagtacaaattggta

SEQ ID NO: 159997 - DNA, 22 bp, Artificial Sequence
  chemically synthesized
gtgggagtacaaattggtacag

SEQ ID NO: 159998 - DNA, 22 bp, Artificial Sequence
  chemically synthesized
gtacagcaattatgaaggacag

SEQ ID NO: 159999 - DNA, 22 bp, Artificial Sequence
  chemically synthesized
tgaaggacagtatggagatttg

SEQ ID NO: 160000 - DNA, 22 bp, Artificial Sequence
  chemically synthesized
gtcaaaaatgtaaagtagaact

SEQ ID NO: 160001 - DNA, 22 bp, Artificial Sequence
  chemically synthesized
tcaaaaatgtaaagtagaacta

SEQ ID NO: 160002 - DNA, 22 bp, Artificial Sequence
  chemically synthesized
ccatatgatccagcaatatcac

SEQ ID NO: 160003 - DNA, 22 bp, Artificial Sequence
  chemically synthesized
ctaggtatatacccttaaaaga

SEQ ID NO: 160004 - DNA, 22 bp, Artificial Sequence
  chemically synthesized
ggtatatacccttaaaagaata

SEQ ID NO: 160005 - DNA, 22 bp, Artificial Sequence
  chemically synthesized
aaaagaataaattagtatgtcg

SEQ ID NO: 160006 - DNA, 22 bp, Artificial Sequence
  chemically synthesized
aaagaataaattagtatgtcga

SEQ ID NO: 160007 - DNA, 22 bp, Artificial Sequence
  chemically synthesized
gtatgtcgaagatatatcagta

SEQ ID NO: 160008 - DNA, 22 bp, Artificial Sequence
  chemically synthesized
ccatctttattatagcactatt

SEQ ID NO: 160009 - DNA, 22 bp, Artificial Sequence
  chemically synthesized
tattatagcactattcacaaac

SEQ ID NO: 160010 - DNA, 22 bp, Artificial Sequence
  chemically synthesized
attatagcactattcacaaacg

SEQ ID NO: 160011 - DNA, 22 bp, Artificial Sequence
  chemically synthesized
ttatagcactattcacaaacgc

SEQ ID NO: 160012 - DNA, 22 bp, Artificial Sequence
  chemically synthesized
tagcactattcacaaacgccaa

SEQ ID NO: 160013 - DNA, 22 bp, Artificial Sequence
  chemically synthesized
ttcacaaacgccaagatttgaa

SEQ ID NO: 160014 - DNA, 22 bp, Artificial Sequence
  chemically synthesized
acaaacgccaagatttgaaatc

SEQ ID NO: 160015 - DNA, 22 bp, Artificial Sequence
  chemically synthesized
gaaatcaactgatgtattcgtc

SEQ ID NO: 160016 - DNA, 22 bp, Artificial Sequence
  chemically synthesized
aaatcaactgatgtattcgtca

SEQ ID NO: 160017 - DNA, 22 bp, Artificial Sequence
  chemically synthesized
atgtattcgtcaacagataaat

SEQ ID NO: 160018 - DNA, 22 bp, Artificial Sequence
  chemically synthesized
gtcaacagataaatggataaag

SEQ ID NO: 160019 - DNA, 22 bp, Artificial Sequence
  chemically synthesized
ttcaaccataaaaaagaatgaa

SEQ ID NO: 160020 - DNA, 22 bp, Artificial Sequence
  chemically synthesized
aaccataaaaaagaatgaaata

SEQ ID NO: 160021 - DNA, 22 bp, Artificial Sequence
  chemically synthesized
tcaattacagtaacataaatgg

SEQ ID NO: 160022 - DNA, 22 bp, Artificial Sequence
  chemically synthesized
cagtaacataaatggtactgaa

SEQ ID NO: 160023 - DNA, 22 bp, Artificial Sequence
  chemically synthesized
aaagcaattacgttaagtgaaa

SEQ ID NO: 160024 - DNA, 22 bp, Artificial Sequence
  chemically synthesized
cgttaagtgaaataagccaagc

SEQ ID NO: 160025 - DNA, 22 bp, Artificial Sequence
  chemically synthesized
agtgaaataagccaagcacaga

SEQ ID NO: 160026 - DNA, 22 bp, Artificial Sequence
  chemically synthesized
taactcgtgtggaagttaaaaa

SEQ ID NO: 160027 - DNA, 22 bp, Artificial Sequence
  chemically synthesized
actcgtgtggaagttaaaaacg

SEQ ID NO: 160028 - DNA, 22 bp, Artificial Sequence
  chemically synthesized
gtgtggaagttaaaaacgtgga

SEQ ID NO: 160029 - DNA, 22 bp, Artificial Sequence
  chemically synthesized
aaaacgtggatcttatgaagac

SEQ ID NO: 160030 - DNA, 22 bp, Artificial Sequence
  chemically synthesized
atgaagacagagagtagattgg

SEQ ID NO: 160031 - DNA, 22 bp, Artificial Sequence
  chemically synthesized
tgaagacagagagtagattggt

SEQ ID NO: 160032 - DNA, 22 bp, Artificial Sequence
  chemically synthesized
gtagttaccggcggcgggaggg

SEQ ID NO: 160033 - DNA, 22 bp, Artificial Sequence
  chemically synthesized
ccggcggcgggagggaagaaag

SEQ ID NO: 160034 - DNA, 22 bp, Artificial Sequence
  chemically synthesized
ccactctctctctctccctctg

SEQ ID NO: 160035 - DNA, 22 bp, Artificial Sequence
  chemically synthesized
tctctctctccctctgtgtgta

SEQ ID NO: 160036 - DNA, 22 bp, Artificial Sequence
  chemically synthesized
tctctctccctctgtgtgtatg

SEQ ID NO: 160037 - DNA, 22 bp, Artificial Sequence
  chemically synthesized
tctctccctctgtgtgtatgtg

SEQ ID NO: 160038 - DNA, 22 bp, Artificial Sequence
  chemically synthesized
tctccctctgtgtgtatgtgtg

SEQ ID NO: 160039 - DNA, 22 bp, Artificial Sequence
  chemically synthesized
tccctctgtgtgtatgtgtgca

SEQ ID NO: 160040 - DNA, 22 bp, Artificial Sequence
  chemically synthesized
cctctgtgtgtatgtgtgcata

SEQ ID NO: 160041 - DNA, 22 bp, Artificial Sequence
  chemically synthesized
tgtgtgtatgtgtgcatatgta

SEQ ID NO: 160042 - DNA, 22 bp, Artificial Sequence
  chemically synthesized
tgtgtatgtgtgcatatgtatg

SEQ ID NO: 160043 - DNA, 22 bp, Artificial Sequence
  chemically synthesized
gtatatatatgtatgtatgtat

SEQ ID NO: 160044 - DNA, 22 bp, Artificial Sequence
  chemically synthesized
tatatatatgtatgtatgtatt

SEQ ID NO: 160045 - DNA, 22 bp, Artificial Sequence
  chemically synthesized
ccactgaaccgtacactcaaaa

SEQ ID NO: 160046 - DNA, 22 bp, Artificial Sequence
  chemically synthesized
aaccgtacactcaaaaatggta

SEQ ID NO: 160047 - DNA, 22 bp, Artificial Sequence
  chemically synthesized
aaaaatggtaaagatgggctgg

SEQ ID NO: 160048 - DNA, 22 bp, Artificial Sequence
  chemically synthesized
ggtgcggtggccaatgcctgta

SEQ ID NO: 160049 - DNA, 22 bp, Artificial Sequence
  chemically synthesized
taatctcagcactttgggaggc

SEQ ID NO: 160050 - DNA, 22 bp, Artificial Sequence
  chemically synthesized
agcactttgggaggccaaggca

SEQ ID NO: 160051 - DNA, 22 bp, Artificial Sequence
  chemically synthesized
tgggaggccaaggcaggtggat

SEQ ID NO: 160052 - DNA, 22 bp, Artificial Sequence
  chemically synthesized
gggaggccaaggcaggtggatc

SEQ ID NO: 160053 - DNA, 22 bp, Artificial Sequence
  chemically synthesized
ggaggccaaggcaggtggatca

SEQ ID NO: 160054 - DNA, 22 bp, Artificial Sequence
  chemically synthesized
accaacatggtgaaaccctgtc

SEQ ID NO: 160055 - DNA, 22 bp, Artificial Sequence
  chemically synthesized
tctctactaaaaatacaaaaaa

SEQ ID NO: 160056 - DNA, 22 bp, Artificial Sequence
  chemically synthesized
tactaaaaatacaaaaaattag

SEQ ID NO: 160057 - DNA, 22 bp, Artificial Sequence
  chemically synthesized
ctaaaaatacaaaaaattagcc

SEQ ID NO: 160058 - DNA, 22 bp, Artificial Sequence
  chemically synthesized
aaaatacaaaaaattagccagg

SEQ ID NO: 160059 - DNA, 22 bp, Artificial Sequence
  chemically synthesized
gccaggcgtggtggcaggcgcc

SEQ ID NO: 160060 - DNA, 22 bp, Artificial Sequence
  chemically synthesized
taatcccacctacttgggaggc

SEQ ID NO: 160061 - DNA, 22 bp, Artificial Sequence
  chemically synthesized
cttgggaggcttgggcaggaga

SEQ ID NO: 160062 - DNA, 22 bp, Artificial Sequence
  chemically synthesized
gggaggcttgggcaggagaatc

SEQ ID NO: 160063 - DNA, 22 bp, Artificial Sequence
  chemically synthesized
ggaggcttgggcaggagaatcg

SEQ ID NO: 160064 - DNA, 22 bp, Artificial Sequence
  chemically synthesized
gggcaggagaatcgcttgaacc

SEQ ID NO: 160065 - DNA, 22 bp, Artificial Sequence
  chemically synthesized
ggcaggagaatcgcttgaacct

SEQ ID NO: 160066 - DNA, 22 bp, Artificial Sequence
  chemically synthesized
gaacctggtgggggcggaggtt

SEQ ID NO: 160067 - DNA, 22 bp, Artificial Sequence
  chemically synthesized
aacctggtgggggcggaggttg

SEQ ID NO: 160068 - DNA, 22 bp, Artificial Sequence
  chemically synthesized
gtgggggcggaggttgcagtga

SEQ ID NO: 160069 - DNA, 22 bp, Artificial Sequence
  chemically synthesized
cagtgagccaagatcctaccac

SEQ ID NO: 160070 - DNA, 22 bp, Artificial Sequence
  chemically synthesized
ccactgcactccagcctggatg

SEQ ID NO: 160071 - DNA, 22 bp, Artificial Sequence
  chemically synthesized
cactccagcctggatgacggag

SEQ ID NO: 160072 - DNA, 22 bp, Artificial Sequence
  chemically synthesized
cagcctggatgacggagcgaga

SEQ ID NO: 160073 - DNA, 22 bp, Artificial Sequence
  chemically synthesized
gatgacggagcgagactccgtc

SEQ ID NO: 160074 - DNA, 22 bp, Artificial Sequence
  chemically synthesized
cgtctcaaggaaaaaaaaaaag

SEQ ID NO: 160075 - DNA, 22 bp, Artificial Sequence
  chemically synthesized
aaggaaaaaaaaaaagtaaaga

SEQ ID NO: 160076 - DNA, 22 bp, Artificial Sequence
  chemically synthesized
cgtatgtatattttaccttaat

SEQ ID NO: 160077 - DNA, 22 bp, Artificial Sequence
  chemically synthesized
taccttaataaaaataaattta

SEQ ID NO: 160078 - DNA, 22 bp, Artificial Sequence
  chemically synthesized
accttaataaaaataaatttaa

SEQ ID NO: 160079 - DNA, 22 bp, Artificial Sequence
  chemically synthesized
ccttaataaaaataaatttaaa

SEQ ID NO: 160080 - DNA, 22 bp, Artificial Sequence
  chemically synthesized
aataaaaataaatttaaaaaat

SEQ ID NO: 160081 - DNA, 22 bp, Artificial Sequence
  chemically synthesized
ataaaaataaatttaaaaaata

SEQ ID NO: 160082 - DNA, 22 bp, Artificial Sequence
  chemically synthesized
aaaaaatattcagtaggccggg

SEQ ID NO: 160083 - DNA, 22 bp, Artificial Sequence
  chemically synthesized
aaaaatattcagtaggccgggt

SEQ ID NO: 160084 - DNA, 22 bp, Artificial Sequence
  chemically synthesized
agtaggccgggtgcagtggctc

SEQ ID NO: 160085 - DNA, 22 bp, Artificial Sequence
  chemically synthesized
acgcctgtgatcccagcacttt

SEQ ID NO: 160086 - DNA, 22 bp, Artificial Sequence
  chemically synthesized
tgatcccagcactttgggaggc

SEQ ID NO: 160087 - DNA, 22 bp, Artificial Sequence
  chemically synthesized
tgggaggcggaggcgggtggat

SEQ ID NO: 160088 - DNA, 22 bp, Artificial Sequence
  chemically synthesized
gggaggcggaggcgggtggatc

SEQ ID NO: 160089 - DNA, 22 bp, Artificial Sequence
  chemically synthesized
ggaggcggaggcgggtggatca

SEQ ID NO: 160090 - DNA, 22 bp, Artificial Sequence
  chemically synthesized
gctaacacagtgaaaccccgtc

SEQ ID NO: 160091 - DNA, 22 bp, Artificial Sequence
  chemically synthesized
acacagtgaaaccccgtctcta

SEQ ID NO: 160092 - DNA, 22 bp, Artificial Sequence
  chemically synthesized
tactaaaaaaatacaaaaaatt

SEQ ID NO: 160093 - DNA, 22 bp, Artificial Sequence
  chemically synthesized
ctaaaaaaatacaaaaaattag

SEQ ID NO: 160094 - DNA, 22 bp, Artificial Sequence
  chemically synthesized
aaaaaatacaaaaaattagccg

SEQ ID NO: 160095 - DNA, 22 bp, Artificial Sequence
  chemically synthesized
gccgggcttggtggcgggtgcc

SEQ ID NO: 160096 - DNA, 22 bp, Artificial Sequence
  chemically synthesized
ggtggcgggtgcctgtagtccc

SEQ ID NO: 160097 - DNA, 22 bp, Artificial Sequence
  chemically synthesized
gtggcgggtgcctgtagtccca

SEQ ID NO: 160098 - DNA, 22 bp, Artificial Sequence
  chemically synthesized
tagtcccagctactatggaggc

SEQ ID NO: 160099 - DNA, 22 bp, Artificial Sequence
  chemically synthesized
ctatggaggctgaggcgggaga

SEQ ID NO: 160100 - DNA, 22 bp, Artificial Sequence
  chemically synthesized
tggaggctgaggcgggagaatg

SEQ ID NO: 160101 - DNA, 22 bp, Artificial Sequence
  chemically synthesized
aggcgggagaatggcgtgaacg

SEQ ID NO: 160102 - DNA, 22 bp, Artificial Sequence
  chemically synthesized
gcagtgagcagagatcaggggc

SEQ ID NO: 160103 - DNA, 22 bp, Artificial Sequence
  chemically synthesized
cagtgagcagagatcaggggcc

SEQ ID NO: 160104 - DNA, 22 bp, Artificial Sequence
  chemically synthesized
cactccagcctgggcgacagag

SEQ ID NO: 160105 - DNA, 22 bp, Artificial Sequence
  chemically synthesized
cagcctgggcgacagagagaga

SEQ ID NO: 160106 - DNA, 22 bp, Artificial Sequence
  chemically synthesized
ggcgacagagagagactctgtc

SEQ ID NO: 160107 - DNA, 22 bp, Artificial Sequence
  chemically synthesized
tgtctcaaaaaaaagaaaaaaa

SEQ ID NO: 160108 - DNA, 22 bp, Artificial Sequence
  chemically synthesized
tctcaaaaaaaagaaaaaaaaa

SEQ ID NO: 160109 - DNA, 22 bp, Artificial Sequence
  chemically synthesized
aaaaaaaagaaaaaaaaaattt

SEQ ID NO: 160110 - DNA, 22 bp, Artificial Sequence
  chemically synthesized
agtagactagctaaaaaaatcc

SEQ ID NO: 160111 - DNA, 22 bp, Artificial Sequence
  chemically synthesized
gtagactagctaaaaaaatcca

SEQ ID NO: 160112 - DNA, 22 bp, Artificial Sequence
  chemically synthesized
gctaaaaaaatccagagatagt

SEQ ID NO: 160113 - DNA, 22 bp, Artificial Sequence
  chemically synthesized
aaaaaatccagagatagttatt

SEQ ID NO: 160114 - DNA, 22 bp, Artificial Sequence
  chemically synthesized
ttgatgcatatgtaaaagtctt

SEQ ID NO: 160115 - DNA, 22 bp, Artificial Sequence
  chemically synthesized
atgcatatgtaaaagtcttcca

SEQ ID NO: 160116 - DNA, 22 bp, Artificial Sequence
  chemically synthesized
ccaatatttacaagtacaatga

SEQ ID NO: 160117 - DNA, 22 bp, Artificial Sequence
  chemically synthesized
caatatttacaagtacaatgaa

SEQ ID NO: 160118 - DNA, 22 bp, Artificial Sequence
  chemically synthesized
acaagtacaatgaaaaaaaaat

SEQ ID NO: 160119 - DNA, 22 bp, Artificial Sequence
  chemically synthesized
caagtacaatgaaaaaaaaata

SEQ ID NO: 160120 - DNA, 22 bp, Artificial Sequence
  chemically synthesized
gaattaagtgtagaactcattg

SEQ ID NO: 160121 - DNA, 22 bp, Artificial Sequence
  chemically synthesized
aattaagtgtagaactcattga

SEQ ID NO: 160122 - DNA, 22 bp, Artificial Sequence
  chemically synthesized
agtgtagaactcattgacaatg

SEQ ID NO: 160123 - DNA, 22 bp, Artificial Sequence
  chemically synthesized
attgacaatgtttcaaaggatg

SEQ ID NO: 160124 - DNA, 22 bp, Artificial Sequence
  chemically synthesized
acaatgtttcaaaggatgtgag

SEQ ID NO: 160125 - DNA, 22 bp, Artificial Sequence
  chemically synthesized
caaaggatgtgagggataaact

SEQ ID NO: 160126 - DNA, 22 bp, Artificial Sequence
  chemically synthesized
aaaggatgtgagggataaacta

SEQ ID NO: 160127 - DNA, 22 bp, Artificial Sequence
  chemically synthesized
aaatttgggcagtacatgctgt

SEQ ID NO: 160128 - DNA, 22 bp, Artificial Sequence
  chemically synthesized
gggcagtacatgctgttcctgt

SEQ ID NO: 160129 - DNA, 22 bp, Artificial Sequence
  chemically synthesized
ggcagtacatgctgttcctgtg

SEQ ID NO: 160130 - DNA, 22 bp, Artificial Sequence
  chemically synthesized
ttcctgtgtacttggaacagag

SEQ ID NO: 160131 - DNA, 22 bp, Artificial Sequence
  chemically synthesized
ctgtgtacttggaacagaggga

SEQ ID NO: 160132 - DNA, 22 bp, Artificial Sequence
  chemically synthesized
tgtacttggaacagagggagaa

SEQ ID NO: 160133 - DNA, 22 bp, Artificial Sequence
  chemically synthesized
ggaacagagggagaaaatctgg

SEQ ID NO: 160134 - DNA, 22 bp, Artificial Sequence
  chemically synthesized
gaacagagggagaaaatctggg

SEQ ID NO: 160135 - DNA, 22 bp, Artificial Sequence
  chemically synthesized
ggctggaaatattgttatagga

SEQ ID NO: 160136 - DNA, 22 bp, Artificial Sequence
  chemically synthesized
gaaatattgttataggagttag

SEQ ID NO: 160137 - DNA, 22 bp, Artificial Sequence
  chemically synthesized
ttataggagttagcacatgaag

SEQ ID NO: 160138 - DNA, 22 bp, Artificial Sequence
  chemically synthesized
taggagttagcacatgaaggtg

SEQ ID NO: 160139 - DNA, 22 bp, Artificial Sequence
  chemically synthesized
gcacatgaaggtgacaactaaa

SEQ ID NO: 160140 - DNA, 22 bp, Artificial Sequence
  chemically synthesized
aattatttggagtagatggagt

SEQ ID NO: 160141 - DNA, 22 bp, Artificial Sequence
  chemically synthesized
tttggagtagatggagtcacca

SEQ ID NO: 160142 - DNA, 22 bp, Artificial Sequence
  chemically synthesized
ggagtagatggagtcaccagca

SEQ ID NO: 160143 - DNA, 22 bp, Artificial Sequence
  chemically synthesized
gagtagatggagtcaccagcac

SEQ ID NO: 160144 - DNA, 22 bp, Artificial Sequence
  chemically synthesized
tagaatgaaatgacccaagata

SEQ ID NO: 160145 - DNA, 22 bp, Artificial Sequence
  chemically synthesized
agaatgaaatgacccaagatag

SEQ ID NO: 160146 - DNA, 22 bp, Artificial Sequence
  chemically synthesized
gaatgaaatgacccaagataga

SEQ ID NO: 160147 - DNA, 22 bp, Artificial Sequence
  chemically synthesized
tggagagcccccaaatttaaat

SEQ ID NO: 160148 - DNA, 22 bp, Artificial Sequence
  chemically synthesized
ggagagcccccaaatttaaata

SEQ ID NO: 160149 - DNA, 22 bp, Artificial Sequence
  chemically synthesized
gagagcccccaaatttaaataa

SEQ ID NO: 160150 - DNA, 22 bp, Artificial Sequence
  chemically synthesized
aaataaaatcagtataagagaa

SEQ ID NO: 160151 - DNA, 22 bp, Artificial Sequence
  chemically synthesized
aataaaatcagtataagagaag

SEQ ID NO: 160152 - DNA, 22 bp, Artificial Sequence
  chemically synthesized
gtctaaattgtttcttagtgac

SEQ ID NO: 160153 - DNA, 22 bp, Artificial Sequence
  chemically synthesized
aattgtttcttagtgacaaaag

SEQ ID NO: 160154 - DNA, 22 bp, Artificial Sequence
  chemically synthesized
tttcttagtgacaaaagaataa

SEQ ID NO: 160155 - DNA, 22 bp, Artificial Sequence
  chemically synthesized
cttagtgacaaaagaataacct

SEQ ID NO: 160156 - DNA, 22 bp, Artificial Sequence
  chemically synthesized
ttagtgacaaaagaataacctg

SEQ ID NO: 160157 - DNA, 22 bp, Artificial Sequence
  chemically synthesized
agtgacaaaagaataacctgaa

SEQ ID NO: 160158 - DNA, 22 bp, Artificial Sequence
  chemically synthesized
gtgacaaaagaataacctgaat

SEQ ID NO: 160159 - DNA, 22 bp, Artificial Sequence
  chemically synthesized
aatattagattagctgcctata

SEQ ID NO: 160160 - DNA, 22 bp, Artificial Sequence
  chemically synthesized
gattagctgcctatatgctctc

SEQ ID NO: 160161 - DNA, 22 bp, Artificial Sequence
  chemically synthesized
gctgcctatatgctctctgaat

SEQ ID NO: 160162 - DNA, 22 bp, Artificial Sequence
  chemically synthesized
cctatatgctctctgaatcaat

SEQ ID NO: 160163 - DNA, 22 bp, Artificial Sequence
  chemically synthesized
tatgctctctgaatcaatttca

SEQ ID NO: 160164 - DNA, 22 bp, Artificial Sequence
  chemically synthesized
tctgaatcaatttcattcaaca

SEQ ID NO: 160165 - DNA, 22 bp, Artificial Sequence
  chemically synthesized
tgaatcaatttcattcaacatg

SEQ ID NO: 160166 - DNA, 22 bp, Artificial Sequence
  chemically synthesized
aatcaatttcattcaacatgca

SEQ ID NO: 160167 - DNA, 22 bp, Artificial Sequence
  chemically synthesized
cattcaacatgcaacagtacta

SEQ ID NO: 160168 - DNA, 22 bp, Artificial Sequence
  chemically synthesized
attcaacatgcaacagtactat

SEQ ID NO: 160169 - DNA, 22 bp, Artificial Sequence
  chemically synthesized
aacatgcaacagtactattgtt

SEQ ID NO: 160170 - DNA, 22 bp, Artificial Sequence
  chemically synthesized
ttgttttatgctccttcacaga

SEQ ID NO: 160171 - DNA, 22 bp, Artificial Sequence
  chemically synthesized
ttttatgctccttcacagagga

SEQ ID NO: 160172 - DNA, 22 bp, Artificial Sequence
  chemically synthesized
tatgctccttcacagaggaaat

SEQ ID NO: 160173 - DNA, 22 bp, Artificial Sequence
  chemically synthesized
atgctccttcacagaggaaatt

SEQ ID NO: 160174 - DNA, 22 bp, Artificial Sequence
  chemically synthesized
tgctccttcacagaggaaattc

SEQ ID NO: 160175 - DNA, 22 bp, Artificial Sequence
  chemically synthesized
cttcacagaggaaattctggaa

SEQ ID NO: 160176 - DNA, 22 bp, Artificial Sequence
  chemically synthesized
cacagaggaaattctggaaaga

SEQ ID NO: 160177 - DNA, 22 bp, Artificial Sequence
  chemically synthesized
acagaggaaattctggaaagag

SEQ ID NO: 160178 - DNA, 22 bp, Artificial Sequence
  chemically synthesized
tggaaagagcacatggggttcc

SEQ ID NO: 160179 - DNA, 22 bp, Artificial Sequence
  chemically synthesized
gaaagagcacatggggttcctt

SEQ ID NO: 160180 - DNA, 22 bp, Artificial Sequence
  chemically synthesized
cttgccttttcatctgtattcc

SEQ ID NO: 160181 - DNA, 22 bp, Artificial Sequence
  chemically synthesized
gccttttcatctgtattccttg

SEQ ID NO: 160182 - DNA, 22 bp, Artificial Sequence
  chemically synthesized
ccttttcatctgtattccttgt

SEQ ID NO: 160183 - DNA, 22 bp, Artificial Sequence
  chemically synthesized
ttcatctgtattccttgttctc

SEQ ID NO: 160184 - DNA, 22 bp, Artificial Sequence
  chemically synthesized
tcatctgtattccttgttctcc

SEQ ID NO: 160185 - DNA, 22 bp, Artificial Sequence
  chemically synthesized
catctgtattccttgttctcct

SEQ ID NO: 160186 - DNA, 22 bp, Artificial Sequence
  chemically synthesized
atctgtattccttgttctcctg

SEQ ID NO: 160187 - DNA, 22 bp, Artificial Sequence
  chemically synthesized
tattccttgttctcctggaaat

SEQ ID NO: 160188 - DNA, 22 bp, Artificial Sequence
  chemically synthesized
cttgttctcctggaaatccatt

SEQ ID NO: 160189 - DNA, 22 bp, Artificial Sequence
  chemically synthesized
gttctcctggaaatccattata

SEQ ID NO: 160190 - DNA, 22 bp, Artificial Sequence
  chemically synthesized
ttctcctggaaatccattataa

SEQ ID NO: 160191 - DNA, 22 bp, Artificial Sequence
  chemically synthesized
tcctggaaatccattataaata

SEQ ID NO: 160192 - DNA, 22 bp, Artificial Sequence
  chemically synthesized
ctggaaatccattataaatatt

SEQ ID NO: 160193 - DNA, 22 bp, Artificial Sequence
  chemically synthesized
gaaatccattataaatattctc

SEQ ID NO: 160194 - DNA, 22 bp, Artificial Sequence
  chemically synthesized
taaatattctccaccattagta

SEQ ID NO: 160195 - DNA, 22 bp, Artificial Sequence
  chemically synthesized
tccaccattagtatgcttccta

SEQ ID NO: 160196 - DNA, 22 bp, Artificial Sequence
  chemically synthesized
caccattagtatgcttcctaaa

SEQ ID NO: 160197 - DNA, 22 bp, Artificial Sequence
  chemically synthesized
gtatgcttcctaaatttgccaa

SEQ ID NO: 160198 - DNA, 22 bp, Artificial Sequence
  chemically synthesized
cctaaatttgccaatgtctaaa

SEQ ID NO: 160199 - DNA, 22 bp, Artificial Sequence
  chemically synthesized
ctaaatttgccaatgtctaaac

SEQ ID NO: 160200 - DNA, 22 bp, Artificial Sequence
  chemically synthesized
aatttgccaatgtctaaacatt

SEQ ID NO: 160201 - DNA, 22 bp, Artificial Sequence
  chemically synthesized
gccaatgtctaaacattatatc

SEQ ID NO: 160202 - DNA, 22 bp, Artificial Sequence
  chemically synthesized
ccaatgtctaaacattatatca

SEQ ID NO: 160203 - DNA, 22 bp, Artificial Sequence
  chemically synthesized
aacattatatcaagtgtctctt

SEQ ID NO: 160204 - DNA, 22 bp, Artificial Sequence
  chemically synthesized
tatcaagtgtctcttagctaca

SEQ ID NO: 160205 - DNA, 22 bp, Artificial Sequence
  chemically synthesized
ttagctacattcaagaaagcct

SEQ ID NO: 160206 - DNA, 22 bp, Artificial Sequence
  chemically synthesized
agctacattcaagaaagcctag

SEQ ID NO: 160207 - DNA, 22 bp, Artificial Sequence
  chemically synthesized
gctacattcaagaaagcctaga

SEQ ID NO: 160208 - DNA, 22 bp, Artificial Sequence
  chemically synthesized
cattcaagaaagcctagaaacc

SEQ ID NO: 160209 - DNA, 22 bp, Artificial Sequence
  chemically synthesized
aagaaagcctagaaaccagctg

SEQ ID NO: 160210 - DNA, 22 bp, Artificial Sequence
  chemically synthesized
gaaaccagctgtaaaatgtcaa

SEQ ID NO: 160211 - DNA, 22 bp, Artificial Sequence
  chemically synthesized
taaaatgtcaaggagaatagtg

SEQ ID NO: 160212 - DNA, 22 bp, Artificial Sequence
  chemically synthesized
gcttagaatttatcagatactt

SEQ ID NO: 160213 - DNA, 22 bp, Artificial Sequence
  chemically synthesized
cttagaatttatcagatactta

SEQ ID NO: 160214 - DNA, 22 bp, Artificial Sequence
  chemically synthesized
agaatttatcagatacttacgt

SEQ ID NO: 160215 - DNA, 22 bp, Artificial Sequence
  chemically synthesized
gaatttatcagatacttacgtg

SEQ ID NO: 160216 - DNA, 22 bp, Artificial Sequence
  chemically synthesized
atcagatacttacgtgataaat

SEQ ID NO: 160217 - DNA, 22 bp, Artificial Sequence
  chemically synthesized
tcagatacttacgtgataaatg

SEQ ID NO: 160218 - DNA, 22 bp, Artificial Sequence
  chemically synthesized
acgtgataaatgaaattgtaat

SEQ ID NO: 160219 - DNA, 22 bp, Artificial Sequence
  chemically synthesized
cgtgataaatgaaattgtaatg

SEQ ID NO: 160220 - DNA, 22 bp, Artificial Sequence
  chemically synthesized
taatgcataatcccattttact

SEQ ID NO: 160221 - DNA, 22 bp, Artificial Sequence
  chemically synthesized
tactaataatttaaaggtaaga

SEQ ID NO: 160222 - DNA, 22 bp, Artificial Sequence
  chemically synthesized
actaataatttaaaggtaagac

SEQ ID NO: 160223 - DNA, 22 bp, Artificial Sequence
  chemically synthesized
ctaataatttaaaggtaagact

SEQ ID NO: 160224 - DNA, 22 bp, Artificial Sequence
  chemically synthesized
ataatttaaaggtaagactata

SEQ ID NO: 160225 - DNA, 22 bp, Artificial Sequence
  chemically synthesized
aaaggtaagactataatttttt

SEQ ID NO: 160226 - DNA, 22 bp, Artificial Sequence
  chemically synthesized
aaggtaagactataattttttt

SEQ ID NO: 160227 - DNA, 22 bp, Artificial Sequence
  chemically synthesized
taatttttttcatttcatttag

SEQ ID NO: 160228 - DNA, 22 bp, Artificial Sequence
  chemically synthesized
ttttcatttcatttagaatata

SEQ ID NO: 160229 - DNA, 22 bp, Artificial Sequence
  chemically synthesized
tttcatttcatttagaatatat

SEQ ID NO: 160230 - DNA, 22 bp, Artificial Sequence
  chemically synthesized
ttcatttcatttagaatatata

SEQ ID NO: 160231 - DNA, 22 bp, Artificial Sequence
  chemically synthesized
tcatttcatttagaatatataa

SEQ ID NO: 160232 - DNA, 22 bp, Artificial Sequence
  chemically synthesized
catttcatttagaatatataac

SEQ ID NO: 160233 - DNA, 22 bp, Artificial Sequence
  chemically synthesized
atttcatttagaatatataaca

SEQ ID NO: 160234 - DNA, 22 bp, Artificial Sequence
  chemically synthesized
catttagaatatataacatctc

SEQ ID NO: 160235 - DNA, 22 bp, Artificial Sequence
  chemically synthesized
atttagaatatataacatctca

SEQ ID NO: 160236 - DNA, 22 bp, Artificial Sequence
  chemically synthesized
agaatatataacatctcactca

SEQ ID NO: 160237 - DNA, 22 bp, Artificial Sequence
  chemically synthesized
gaatatataacatctcactcat

SEQ ID NO: 160238 - DNA, 22 bp, Artificial Sequence
  chemically synthesized
actcataaatagtaggaatata

SEQ ID NO: 160239 - DNA, 22 bp, Artificial Sequence
  chemically synthesized
ataaatagtaggaatataatga

SEQ ID NO: 160240 - DNA, 22 bp, Artificial Sequence
  chemically synthesized
ttttttgaaagaaaaagaagga

SEQ ID NO: 160241 - DNA, 22 bp, Artificial Sequence
  chemically synthesized
tttgaaagaaaaagaaggaagg

SEQ ID NO: 160242 - DNA, 22 bp, Artificial Sequence
  chemically synthesized
ttgaaagaaaaagaaggaagga

SEQ ID NO: 160243 - DNA, 22 bp, Artificial Sequence
  chemically synthesized
tgaaagaaaaagaaggaaggaa

SEQ ID NO: 160244 - DNA, 22 bp, Artificial Sequence
  chemically synthesized
gaaagaaaaagaaggaaggaaa

SEQ ID NO: 160245 - DNA, 22 bp, Artificial Sequence
  chemically synthesized
aaagaaaaagaaggaaggaaag

SEQ ID NO: 160246 - DNA, 22 bp, Artificial Sequence
  chemically synthesized
actcaaatgttcaacaacttgc

SEQ ID NO: 160247 - DNA, 22 bp, Artificial Sequence
  chemically synthesized
ctcaaatgttcaacaacttgct

SEQ ID NO: 160248 - DNA, 22 bp, Artificial Sequence
  chemically synthesized
aaatgttcaacaacttgcttcc

SEQ ID NO: 160249 - DNA, 22 bp, Artificial Sequence
  chemically synthesized
aacaacttgcttccagctttac

SEQ ID NO: 160250 - DNA, 22 bp, Artificial Sequence
  chemically synthesized
gcttccagctttacatttgtag

SEQ ID NO: 160251 - DNA, 22 bp, Artificial Sequence
  chemically synthesized
cttccagctttacatttgtagg

SEQ ID NO: 160252 - DNA, 22 bp, Artificial Sequence
  chemically synthesized
ccagctttacatttgtaggact

SEQ ID NO: 160253 - DNA, 22 bp, Artificial Sequence
  chemically synthesized
cagctttacatttgtaggactt

SEQ ID NO: 160254 - DNA, 22 bp, Artificial Sequence
  chemically synthesized
tacatttgtaggacttagaaat

SEQ ID NO: 160255 - DNA, 22 bp, Artificial Sequence
  chemically synthesized
acatttgtaggacttagaaatg

SEQ ID NO: 160256 - DNA, 22 bp, Artificial Sequence
  chemically synthesized
catttgtaggacttagaaatgt

SEQ ID NO: 160257 - DNA, 22 bp, Artificial Sequence
  chemically synthesized
gtaggacttagaaatgtccatt

SEQ ID NO: 160258 - DNA, 22 bp, Artificial Sequence
  chemically synthesized
taggacttagaaatgtccatta

SEQ ID NO: 160259 - DNA, 22 bp, Artificial Sequence
  chemically synthesized
agaaatgtccattataatttgt

SEQ ID NO: 160260 - DNA, 22 bp, Artificial Sequence
  chemically synthesized
gaaatgtccattataatttgtc

SEQ ID NO: 160261 - DNA, 22 bp, Artificial Sequence
  chemically synthesized
taatttgtcactataagaatgt

SEQ ID NO: 160262 - DNA, 22 bp, Artificial Sequence
  chemically synthesized
gtcactataagaatgttactta

SEQ ID NO: 160263 - DNA, 22 bp, Artificial Sequence
  chemically synthesized
tcactataagaatgttacttaa

SEQ ID NO: 160264 - DNA, 22 bp, Artificial Sequence
  chemically synthesized
taagaatgttacttaatttact

SEQ ID NO: 160265 - DNA, 22 bp, Artificial Sequence
  chemically synthesized
cttaatttactaaaagataaaa

SEQ ID NO: 160266 - DNA, 22 bp, Artificial Sequence
  chemically synthesized
aatttactaaaagataaaaaaa

SEQ ID NO: 160267 - DNA, 22 bp, Artificial Sequence
  chemically synthesized
atttactaaaagataaaaaaaa

SEQ ID NO: 160268 - DNA, 22 bp, Artificial Sequence
  chemically synthesized
actaaaagataaaaaaaacttc

SEQ ID NO: 160269 - DNA, 22 bp, Artificial Sequence
  chemically synthesized
ctaaaagataaaaaaaacttca

SEQ ID NO: 160270 - DNA, 22 bp, Artificial Sequence
  chemically synthesized
aaagataaaaaaaacttcaata

SEQ ID NO: 160271 - DNA, 22 bp, Artificial Sequence
  chemically synthesized
caataaaataaaatgggaagaa

SEQ ID NO: 160272 - DNA, 22 bp, Artificial Sequence
  chemically synthesized
aataaaataaaatgggaagaat

SEQ ID NO: 160273 - DNA, 22 bp, Artificial Sequence
  chemically synthesized
aagaagactgaggaagtaattg

SEQ ID NO: 160274 - DNA, 22 bp, Artificial Sequence
  chemically synthesized
aggaagtaattgtgtggtaaaa

SEQ ID NO: 160275 - DNA, 22 bp, Artificial Sequence
  chemically synthesized
tgtggtaaaaagtagttatgaa

SEQ ID NO: 160276 - DNA, 22 bp, Artificial Sequence
  chemically synthesized
tgaatacagatttttcttttct

SEQ ID NO: 160277 - DNA, 22 bp, Artificial Sequence
  chemically synthesized
ttcttttctgaataaaaagaga

SEQ ID NO: 160278 - DNA, 22 bp, Artificial Sequence
  chemically synthesized
tcttttctgaataaaaagagaa

SEQ ID NO: 160279 - DNA, 22 bp, Artificial Sequence
  chemically synthesized
cttttctgaataaaaagagaaa

SEQ ID NO: 160280 - DNA, 22 bp, Artificial Sequence
  chemically synthesized
ttttctgaataaaaagagaaaa

SEQ ID NO: 160281 - DNA, 22 bp, Artificial Sequence
  chemically synthesized
ttctgaataaaaagagaaaaac

SEQ ID NO: 160282 - DNA, 22 bp, Artificial Sequence
  chemically synthesized
tctgaataaaaagagaaaaacc

SEQ ID NO: 160283 - DNA, 22 bp, Artificial Sequence
  chemically synthesized
ctgaataaaaagagaaaaacct

SEQ ID NO: 160284 - DNA, 22 bp, Artificial Sequence
  chemically synthesized
tgaataaaaagagaaaaacctt

SEQ ID NO: 160285 - DNA, 22 bp, Artificial Sequence
  chemically synthesized
aataaaaagagaaaaaccttgc

SEQ ID NO: 160286 - DNA, 22 bp, Artificial Sequence
  chemically synthesized
gcctcagtgaaaatgtcaccaa

SEQ ID NO: 160287 - DNA, 22 bp, Artificial Sequence
  chemically synthesized
cctcagtgaaaatgtcaccaag

SEQ ID NO: 160288 - DNA, 22 bp, Artificial Sequence
  chemically synthesized
agtgaaaatgtcaccaagatat

SEQ ID NO: 160289 - DNA, 22 bp, Artificial Sequence
  chemically synthesized
atttaaataggaattggcatag

SEQ ID NO: 160290 - DNA, 22 bp, Artificial Sequence
  chemically synthesized
tttaaataggaattggcataga

SEQ ID NO: 160291 - DNA, 22 bp, Artificial Sequence
  chemically synthesized
aaataggaattggcatagaaac

SEQ ID NO: 160292 - DNA, 22 bp, Artificial Sequence
  chemically synthesized
aataggaattggcatagaaaca

SEQ ID NO: 160293 - DNA, 22 bp, Artificial Sequence
  chemically synthesized
gcatagaaacatgtttgcatta

SEQ ID NO: 160294 - DNA, 22 bp, Artificial Sequence
  chemically synthesized
gcattaaatgggctttagaatt

SEQ ID NO: 160295 - DNA, 22 bp, Artificial Sequence
  chemically synthesized
cattaaatgggctttagaattt

SEQ ID NO: 160296 - DNA, 22 bp, Artificial Sequence
  chemically synthesized
aatgggctttagaattttgcaa

SEQ ID NO: 160297 - DNA, 22 bp, Artificial Sequence
  chemically synthesized
tagaattttgcaaatagaaatg

SEQ ID NO: 160298 - DNA, 22 bp, Artificial Sequence
  chemically synthesized
agaattttgcaaatagaaatgg

SEQ ID NO: 160299 - DNA, 22 bp, Artificial Sequence
  chemically synthesized
gaattttgcaaatagaaatggc

SEQ ID NO: 160300 - DNA, 22 bp, Artificial Sequence
  chemically synthesized
tgcaaatagaaatggcagaaaa

SEQ ID NO: 160301 - DNA, 22 bp, Artificial Sequence
  chemically synthesized
gcaaatagaaatggcagaaaag

SEQ ID NO: 160302 - DNA, 22 bp, Artificial Sequence
  chemically synthesized
caaatagaaatggcagaaaagg

SEQ ID NO: 160303 - DNA, 22 bp, Artificial Sequence
  chemically synthesized
gtaaaaaaattttttgcatatg

SEQ ID NO: 160304 - DNA, 22 bp, Artificial Sequence
  chemically synthesized
taaaaaaattttttgcatatga

SEQ ID NO: 160305 - DNA, 22 bp, Artificial Sequence
  chemically synthesized
tttgcatatgaattattctgca

SEQ ID NO: 160306 - DNA, 22 bp, Artificial Sequence
  chemically synthesized
ttgcatatgaattattctgcat

SEQ ID NO: 160307 - DNA, 22 bp, Artificial Sequence
  chemically synthesized
tgcatatgaattattctgcatt

SEQ ID NO: 160308 - DNA, 22 bp, Artificial Sequence
  chemically synthesized
gcatatgaattattctgcattt

SEQ ID NO: 160309 - DNA, 22 bp, Artificial Sequence
  chemically synthesized
catatgaattattctgcattta

SEQ ID NO: 160310 - DNA, 22 bp, Artificial Sequence
  chemically synthesized
ttctgcatttagcctgtgggaa

SEQ ID NO: 160311 - DNA, 22 bp, Artificial Sequence
  chemically synthesized
tgcatttagcctgtgggaaaag

SEQ ID NO: 160312 - DNA, 22 bp, Artificial Sequence
  chemically synthesized
catttagcctgtgggaaaagag

SEQ ID NO: 160313 - DNA, 22 bp, Artificial Sequence
  chemically synthesized
agcctgtgggaaaagagaaaaa

SEQ ID NO: 160314 - DNA, 22 bp, Artificial Sequence
  chemically synthesized
gcctgtgggaaaagagaaaaag

SEQ ID NO: 160315 - DNA, 22 bp, Artificial Sequence
  chemically synthesized
tgggaaaagagaaaaagagaga

SEQ ID NO: 160316 - DNA, 22 bp, Artificial Sequence
  chemically synthesized
ctgcaagtgtagaaataattac

SEQ ID NO: 160317 - DNA, 22 bp, Artificial Sequence
  chemically synthesized
tgcaagtgtagaaataattacg

SEQ ID NO: 160318 - DNA, 22 bp, Artificial Sequence
  chemically synthesized
caagtgtagaaataattacggg

SEQ ID NO: 160319 - DNA, 22 bp, Artificial Sequence
  chemically synthesized
cggggatattaggtgccagtga

SEQ ID NO: 160320 - DNA, 22 bp, Artificial Sequence
  chemically synthesized
ggtgccagtgaacccaagaggg

SEQ ID NO: 160321 - DNA, 22 bp, Artificial Sequence
  chemically synthesized
acttaaaatttgctgggtccct

SEQ ID NO: 160322 - DNA, 22 bp, Artificial Sequence
  chemically synthesized
aaaatttgctgggtccctcgtg

SEQ ID NO: 160323 - DNA, 22 bp, Artificial Sequence
  chemically synthesized
aaatttgctgggtccctcgtgg

SEQ ID NO: 160324 - DNA, 22 bp, Artificial Sequence
  chemically synthesized
gctgggtccctcgtggttttgg

SEQ ID NO: 160325 - DNA, 22 bp, Artificial Sequence
  chemically synthesized
ctgggtccctcgtggttttggc

SEQ ID NO: 160326 - DNA, 22 bp, Artificial Sequence
  chemically synthesized
ggtccctcgtggttttggctat

SEQ ID NO: 160327 - DNA, 22 bp, Artificial Sequence
  chemically synthesized
gtggttttggctatcaactagg

SEQ ID NO: 160328 - DNA, 22 bp, Artificial Sequence
  chemically synthesized
tggctatcaactaggaaatccc

SEQ ID NO: 160329 - DNA, 22 bp, Artificial Sequence
  chemically synthesized
ggctatcaactaggaaatccct

SEQ ID NO: 160330 - DNA, 22 bp, Artificial Sequence
  chemically synthesized
gctatcaactaggaaatccctc

SEQ ID NO: 160331 - DNA, 22 bp, Artificial Sequence
  chemically synthesized
tcaactaggaaatccctcattt

SEQ ID NO: 160332 - DNA, 22 bp, Artificial Sequence
  chemically synthesized
ggaaatccctcatttcatgctc

SEQ ID NO: 160333 - DNA, 22 bp, Artificial Sequence
  chemically synthesized
atttcatgctcataactcctcc

SEQ ID NO: 160334 - DNA, 22 bp, Artificial Sequence
  chemically synthesized
catgctcataactcctcctact

SEQ ID NO: 160335 - DNA, 22 bp, Artificial Sequence
  chemically synthesized
atgctcataactcctcctactt

SEQ ID NO: 160336 - DNA, 22 bp, Artificial Sequence
  chemically synthesized
ataactcctcctacttctccac

SEQ ID NO: 160337 - DNA, 22 bp, Artificial Sequence
  chemically synthesized
ctcctacttctccacacattca

SEQ ID NO: 160338 - DNA, 22 bp, Artificial Sequence
  chemically synthesized
ctacttctccacacattcataa

SEQ ID NO: 160339 - DNA, 22 bp, Artificial Sequence
  chemically synthesized
cttctccacacattcataaagg

SEQ ID NO: 160340 - DNA, 22 bp, Artificial Sequence
  chemically synthesized
ctccacacattcataaaggaat

SEQ ID NO: 160341 - DNA, 22 bp, Artificial Sequence
  chemically synthesized
tccacacattcataaaggaata

SEQ ID NO: 160342 - DNA, 22 bp, Artificial Sequence
  chemically synthesized
cacacattcataaaggaatatt

SEQ ID NO: 160343 - DNA, 22 bp, Artificial Sequence
  chemically synthesized
ataaaggaatattaaattggtg

SEQ ID NO: 160344 - DNA, 22 bp, Artificial Sequence
  chemically synthesized
aattggtggatagccacttttt

SEQ ID NO: 160345 - DNA, 22 bp, Artificial Sequence
  chemically synthesized
gtggatagccacttttttctcc

SEQ ID NO: 160346 - DNA, 22 bp, Artificial Sequence
  chemically synthesized
ttttctccaatttgagctcaat

SEQ ID NO: 160347 - DNA, 22 bp, Artificial Sequence
  chemically synthesized
tttctccaatttgagctcaata

SEQ ID NO: 160348 - DNA, 22 bp, Artificial Sequence
  chemically synthesized
ttctccaatttgagctcaataa

SEQ ID NO: 160349 - DNA, 22 bp, Artificial Sequence
  chemically synthesized
tctccaatttgagctcaataaa

SEQ ID NO: 160350 - DNA, 22 bp, Artificial Sequence
  chemically synthesized
ctccaatttgagctcaataaat

SEQ ID NO: 160351 - DNA, 22 bp, Artificial Sequence
  chemically synthesized
tccaatttgagctcaataaatt

SEQ ID NO: 160352 - DNA, 22 bp, Artificial Sequence
  chemically synthesized
caatttgagctcaataaattca

SEQ ID NO: 160353 - DNA, 22 bp, Artificial Sequence
  chemically synthesized
gagctcaataaattcatcccgt

SEQ ID NO: 160354 - DNA, 22 bp, Artificial Sequence
  chemically synthesized
agctcaataaattcatcccgtg

SEQ ID NO: 160355 - DNA, 22 bp, Artificial Sequence
  chemically synthesized
aataaattcatcccgtgtttca

SEQ ID NO: 160356 - DNA, 22 bp, Artificial Sequence
  chemically synthesized
atcccgtgtttcagaatgctac

SEQ ID NO: 160357 - DNA, 22 bp, Artificial Sequence
  chemically synthesized
cagaatgctacagacctcacta

SEQ ID NO: 160358 - DNA, 22 bp, Artificial Sequence
  chemically synthesized
agaatgctacagacctcactat

SEQ ID NO: 160359 - DNA, 22 bp, Artificial Sequence
  chemically synthesized
cagacctcactatgagttttac

SEQ ID NO: 160360 - DNA, 22 bp, Artificial Sequence
  chemically synthesized
actatgagttttactgggggat

SEQ ID NO: 160361 - DNA, 22 bp, Artificial Sequence
  chemically synthesized
tgagttttactgggggatgagc

SEQ ID NO: 160362 - DNA, 22 bp, Artificial Sequence
  chemically synthesized
tactgggggatgagcacacaaa

SEQ ID NO: 160363 - DNA, 22 bp, Artificial Sequence
  chemically synthesized
actgggggatgagcacacaaag

SEQ ID NO: 160364 - DNA, 22 bp, Artificial Sequence
  chemically synthesized
ctgggggatgagcacacaaaga

SEQ ID NO: 160365 - DNA, 22 bp, Artificial Sequence
  chemically synthesized
ggggatgagcacacaaagatgg

SEQ ID NO: 160366 - DNA, 22 bp, Artificial Sequence
  chemically synthesized
agacagacttccagaagaagaa

SEQ ID NO: 160367 - DNA, 22 bp, Artificial Sequence
  chemically synthesized
ccagaagaagaagaagatgtcc

SEQ ID NO: 160368 - DNA, 22 bp, Artificial Sequence
  chemically synthesized
cagaagaagaagaagatgtccg

SEQ ID NO: 160369 - DNA, 22 bp, Artificial Sequence
  chemically synthesized
gagataaatgaaaagtgtaaaa

SEQ ID NO: 160370 - DNA, 22 bp, Artificial Sequence
  chemically synthesized
caaaatgtccacagtatattat

SEQ ID NO: 160371 - DNA, 22 bp, Artificial Sequence
  chemically synthesized
tattggcacatatcctggcacc

SEQ ID NO: 160372 - DNA, 22 bp, Artificial Sequence
  chemically synthesized
gcacatatcctggcaccaaaca

SEQ ID NO: 160373 - DNA, 22 bp, Artificial Sequence
  chemically synthesized
gcaccaaacagagtaaaattta

SEQ ID NO: 160374 - DNA, 22 bp, Artificial Sequence
  chemically synthesized
atgacattagctggatgctgtt

SEQ ID NO: 160375 - DNA, 22 bp, Artificial Sequence
  chemically synthesized
tgacattagctggatgctgtta

SEQ ID NO: 160376 - DNA, 22 bp, Artificial Sequence
  chemically synthesized
gctggatgctgttacacagagt

SEQ ID NO: 160377 - DNA, 22 bp, Artificial Sequence
  chemically synthesized
gatgctgttacacagagtgcag

SEQ ID NO: 160378 - DNA, 22 bp, Artificial Sequence
  chemically synthesized
ttacacagagtgcagacagaaa

SEQ ID NO: 160379 - DNA, 22 bp, Artificial Sequence
  chemically synthesized
cacagagtgcagacagaaagta

SEQ ID NO: 160380 - DNA, 22 bp, Artificial Sequence
  chemically synthesized
aagggaatgaagctggaatcct

SEQ ID NO: 160381 - DNA, 22 bp, Artificial Sequence
  chemically synthesized
agggaatgaagctggaatcctt

SEQ ID NO: 160382 - DNA, 22 bp, Artificial Sequence
  chemically synthesized
gaatccttggagaagaaaaatt

SEQ ID NO: 160383 - DNA, 22 bp, Artificial Sequence
  chemically synthesized
ggagaagaaaaattggtgagtg

SEQ ID NO: 160384 - DNA, 22 bp, Artificial Sequence
  chemically synthesized
gagaagaaaaattggtgagtga

SEQ ID NO: 160385 - DNA, 22 bp, Artificial Sequence
  chemically synthesized
gtgagtgatgaatgaaagtgtt

SEQ ID NO: 160386 - DNA, 22 bp, Artificial Sequence
  chemically synthesized
tgaaaaatggacaatattcttc

SEQ ID NO: 160387 - DNA, 22 bp, Artificial Sequence
  chemically synthesized
ttcaggtatctggtaagagcaa

SEQ ID NO: 160388 - DNA, 22 bp, Artificial Sequence
  chemically synthesized
caggtatctggtaagagcaaaa

SEQ ID NO: 160389 - DNA, 22 bp, Artificial Sequence
  chemically synthesized
aggtatctggtaagagcaaaac

SEQ ID NO: 160390 - DNA, 22 bp, Artificial Sequence
  chemically synthesized
gtaagagcaaaaccagctctca

SEQ ID NO: 160391 - DNA, 22 bp, Artificial Sequence
  chemically synthesized
tcaataataattgaggagtaag

SEQ ID NO: 160392 - DNA, 22 bp, Artificial Sequence
  chemically synthesized
aataataattgaggagtaagtc

SEQ ID NO: 160393 - DNA, 22 bp, Artificial Sequence
  chemically synthesized
aggagtaagtctcacgattcca

SEQ ID NO: 160394 - DNA, 22 bp, Artificial Sequence
  chemically synthesized
acgattccaagtttcctctcca

SEQ ID NO: 160395 - DNA, 22 bp, Artificial Sequence
  chemically synthesized
caagtttcctctccataattta

SEQ ID NO: 160396 - DNA, 22 bp, Artificial Sequence
  chemically synthesized
cctctccataatttaattacca

SEQ ID NO: 160397 - DNA, 22 bp, Artificial Sequence
  chemically synthesized
ctctccataatttaattaccag

SEQ ID NO: 160398 - DNA, 22 bp, Artificial Sequence
  chemically synthesized
tccataatttaattaccagctt

SEQ ID NO: 160399 - DNA, 22 bp, Artificial Sequence
  chemically synthesized
cataatttaattaccagcttct

SEQ ID NO: 160400 - DNA, 22 bp, Artificial Sequence
  chemically synthesized
aattaccagcttctccaataac

SEQ ID NO: 160401 - DNA, 22 bp, Artificial Sequence
  chemically synthesized
attaccagcttctccaataaca

SEQ ID NO: 160402 - DNA, 22 bp, Artificial Sequence
  chemically synthesized
ccagcttctccaataacaatca

SEQ ID NO: 160403 - DNA, 22 bp, Artificial Sequence
  chemically synthesized
ctccaataacaatcactctatc

SEQ ID NO: 160404 - DNA, 22 bp, Artificial Sequence
  chemically synthesized
tccaataacaatcactctatcc

SEQ ID NO: 160405 - DNA, 22 bp, Artificial Sequence
  chemically synthesized
caataacaatcactctatccaa

SEQ ID NO: 160406 - DNA, 22 bp, Artificial Sequence
  chemically synthesized
tatccaactaaccaggaactta

SEQ ID NO: 160407 - DNA, 22 bp, Artificial Sequence
  chemically synthesized
tccaactaaccaggaacttaca

SEQ ID NO: 160408 - DNA, 22 bp, Artificial Sequence
  chemically synthesized
accaggaacttacatacaccac

SEQ ID NO: 160409 - DNA, 22 bp, Artificial Sequence
  chemically synthesized
acatacaccaccacctgcaacc

SEQ ID NO: 160410 - DNA, 22 bp, Artificial Sequence
  chemically synthesized
catacaccaccacctgcaaccc

SEQ ID NO: 160411 - DNA, 22 bp, Artificial Sequence
  chemically synthesized
caaccctgctatctgtgcctgt

SEQ ID NO: 160412 - DNA, 22 bp, Artificial Sequence
  chemically synthesized
ctatctgtgcctgtcaggtagt

SEQ ID NO: 160413 - DNA, 22 bp, Artificial Sequence
  chemically synthesized
tctgtgcctgtcaggtagtact

SEQ ID NO: 160414 - DNA, 22 bp, Artificial Sequence
  chemically synthesized
tgcctgtcaggtagtactcaca

SEQ ID NO: 160415 - DNA, 22 bp, Artificial Sequence
  chemically synthesized
tcaggtagtactcacatgtcag

SEQ ID NO: 160416 - DNA, 22 bp, Artificial Sequence
  chemically synthesized
acatgtcagctctttggtcttg

SEQ ID NO: 160417 - DNA, 22 bp, Artificial Sequence
  chemically synthesized
tttggtcttgaataagtcagac

SEQ ID NO: 160418 - DNA, 22 bp, Artificial Sequence
  chemically synthesized
tggtcttgaataagtcagacat

SEQ ID NO: 160419 - DNA, 22 bp, Artificial Sequence
  chemically synthesized
ggtcttgaataagtcagacatt

SEQ ID NO: 160420 - DNA, 22 bp, Artificial Sequence
  chemically synthesized
gtcttgaataagtcagacattg

SEQ ID NO: 160421 - DNA, 22 bp, Artificial Sequence
  chemically synthesized
gaataagtcagacattgtgatt

SEQ ID NO: 160422 - DNA, 22 bp, Artificial Sequence
  chemically synthesized
aataagtcagacattgtgattg

SEQ ID NO: 160423 - DNA, 22 bp, Artificial Sequence
  chemically synthesized
tgattgccattaaaggattctt

SEQ ID NO: 160424 - DNA, 22 bp, Artificial Sequence
  chemically synthesized
ccattaaaggattcttattcta

SEQ ID NO: 160425 - DNA, 22 bp, Artificial Sequence
  chemically synthesized
aaggattcttattctaattgtg

SEQ ID NO: 160426 - DNA, 22 bp, Artificial Sequence
  chemically synthesized
ttattctaattgtgattatctt

SEQ ID NO: 160427 - DNA, 22 bp, Artificial Sequence
  chemically synthesized
attctaattgtgattatctttg

SEQ ID NO: 160428 - DNA, 22 bp, Artificial Sequence
  chemically synthesized
ttctaattgtgattatctttgg

SEQ ID NO: 160429 - DNA, 22 bp, Artificial Sequence
  chemically synthesized
taattgtgattatctttggaga

SEQ ID NO: 160430 - DNA, 22 bp, Artificial Sequence
  chemically synthesized
attgtgattatctttggagaag

SEQ ID NO: 160431 - DNA, 22 bp, Artificial Sequence
  chemically synthesized
tgattatctttggagaagaaaa

SEQ ID NO: 160432 - DNA, 22 bp, Artificial Sequence
  chemically synthesized
tctttggagaagaaaaaatttg

SEQ ID NO: 160433 - DNA, 22 bp, Artificial Sequence
  chemically synthesized
tggagaagaaaaaatttgcccc

SEQ ID NO: 160434 - DNA, 22 bp, Artificial Sequence
  chemically synthesized
ggagaagaaaaaatttgcccct

SEQ ID NO: 160435 - DNA, 22 bp, Artificial Sequence
  chemically synthesized
gagaagaaaaaatttgccccta

SEQ ID NO: 160436 - DNA, 22 bp, Artificial Sequence
  chemically synthesized
gcccctattagaaaaagccagt

SEQ ID NO: 160437 - DNA, 22 bp, Artificial Sequence
  chemically synthesized
cccctattagaaaaagccagtg

SEQ ID NO: 160438 - DNA, 22 bp, Artificial Sequence
  chemically synthesized
ttagaaaaagccagtgacttat

SEQ ID NO: 160439 - DNA, 22 bp, Artificial Sequence
  chemically synthesized
gaaaaagccagtgacttatgga

SEQ ID NO: 160440 - DNA, 22 bp, Artificial Sequence
  chemically synthesized
atggatgggagtgtcataaaac

SEQ ID NO: 160441 - DNA, 22 bp, Artificial Sequence
  chemically synthesized
tggatgggagtgtcataaaact

SEQ ID NO: 160442 - DNA, 22 bp, Artificial Sequence
  chemically synthesized
agcattggggatcaaatctgtg

SEQ ID NO: 160443 - DNA, 22 bp, Artificial Sequence
  chemically synthesized
gggatcaaatctgtggaaatca

SEQ ID NO: 160444 - DNA, 22 bp, Artificial Sequence
  chemically synthesized
tggaaatcaaagtatttaattg

SEQ ID NO: 160445 - DNA, 22 bp, Artificial Sequence
  chemically synthesized
aattgacctactagtttacggt

SEQ ID NO: 160446 - DNA, 22 bp, Artificial Sequence
  chemically synthesized
attgacctactagtttacggta

SEQ ID NO: 160447 - DNA, 22 bp, Artificial Sequence
  chemically synthesized
acctactagtttacggtaaatg

SEQ ID NO: 160448 - DNA, 22 bp, Artificial Sequence
  chemically synthesized
ctagtttacggtaaatgtatgt

SEQ ID NO: 160449 - DNA, 22 bp, Artificial Sequence
  chemically synthesized
gtttacggtaaatgtatgttag

SEQ ID NO: 160450 - DNA, 22 bp, Artificial Sequence
  chemically synthesized
acggtaaatgtatgttagctga

SEQ ID NO: 160451 - DNA, 22 bp, Artificial Sequence
  chemically synthesized
cggtaaatgtatgttagctgat

SEQ ID NO: 160452 - DNA, 22 bp, Artificial Sequence
  chemically synthesized
gctgatacagcctccctgtcat

SEQ ID NO: 160453 - DNA, 22 bp, Artificial Sequence
  chemically synthesized
atacagcctccctgtcatgaaa

SEQ ID NO: 160454 - DNA, 22 bp, Artificial Sequence
  chemically synthesized
cctgtcatgaaatgtcctctgc

SEQ ID NO: 160455 - DNA, 22 bp, Artificial Sequence
  chemically synthesized
tcatgaaatgtcctctgctgat

SEQ ID NO: 160456 - DNA, 22 bp, Artificial Sequence
  chemically synthesized
tgctgatttggttctttcattt

SEQ ID NO: 160457 - DNA, 22 bp, Artificial Sequence
  chemically synthesized
ctgatttggttctttcatttga

SEQ ID NO: 160458 - DNA, 22 bp, Artificial Sequence
  chemically synthesized
atttggttctttcatttgaagt

SEQ ID NO: 160459 - DNA, 22 bp, Artificial Sequence
  chemically synthesized
ggttctttcatttgaagtttag

SEQ ID NO: 160460 - DNA, 22 bp, Artificial Sequence
  chemically synthesized
gttctttcatttgaagtttagc

SEQ ID NO: 160461 - DNA, 22 bp, Artificial Sequence
  chemically synthesized
tttcatttgaagtttagcagca

SEQ ID NO: 160462 - DNA, 22 bp, Artificial Sequence
  chemically synthesized
tcatttgaagtttagcagcagt

SEQ ID NO: 160463 - DNA, 22 bp, Artificial Sequence
  chemically synthesized
catttgaagtttagcagcagtt

SEQ ID NO: 160464 - DNA, 22 bp, Artificial Sequence
  chemically synthesized
atttgaagtttagcagcagttg

SEQ ID NO: 160465 - DNA, 22 bp, Artificial Sequence
  chemically synthesized
gaagtttagcagcagttgaaca

SEQ ID NO: 160466 - DNA, 22 bp, Artificial Sequence
  chemically synthesized
aagtttagcagcagttgaacat

SEQ ID NO: 160467 - DNA, 22 bp, Artificial Sequence
  chemically synthesized
agcagcagttgaacatttgttg

SEQ ID NO: 160468 - DNA, 22 bp, Artificial Sequence
  chemically synthesized
gcagcagttgaacatttgttgt

SEQ ID NO: 160469 - DNA, 22 bp, Artificial Sequence
  chemically synthesized
aacatttgttgttgaatatttg

SEQ ID NO: 160470 - DNA, 22 bp, Artificial Sequence
  chemically synthesized
gttgttgaatatttgagtaaac

SEQ ID NO: 160471 - DNA, 22 bp, Artificial Sequence
  chemically synthesized
ttgttgaatatttgagtaaact

SEQ ID NO: 160472 - DNA, 22 bp, Artificial Sequence
  chemically synthesized
ttgaatatttgagtaaacttgt

SEQ ID NO: 160473 - DNA, 22 bp, Artificial Sequence
  chemically synthesized
aatatttgagtaaacttgtatc

SEQ ID NO: 160474 - DNA, 22 bp, Artificial Sequence
  chemically synthesized
gagtaaacttgtatccatttcc

SEQ ID NO: 160475 - DNA, 22 bp, Artificial Sequence
  chemically synthesized
agtaaacttgtatccatttcct

SEQ ID NO: 160476 - DNA, 22 bp, Artificial Sequence
  chemically synthesized
gtatccatttcctcttttctct

SEQ ID NO: 160477 - DNA, 22 bp, Artificial Sequence
  chemically synthesized
tatccatttcctcttttctctt

SEQ ID NO: 160478 - DNA, 22 bp, Artificial Sequence
  chemically synthesized
cctcttttctctttcttccttg

SEQ ID NO: 160479 - DNA, 22 bp, Artificial Sequence
  chemically synthesized
ctcttttctctttcttccttgt

SEQ ID NO: 160480 - DNA, 22 bp, Artificial Sequence
  chemically synthesized
ttttctctttcttccttgttac

SEQ ID NO: 160481 - DNA, 22 bp, Artificial Sequence
  chemically synthesized
ttctctttcttccttgttactt

SEQ ID NO: 160482 - DNA, 22 bp, Artificial Sequence
  chemically synthesized
tctctttcttccttgttactta

SEQ ID NO: 160483 - DNA, 22 bp, Artificial Sequence
  chemically synthesized
ctctttcttccttgttacttac

SEQ ID NO: 160484 - DNA, 22 bp, Artificial Sequence
  chemically synthesized
tctttcttccttgttacttacc

SEQ ID NO: 160485 - DNA, 22 bp, Artificial Sequence
  chemically synthesized
tttcttccttgttacttacctt

SEQ ID NO: 160486 - DNA, 22 bp, Artificial Sequence
  chemically synthesized
tcttccttgttacttaccttcc

SEQ ID NO: 160487 - DNA, 22 bp, Artificial Sequence
  chemically synthesized
cttccttgttacttaccttcct

SEQ ID NO: 160488 - DNA, 22 bp, Artificial Sequence
  chemically synthesized
ttccttgttacttaccttcctt

SEQ ID NO: 160489 - DNA, 22 bp, Artificial Sequence
  chemically synthesized
ccttgttacttaccttcctttt

SEQ ID NO: 160490 - DNA, 22 bp, Artificial Sequence
  chemically synthesized
cttgttacttaccttccttttc

SEQ ID NO: 160491 - DNA, 22 bp, Artificial Sequence
  chemically synthesized
gttacttaccttccttttcttt

SEQ ID NO: 160492 - DNA, 22 bp, Artificial Sequence
  chemically synthesized
ttacttaccttccttttctttc

SEQ ID NO: 160493 - DNA, 22 bp, Artificial Sequence
  chemically synthesized
cttaccttccttttctttcaaa

SEQ ID NO: 160494 - DNA, 22 bp, Artificial Sequence
  chemically synthesized
accttccttttctttcaaaaaa

SEQ ID NO: 160495 - DNA, 22 bp, Artificial Sequence
  chemically synthesized
ccttccttttctttcaaaaaaa

SEQ ID NO: 160496 - DNA, 22 bp, Artificial Sequence
  chemically synthesized
ccttttctttcaaaaaaaaaaa

SEQ ID NO: 160497 - DNA, 22 bp, Artificial Sequence
  chemically synthesized
cttttctttcaaaaaaaaaaaa

SEQ ID NO: 160498 - DNA, 22 bp, Artificial Sequence
  chemically synthesized
ttctttcaaaaaaaaaaaaaaa

SEQ ID NO: 160499 - DNA, 22 bp, Artificial Sequence
  chemically synthesized
tctttcaaaaaaaaaaaaaaaa

SEQ ID NO: 160500 - DNA, 22 bp, Artificial Sequence
  chemically synthesized
ctttcaaaaaaaaaaaaaaaaa

SEQ ID NO: 160501 - DNA, 22 bp, Artificial Sequence
  chemically synthesized
tttcaaaaaaaaaaaaaaaaaa

SEQ ID NO: 160502 - DNA, 22 bp, Artificial Sequence
  chemically synthesized
tcaaaaaaaaaaaaaaaaaaaa

SEQ ID NO: 160503 - DNA, 22 bp, Artificial Sequence
  chemically synthesized
caaaaaaaaaaaaaaaaaaaaa

SEQ ID NO: 160504 - DNA, 22 bp, Artificial Sequence
  chemically synthesized
aaaaaaaaaaaaaaaaaaaaag

SEQ ID NO: 160505 - DNA, 22 bp, Artificial Sequence
  chemically synthesized
ctttttctttcaaagaacagct

SEQ ID NO: 160506 - DNA, 22 bp, Artificial Sequence
  chemically synthesized
tttctttcaaagaacagctact

SEQ ID NO: 160507 - DNA, 22 bp, Artificial Sequence
  chemically synthesized
ttctttcaaagaacagctactt

SEQ ID NO: 160508 - DNA, 22 bp, Artificial Sequence
  chemically synthesized
tctttcaaagaacagctacttc

SEQ ID NO: 160509 - DNA, 22 bp, Artificial Sequence
  chemically synthesized
ctttcaaagaacagctacttcc

SEQ ID NO: 160510 - DNA, 22 bp, Artificial Sequence
  chemically synthesized
tttcaaagaacagctacttcct

SEQ ID NO: 160511 - DNA, 22 bp, Artificial Sequence
  chemically synthesized
tcaaagaacagctacttcctga

SEQ ID NO: 160512 - DNA, 22 bp, Artificial Sequence
  chemically synthesized
caaagaacagctacttcctgaa

SEQ ID NO: 160513 - DNA, 22 bp, Artificial Sequence
  chemically synthesized
aaagaacagctacttcctgaat

SEQ ID NO: 160514 - DNA, 22 bp, Artificial Sequence
  chemically synthesized
cttcctgaatttccagcatatt

SEQ ID NO: 160515 - DNA, 22 bp, Artificial Sequence
  chemically synthesized
cctgaatttccagcatattggt

SEQ ID NO: 160516 - DNA, 22 bp, Artificial Sequence
  chemically synthesized
ctgaatttccagcatattggtg

SEQ ID NO: 160517 - DNA, 22 bp, Artificial Sequence
  chemically synthesized
aatttccagcatattggtgaca

SEQ ID NO: 160518 - DNA, 22 bp, Artificial Sequence
  chemically synthesized
ccagcatattggtgacatgaag

SEQ ID NO: 160519 - DNA, 22 bp, Artificial Sequence
  chemically synthesized
cagcatattggtgacatgaagc

SEQ ID NO: 160520 - DNA, 22 bp, Artificial Sequence
  chemically synthesized
gtgacatgaagcatacggttag

SEQ ID NO: 160521 - DNA, 22 bp, Artificial Sequence
  chemically synthesized
gctgattcatgagcttactgag

SEQ ID NO: 160522 - DNA, 22 bp, Artificial Sequence
  chemically synthesized
attcatgagcttactgagataa

SEQ ID NO: 160523 - DNA, 22 bp, Artificial Sequence
  chemically synthesized
atgagcttactgagataaaaca

SEQ ID NO: 160524 - DNA, 22 bp, Artificial Sequence
  chemically synthesized
actgagataaaacaactttatt

SEQ ID NO: 160525 - DNA, 22 bp, Artificial Sequence
  chemically synthesized
ctgagataaaacaactttattg

SEQ ID NO: 160526 - DNA, 22 bp, Artificial Sequence
  chemically synthesized
agataaaacaactttattgaag

SEQ ID NO: 160527 - DNA, 22 bp, Artificial Sequence
  chemically synthesized
tattgaagtgtctaggaaagaa

SEQ ID NO: 160528 - DNA, 22 bp, Artificial Sequence
  chemically synthesized
attgaagtgtctaggaaagaat

SEQ ID NO: 160529 - DNA, 22 bp, Artificial Sequence
  chemically synthesized
ttgaagtgtctaggaaagaatg

SEQ ID NO: 160530 - DNA, 22 bp, Artificial Sequence
  chemically synthesized
aagtgtctaggaaagaatgaag

SEQ ID NO: 160531 - DNA, 22 bp, Artificial Sequence
  chemically synthesized
ggaaagaatgaagtaactttac

SEQ ID NO: 160532 - DNA, 22 bp, Artificial Sequence
  chemically synthesized
tacttttcactgtatcacaaac

SEQ ID NO: 160533 - DNA, 22 bp, Artificial Sequence
  chemically synthesized
acttttcactgtatcacaaaca

SEQ ID NO: 160534 - DNA, 22 bp, Artificial Sequence
  chemically synthesized
cttttcactgtatcacaaacat

SEQ ID NO: 160535 - DNA, 22 bp, Artificial Sequence
  chemically synthesized
ttcactgtatcacaaacatttc

SEQ ID NO: 160536 - DNA, 22 bp, Artificial Sequence
  chemically synthesized
tcactgtatcacaaacatttct

SEQ ID NO: 160537 - DNA, 22 bp, Artificial Sequence
  chemically synthesized
cactgtatcacaaacatttctc

SEQ ID NO: 160538 - DNA, 22 bp, Artificial Sequence
  chemically synthesized
actgtatcacaaacatttctct

SEQ ID NO: 160539 - DNA, 22 bp, Artificial Sequence
  chemically synthesized
tatcacaaacatttctctaatg

SEQ ID NO: 160540 - DNA, 22 bp, Artificial Sequence
  chemically synthesized
ctctaatgtatagcttaaaatg

SEQ ID NO: 160541 - DNA, 22 bp, Artificial Sequence
  chemically synthesized
tctaatgtatagcttaaaatgt

SEQ ID NO: 160542 - DNA, 22 bp, Artificial Sequence
  chemically synthesized
taatgtatagcttaaaatgtac

SEQ ID NO: 160543 - DNA, 22 bp, Artificial Sequence
  chemically synthesized
atgtatagcttaaaatgtactg

SEQ ID NO: 160544 - DNA, 22 bp, Artificial Sequence
  chemically synthesized
aaaatgtactgattcaaaatat

SEQ ID NO: 160545 - DNA, 22 bp, Artificial Sequence
  chemically synthesized
aaatgtactgattcaaaatatg

SEQ ID NO: 160546 - DNA, 22 bp, Artificial Sequence
  chemically synthesized
attcaaaatatgtaatttttag

SEQ ID NO: 160547 - DNA, 22 bp, Artificial Sequence
  chemically synthesized
aaaatatgtaatttttagaaaa

SEQ ID NO: 160548 - DNA, 22 bp, Artificial Sequence
  chemically synthesized
ttagaaaataactattttgatc

SEQ ID NO: 160549 - DNA, 22 bp, Artificial Sequence
  chemically synthesized
tagaaaataactattttgatca

SEQ ID NO: 160550 - DNA, 22 bp, Artificial Sequence
  chemically synthesized
agaaaataactattttgatcag

SEQ ID NO: 160551 - DNA, 22 bp, Artificial Sequence
  chemically synthesized
gaaaataactattttgatcaga

SEQ ID NO: 160552 - DNA, 22 bp, Artificial Sequence
  chemically synthesized
ttttgatcagagaacttttata

SEQ ID NO: 160553 - DNA, 22 bp, Artificial Sequence
  chemically synthesized
tgatcagagaacttttatataa

SEQ ID NO: 160554 - DNA, 22 bp, Artificial Sequence
  chemically synthesized
gatcagagaacttttatataaa

SEQ ID NO: 160555 - DNA, 22 bp, Artificial Sequence
  chemically synthesized
atcagagaacttttatataaag

SEQ ID NO: 160556 - DNA, 22 bp, Artificial Sequence
  chemically synthesized
ttatataaagcataagagccca

SEQ ID NO: 160557 - DNA, 22 bp, Artificial Sequence
  chemically synthesized
tatataaagcataagagcccag

SEQ ID NO: 160558 - DNA, 22 bp, Artificial Sequence
  chemically synthesized
atataaagcataagagcccagg

SEQ ID NO: 160559 - DNA, 22 bp, Artificial Sequence
  chemically synthesized
tataaagcataagagcccaggt

SEQ ID NO: 160560 - DNA, 22 bp, Artificial Sequence
  chemically synthesized
ttcagaaaattcaatcatcagt

SEQ ID NO: 160561 - DNA, 22 bp, Artificial Sequence
  chemically synthesized
tcagaaaattcaatcatcagtg

SEQ ID NO: 160562 - DNA, 22 bp, Artificial Sequence
  chemically synthesized
cagaaaattcaatcatcagtga

SEQ ID NO: 160563 - DNA, 22 bp, Artificial Sequence
  chemically synthesized
agaaaattcaatcatcagtgaa

SEQ ID NO: 160564 - DNA, 22 bp, Artificial Sequence
  chemically synthesized
aatcatcagtgaaattgaaaag

SEQ ID NO: 160565 - DNA, 22 bp, Artificial Sequence
  chemically synthesized
aaaagtgactaaattttctttg

SEQ ID NO: 160566 - DNA, 22 bp, Artificial Sequence
  chemically synthesized
aattttctttggttattcatag

SEQ ID NO: 160567 - DNA, 22 bp, Artificial Sequence
  chemically synthesized
tctttggttattcatagtgctt

SEQ ID NO: 160568 - DNA, 22 bp, Artificial Sequence
  chemically synthesized
ctttggttattcatagtgcttt

SEQ ID NO: 160569 - DNA, 22 bp, Artificial Sequence
  chemically synthesized
tttggttattcatagtgctttc

SEQ ID NO: 160570 - DNA, 22 bp, Artificial Sequence
  chemically synthesized
tggttattcatagtgctttcct

SEQ ID NO: 160571 - DNA, 22 bp, Artificial Sequence
  chemically synthesized
ggttattcatagtgctttcctc

SEQ ID NO: 160572 - DNA, 22 bp, Artificial Sequence
  chemically synthesized
gttattcatagtgctttcctca

SEQ ID NO: 160573 - DNA, 22 bp, Artificial Sequence
  chemically synthesized
ttcatagtgctttcctcaattt

SEQ ID NO: 160574 - DNA, 22 bp, Artificial Sequence
  chemically synthesized
atagtgctttcctcaattttag

SEQ ID NO: 160575 - DNA, 22 bp, Artificial Sequence
  chemically synthesized
tcctcaattttagtctccccaa

SEQ ID NO: 160576 - DNA, 22 bp, Artificial Sequence
  chemically synthesized
cctcaattttagtctccccaag

SEQ ID NO: 160577 - DNA, 22 bp, Artificial Sequence
  chemically synthesized
ctcaattttagtctccccaagt

SEQ ID NO: 160578 - DNA, 22 bp, Artificial Sequence
  chemically synthesized
aattttagtctccccaagtttg

SEQ ID NO: 160579 - DNA, 22 bp, Artificial Sequence
  chemically synthesized
tagtctccccaagtttgtcctg

SEQ ID NO: 160580 - DNA, 22 bp, Artificial Sequence
  chemically synthesized
agtctccccaagtttgtcctgt

SEQ ID NO: 160581 - DNA, 22 bp, Artificial Sequence
  chemically synthesized
gtctccccaagtttgtcctgtc

SEQ ID NO: 160582 - DNA, 22 bp, Artificial Sequence
  chemically synthesized
cccaagtttgtcctgtcttccc

SEQ ID NO: 160583 - DNA, 22 bp, Artificial Sequence
  chemically synthesized
gtcctgtcttccctgtctagtt

SEQ ID NO: 160584 - DNA, 22 bp, Artificial Sequence
  chemically synthesized
tcctgtcttccctgtctagttc

SEQ ID NO: 160585 - DNA, 22 bp, Artificial Sequence
  chemically synthesized
tcttccctgtctagttctacat

SEQ ID NO: 160586 - DNA, 22 bp, Artificial Sequence
  chemically synthesized
ccctgtctagttctacatttga

SEQ ID NO: 160587 - DNA, 22 bp, Artificial Sequence
  chemically synthesized
cctgtctagttctacatttgac

SEQ ID NO: 160588 - DNA, 22 bp, Artificial Sequence
  chemically synthesized
tctagttctacatttgacttct

SEQ ID NO: 160589 - DNA, 22 bp, Artificial Sequence
  chemically synthesized
gttctacatttgacttcttcta

SEQ ID NO: 160590 - DNA, 22 bp, Artificial Sequence
  chemically synthesized
tacatttgacttcttctaagaa

SEQ ID NO: 160591 - DNA, 22 bp, Artificial Sequence
  chemically synthesized
catttgacttcttctaagaaat

SEQ ID NO: 160592 - DNA, 22 bp, Artificial Sequence
  chemically synthesized
gacttcttctaagaaatctgtc

SEQ ID NO: 160593 - DNA, 22 bp, Artificial Sequence
  chemically synthesized
acttcttctaagaaatctgtcc

SEQ ID NO: 160594 - DNA, 22 bp, Artificial Sequence
  chemically synthesized
cttctaagaaatctgtccttta

SEQ ID NO: 160595 - DNA, 22 bp, Artificial Sequence
  chemically synthesized
ttctaagaaatctgtcctttag

SEQ ID NO: 160596 - DNA, 22 bp, Artificial Sequence
  chemically synthesized
ctaagaaatctgtcctttagct

SEQ ID NO: 160597 - DNA, 22 bp, Artificial Sequence
  chemically synthesized
taagaaatctgtcctttagctt

SEQ ID NO: 160598 - DNA, 22 bp, Artificial Sequence
  chemically synthesized
agaaatctgtcctttagctttt

SEQ ID NO: 160599 - DNA, 22 bp, Artificial Sequence
  chemically synthesized
tcctttagcttttttattttta

SEQ ID NO: 160600 - DNA, 22 bp, Artificial Sequence
  chemically synthesized
tagcttttttatttttactaat

SEQ ID NO: 160601 - DNA, 22 bp, Artificial Sequence
  chemically synthesized
agcttttttatttttactaatt

SEQ ID NO: 160602 - DNA, 22 bp, Artificial Sequence
  chemically synthesized
gcttttttatttttactaattt

SEQ ID NO: 160603 - DNA, 22 bp, Artificial Sequence
  chemically synthesized
ttttatttttactaatttctta

SEQ ID NO: 160604 - DNA, 22 bp, Artificial Sequence
  chemically synthesized
tttatttttactaatttcttat

SEQ ID NO: 160605 - DNA, 22 bp, Artificial Sequence
  chemically synthesized
ttatttttactaatttcttatg

SEQ ID NO: 160606 - DNA, 22 bp, Artificial Sequence
  chemically synthesized
tatttttactaatttcttatgt

SEQ ID NO: 160607 - DNA, 22 bp, Artificial Sequence
  chemically synthesized
atttttactaatttcttatgtc

SEQ ID NO: 160608 - DNA, 22 bp, Artificial Sequence
  chemically synthesized
tttttactaatttcttatgtca

SEQ ID NO: 160609 - DNA, 22 bp, Artificial Sequence
  chemically synthesized
ttactaatttcttatgtcagag

SEQ ID NO: 160610 - DNA, 22 bp, Artificial Sequence
  chemically synthesized
tactaatttcttatgtcagagc

SEQ ID NO: 160611 - DNA, 22 bp, Artificial Sequence
  chemically synthesized
actaatttcttatgtcagagct

SEQ ID NO: 160612 - DNA, 22 bp, Artificial Sequence
  chemically synthesized
ctaatttcttatgtcagagctc

SEQ ID NO: 160613 - DNA, 22 bp, Artificial Sequence
  chemically synthesized
atttcttatgtcagagctcaca

SEQ ID NO: 160614 - DNA, 22 bp, Artificial Sequence
  chemically synthesized
cttatgtcagagctcacaaaat

SEQ ID NO: 160615 - DNA, 22 bp, Artificial Sequence
  chemically synthesized
ttatgtcagagctcacaaaatt

SEQ ID NO: 160616 - DNA, 22 bp, Artificial Sequence
  chemically synthesized
atgtcagagctcacaaaattat

SEQ ID NO: 160617 - DNA, 22 bp, Artificial Sequence
  chemically synthesized
tgtcagagctcacaaaattata

SEQ ID NO: 160618 - DNA, 22 bp, Artificial Sequence
  chemically synthesized
acaaaattatataagcatctca

SEQ ID NO: 160619 - DNA, 22 bp, Artificial Sequence
  chemically synthesized
tataagcatctcacctatattt

SEQ ID NO: 160620 - DNA, 22 bp, Artificial Sequence
  chemically synthesized
acctatatttcattaagaacta

SEQ ID NO: 160621 - DNA, 22 bp, Artificial Sequence
  chemically synthesized
tatttcattaagaactaatgag

SEQ ID NO: 160622 - DNA, 22 bp, Artificial Sequence
  chemically synthesized
cattaagaactaatgagccttt

SEQ ID NO: 160623 - DNA, 22 bp, Artificial Sequence
  chemically synthesized
attaagaactaatgagccttta

SEQ ID NO: 160624 - DNA, 22 bp, Artificial Sequence
  chemically synthesized
agaactaatgagcctttattgg

SEQ ID NO: 160625 - DNA, 22 bp, Artificial Sequence
  chemically synthesized
atgagcctttattgggctatat

SEQ ID NO: 160626 - DNA, 22 bp, Artificial Sequence
  chemically synthesized
tattgggctatattatgctaat

SEQ ID NO: 160627 - DNA, 22 bp, Artificial Sequence
  chemically synthesized
attgggctatattatgctaatt

SEQ ID NO: 160628 - DNA, 22 bp, Artificial Sequence
  chemically synthesized
ttgggctatattatgctaatta

SEQ ID NO: 160629 - DNA, 22 bp, Artificial Sequence
  chemically synthesized
ggctatattatgctaattataa

SEQ ID NO: 160630 - DNA, 22 bp, Artificial Sequence
  chemically synthesized
tattatgctaattataactctg

SEQ ID NO: 160631 - DNA, 22 bp, Artificial Sequence
  chemically synthesized
tgctaattataactctgaacat

SEQ ID NO: 160632 - DNA, 22 bp, Artificial Sequence
  chemically synthesized
attataactctgaacattttaa

SEQ ID NO: 160633 - DNA, 22 bp, Artificial Sequence
  chemically synthesized
taactctgaacattttaaaacc

SEQ ID NO: 160634 - DNA, 22 bp, Artificial Sequence
  chemically synthesized
tgaacattttaaaaccaggaaa

SEQ ID NO: 160635 - DNA, 22 bp, Artificial Sequence
  chemically synthesized
aacattttaaaaccaggaaact

SEQ ID NO: 160636 - DNA, 22 bp, Artificial Sequence
  chemically synthesized
taaaaccaggaaactggactct

SEQ ID NO: 160637 - DNA, 22 bp, Artificial Sequence
  chemically synthesized
aaaaccaggaaactggactcta

SEQ ID NO: 160638 - DNA, 22 bp, Artificial Sequence
  chemically synthesized
aaaccaggaaactggactctat

SEQ ID NO: 160639 - DNA, 22 bp, Artificial Sequence
  chemically synthesized
gactctattctggctaaatgat

SEQ ID NO: 160640 - DNA, 22 bp, Artificial Sequence
  chemically synthesized
tattctggctaaatgattcatt

SEQ ID NO: 160641 - DNA, 22 bp, Artificial Sequence
  chemically synthesized
ttctggctaaatgattcatttg

SEQ ID NO: 160642 - DNA, 22 bp, Artificial Sequence
  chemically synthesized
tggctaaatgattcatttgccc

SEQ ID NO: 160643 - DNA, 22 bp, Artificial Sequence
  chemically synthesized
gctaaatgattcatttgcccat

SEQ ID NO: 160644 - DNA, 22 bp, Artificial Sequence
  chemically synthesized
aatgattcatttgcccattatt

SEQ ID NO: 160645 - DNA, 22 bp, Artificial Sequence
  chemically synthesized
atttgcccattattcagtatct

SEQ ID NO: 160646 - DNA, 22 bp, Artificial Sequence
  chemically synthesized
gcccattattcagtatctgtgg

SEQ ID NO: 160647 - DNA, 22 bp, Artificial Sequence
  chemically synthesized
cccattattcagtatctgtggt

SEQ ID NO: 160648 - DNA, 22 bp, Artificial Sequence
  chemically synthesized
ttcagtatctgtggtttatcag

SEQ ID NO: 160649 - DNA, 22 bp, Artificial Sequence
  chemically synthesized
agtatctgtggtttatcaggag

SEQ ID NO: 160650 - DNA, 22 bp, Artificial Sequence
  chemically synthesized
tggtttatcaggagcaagttct

SEQ ID NO: 160651 - DNA, 22 bp, Artificial Sequence
  chemically synthesized
atcaggagcaagttctcttgcc

SEQ ID NO: 160652 - DNA, 22 bp, Artificial Sequence
  chemically synthesized
tcaggagcaagttctcttgccg

SEQ ID NO: 160653 - DNA, 22 bp, Artificial Sequence
  chemically synthesized
tcttgccgtaggcattgctgct

SEQ ID NO: 160654 - DNA, 22 bp, Artificial Sequence
  chemically synthesized
ttgccgtaggcattgctgctgc

SEQ ID NO: 160655 - DNA, 22 bp, Artificial Sequence
  chemically synthesized
gccgtaggcattgctgctgctc

SEQ ID NO: 160656 - DNA, 22 bp, Artificial Sequence
  chemically synthesized
ccgtaggcattgctgctgctca

SEQ ID NO: 160657 - DNA, 22 bp, Artificial Sequence
  chemically synthesized
ctgctgctcatcttgtccctta

SEQ ID NO: 160658 - DNA, 22 bp, Artificial Sequence
  chemically synthesized
ctgctcatcttgtcccttagca

SEQ ID NO: 160659 - DNA, 22 bp, Artificial Sequence
  chemically synthesized
ctcatcttgtcccttagcagtt

SEQ ID NO: 160660 - DNA, 22 bp, Artificial Sequence
  chemically synthesized
atcttgtcccttagcagttcct

SEQ ID NO: 160661 - DNA, 22 bp, Artificial Sequence
  chemically synthesized
gtcccttagcagttccttctct

SEQ ID NO: 160662 - DNA, 22 bp, Artificial Sequence
  chemically synthesized
tcccttagcagttccttctctc

SEQ ID NO: 160663 - DNA, 22 bp, Artificial Sequence
  chemically synthesized
agcagttccttctctctagata

SEQ ID NO: 160664 - DNA, 22 bp, Artificial Sequence
  chemically synthesized
gcagttccttctctctagatat

SEQ ID NO: 160665 - DNA, 22 bp, Artificial Sequence
  chemically synthesized
cttctctctagatattccataa

SEQ ID NO: 160666 - DNA, 22 bp, Artificial Sequence
  chemically synthesized
ctctctagatattccataaagt

SEQ ID NO: 160667 - DNA, 22 bp, Artificial Sequence
  chemically synthesized
tctctagatattccataaagtg

SEQ ID NO: 160668 - DNA, 22 bp, Artificial Sequence
  chemically synthesized
tctagatattccataaagtgta

SEQ ID NO: 160669 - DNA, 22 bp, Artificial Sequence
  chemically synthesized
tagatattccataaagtgtatt

SEQ ID NO: 160670 - DNA, 22 bp, Artificial Sequence
  chemically synthesized
gatattccataaagtgtattaa

SEQ ID NO: 160671 - DNA, 22 bp, Artificial Sequence
  chemically synthesized
cataaagtgtattaaaatttta

SEQ ID NO: 160672 - DNA, 22 bp, Artificial Sequence
  chemically synthesized
aaattttaaactcacaacattt

SEQ ID NO: 160673 - DNA, 22 bp, Artificial Sequence
  chemically synthesized
taaactcacaacatttcaagag

SEQ ID NO: 160674 - DNA, 22 bp, Artificial Sequence
  chemically synthesized
aaactcacaacatttcaagagt

SEQ ID NO: 160675 - DNA, 22 bp, Artificial Sequence
  chemically synthesized
aactcacaacatttcaagagtt

SEQ ID NO: 160676 - DNA, 22 bp, Artificial Sequence
  chemically synthesized
acaacatttcaagagtttcagc

SEQ ID NO: 160677 - DNA, 22 bp, Artificial Sequence
  chemically synthesized
caagagtttcagctgtttaaaa

SEQ ID NO: 160678 - DNA, 22 bp, Artificial Sequence
  chemically synthesized
aagagtttcagctgtttaaaat

SEQ ID NO: 160679 - DNA, 22 bp, Artificial Sequence
  chemically synthesized
cagctgtttaaaatatatagga

SEQ ID NO: 160680 - DNA, 22 bp, Artificial Sequence
  chemically synthesized
agctgtttaaaatatataggaa

SEQ ID NO: 160681 - DNA, 22 bp, Artificial Sequence
  chemically synthesized
tttaaaatatataggaaaaaat

SEQ ID NO: 160682 - DNA, 22 bp, Artificial Sequence
  chemically synthesized
aaaatatataggaaaaaatata

SEQ ID NO: 160683 - DNA, 22 bp, Artificial Sequence
  chemically synthesized
aaatatataggaaaaaatataa

SEQ ID NO: 160684 - DNA, 22 bp, Artificial Sequence
  chemically synthesized
cctttaactttaaagaaatata

SEQ ID NO: 160685 - DNA, 22 bp, Artificial Sequence
  chemically synthesized
taactttaaagaaatataaaaa

SEQ ID NO: 160686 - DNA, 22 bp, Artificial Sequence
  chemically synthesized
aactttaaagaaatataaaaag

SEQ ID NO: 160687 - DNA, 22 bp, Artificial Sequence
  chemically synthesized
actttaaagaaatataaaaagc

SEQ ID NO: 160688 - DNA, 22 bp, Artificial Sequence
  chemically synthesized
taaagaaatataaaaagcaacc

SEQ ID NO: 160689 - DNA, 22 bp, Artificial Sequence
  chemically synthesized
aaagaaatataaaaagcaacca

SEQ ID NO: 160690 - DNA, 22 bp, Artificial Sequence
  chemically synthesized
aagaaatataaaaagcaaccag

SEQ ID NO: 160691 - DNA, 22 bp, Artificial Sequence
  chemically synthesized
tggctcagatttgtcaaaagta

SEQ ID NO: 160692 - DNA, 22 bp, Artificial Sequence
  chemically synthesized
ggctcagatttgtcaaaagtat

SEQ ID NO: 160693 - DNA, 22 bp, Artificial Sequence
  chemically synthesized
gctcagatttgtcaaaagtata

SEQ ID NO: 160694 - DNA, 22 bp, Artificial Sequence
  chemically synthesized
agatttgtcaaaagtataaaga

SEQ ID NO: 160695 - DNA, 22 bp, Artificial Sequence
  chemically synthesized
gtcaaaagtataaagatttcaa

SEQ ID NO: 160696 - DNA, 22 bp, Artificial Sequence
  chemically synthesized
tcaaaagtataaagatttcaat

SEQ ID NO: 160697 - DNA, 22 bp, Artificial Sequence
  chemically synthesized
caattatttctaaagcattctc

SEQ ID NO: 160698 - DNA, 22 bp, Artificial Sequence
  chemically synthesized
aattatttctaaagcattctct

SEQ ID NO: 160699 - DNA, 22 bp, Artificial Sequence
  chemically synthesized
tttctaaagcattctctttaca

SEQ ID NO: 160700 - DNA, 22 bp, Artificial Sequence
  chemically synthesized
ctaaagcattctctttacatta

SEQ ID NO: 160701 - DNA, 22 bp, Artificial Sequence
  chemically synthesized
taaagcattctctttacattat

SEQ ID NO: 160702 - DNA, 22 bp, Artificial Sequence
  chemically synthesized
aagcattctctttacattattc

SEQ ID NO: 160703 - DNA, 22 bp, Artificial Sequence
  chemically synthesized
tctttacattattctgaatata

SEQ ID NO: 160704 - DNA, 22 bp, Artificial Sequence
  chemically synthesized
tttacattattctgaatataaa

SEQ ID NO: 160705 - DNA, 22 bp, Artificial Sequence
  chemically synthesized
tacattattctgaatataaaaa

SEQ ID NO: 160706 - DNA, 22 bp, Artificial Sequence
  chemically synthesized
acattattctgaatataaaaag

SEQ ID NO: 160707 - DNA, 22 bp, Artificial Sequence
  chemically synthesized
cattattctgaatataaaaaga

SEQ ID NO: 160708 - DNA, 22 bp, Artificial Sequence
  chemically synthesized
ttctgaatataaaaagaaatat

SEQ ID NO: 160709 - DNA, 22 bp, Artificial Sequence
  chemically synthesized
tgaatataaaaagaaatatatt

SEQ ID NO: 160710 - DNA, 22 bp, Artificial Sequence
  chemically synthesized
aatataaaaagaaatatattat

SEQ ID NO: 160711 - DNA, 22 bp, Artificial Sequence
  chemically synthesized
tgttcttgggtgtcaattattt

SEQ ID NO: 160712 - DNA, 22 bp, Artificial Sequence
  chemically synthesized
ttgggtgtcaattatttctacc

SEQ ID NO: 160713 - DNA, 22 bp, Artificial Sequence
  chemically synthesized
gggtgtcaattatttctacctc

SEQ ID NO: 160714 - DNA, 22 bp, Artificial Sequence
  chemically synthesized
ggtgtcaattatttctacctct

SEQ ID NO: 160715 - DNA, 22 bp, Artificial Sequence
  chemically synthesized
tttctacctctattctctttca

SEQ ID NO: 160716 - DNA, 22 bp, Artificial Sequence
  chemically synthesized
ctacctctattctctttcattg

SEQ ID NO: 160717 - DNA, 22 bp, Artificial Sequence
  chemically synthesized
tacctctattctctttcattgg

SEQ ID NO: 160718 - DNA, 22 bp, Artificial Sequence
  chemically synthesized
cctctattctctttcattggga

SEQ ID NO: 160719 - DNA, 22 bp, Artificial Sequence
  chemically synthesized
tattctctttcattgggaatct

SEQ ID NO: 160720 - DNA, 22 bp, Artificial Sequence
  chemically synthesized
ttctctttcattgggaatcttt

SEQ ID NO: 160721 - DNA, 22 bp, Artificial Sequence
  chemically synthesized
tctttcattgggaatcttttac

SEQ ID NO: 160722 - DNA, 22 bp, Artificial Sequence
  chemically synthesized
tttcattgggaatcttttacac

SEQ ID NO: 160723 - DNA, 22 bp, Artificial Sequence
  chemically synthesized
tcattgggaatcttttacacca

SEQ ID NO: 160724 - DNA, 22 bp, Artificial Sequence
  chemically synthesized
cattgggaatcttttacaccaa

SEQ ID NO: 160725 - DNA, 22 bp, Artificial Sequence
  chemically synthesized
attgggaatcttttacaccaat

SEQ ID NO: 160726 - DNA, 22 bp, Artificial Sequence
  chemically synthesized
ggaatcttttacaccaatgtac

SEQ ID NO: 160727 - DNA, 22 bp, Artificial Sequence
  chemically synthesized
ttacaccaatgtactggtcaga

SEQ ID NO: 160728 - DNA, 22 bp, Artificial Sequence
  chemically synthesized
tacaccaatgtactggtcagag

SEQ ID NO: 160729 - DNA, 22 bp, Artificial Sequence
  chemically synthesized
acaccaatgtactggtcagagt

SEQ ID NO: 160730 - DNA, 22 bp, Artificial Sequence
  chemically synthesized
caccaatgtactggtcagagtc

SEQ ID NO: 160731 - DNA, 22 bp, Artificial Sequence
  chemically synthesized
gtcagagtctgttaatttgctt

SEQ ID NO: 160732 - DNA, 22 bp, Artificial Sequence
  chemically synthesized
ttaatttgcttgtctaaaatgt

SEQ ID NO: 160733 - DNA, 22 bp, Artificial Sequence
  chemically synthesized
atttgcttgtctaaaatgttct

SEQ ID NO: 160734 - DNA, 22 bp, Artificial Sequence
  chemically synthesized
gcttgtctaaaatgttcttaaa

SEQ ID NO: 160735 - DNA, 22 bp, Artificial Sequence
  chemically synthesized
cttgtctaaaatgttcttaaag

SEQ ID NO: 160736 - DNA, 22 bp, Artificial Sequence
  chemically synthesized
gtctaaaatgttcttaaagaaa

SEQ ID NO: 160737 - DNA, 22 bp, Artificial Sequence
  chemically synthesized
tctaaaatgttcttaaagaaaa

SEQ ID NO: 160738 - DNA, 22 bp, Artificial Sequence
  chemically synthesized
aaatgttcttaaagaaaattgg

SEQ ID NO: 160739 - DNA, 22 bp, Artificial Sequence
  chemically synthesized
ttaaagaaaattggaaatagtt

SEQ ID NO: 160740 - DNA, 22 bp, Artificial Sequence
  chemically synthesized
aaagaaaattggaaatagttaa

SEQ ID NO: 160741 - DNA, 22 bp, Artificial Sequence
  chemically synthesized
aagaaaattggaaatagttaaa

SEQ ID NO: 160742 - DNA, 22 bp, Artificial Sequence
  chemically synthesized
gaaatagttaaatactagagga

SEQ ID NO: 160743 - DNA, 22 bp, Artificial Sequence
  chemically synthesized
aatactagaggaatagctgaaa

SEQ ID NO: 160744 - DNA, 22 bp, Artificial Sequence
  chemically synthesized
gaggaatagctgaaatgtgaaa

SEQ ID NO: 160745 - DNA, 22 bp, Artificial Sequence
  chemically synthesized
aaatgtgaaatatggagaggtt

SEQ ID NO: 160746 - DNA, 22 bp, Artificial Sequence
  chemically synthesized
attaaccaaattaaaatgcaat

SEQ ID NO: 160747 - DNA, 22 bp, Artificial Sequence
  chemically synthesized
ttaaccaaattaaaatgcaatg

SEQ ID NO: 160748 - DNA, 22 bp, Artificial Sequence
  chemically synthesized
accaaattaaaatgcaatgtcc

SEQ ID NO: 160749 - DNA, 22 bp, Artificial Sequence
  chemically synthesized
aaatgcaatgtccaataaaaat

SEQ ID NO: 160750 - DNA, 22 bp, Artificial Sequence
  chemically synthesized
ctttttttttttgtccacaggt

SEQ ID NO: 160751 - DNA, 22 bp, Artificial Sequence
  chemically synthesized
tttttttttttgtccacaggtc

SEQ ID NO: 160752 - DNA, 22 bp, Artificial Sequence
  chemically synthesized
tttttttttgtccacaggtctg

SEQ ID NO: 160753 - DNA, 22 bp, Artificial Sequence
  chemically synthesized
ttttttttgtccacaggtctgg

SEQ ID NO: 160754 - DNA, 22 bp, Artificial Sequence
  chemically synthesized
tttttttgtccacaggtctgga

SEQ ID NO: 160755 - DNA, 22 bp, Artificial Sequence
  chemically synthesized
ttttttgtccacaggtctggaa

SEQ ID NO: 160756 - DNA, 22 bp, Artificial Sequence
  chemically synthesized
tttttgtccacaggtctggaaa

SEQ ID NO: 160757 - DNA, 22 bp, Artificial Sequence
  chemically synthesized
ttttgtccacaggtctggaaag

SEQ ID NO: 160758 - DNA, 22 bp, Artificial Sequence
  chemically synthesized
tttgtccacaggtctggaaaga

SEQ ID NO: 160759 - DNA, 22 bp, Artificial Sequence
  chemically synthesized
ttgtccacaggtctggaaagaa

SEQ ID NO: 160760 - DNA, 22 bp, Artificial Sequence
  chemically synthesized
tgtccacaggtctggaaagaaa

SEQ ID NO: 160761 - DNA, 22 bp, Artificial Sequence
  chemically synthesized
gtccacaggtctggaaagaaat

SEQ ID NO: 160762 - DNA, 22 bp, Artificial Sequence
  chemically synthesized
tccacaggtctggaaagaaata

SEQ ID NO: 160763 - DNA, 22 bp, Artificial Sequence
  chemically synthesized
gaaagaaataacagactggcca

SEQ ID NO: 160764 - DNA, 22 bp, Artificial Sequence
  chemically synthesized
gccagtagtccaatcccctgtc

SEQ ID NO: 160765 - DNA, 22 bp, Artificial Sequence
  chemically synthesized
tccaggtgattttgctggttct

SEQ ID NO: 160766 - DNA, 22 bp, Artificial Sequence
  chemically synthesized
tgctggttctaatgtatttgga

SEQ ID NO: 160767 - DNA, 22 bp, Artificial Sequence
  chemically synthesized
gctggttctaatgtatttggat

SEQ ID NO: 160768 - DNA, 22 bp, Artificial Sequence
  chemically synthesized
ctggttctaatgtatttggatt

SEQ ID NO: 160769 - DNA, 22 bp, Artificial Sequence
  chemically synthesized
gttctaatgtatttggattgcc

SEQ ID NO: 160770 - DNA, 22 bp, Artificial Sequence
  chemically synthesized
taatgtatttggattgccatgc

SEQ ID NO: 160771 - DNA, 22 bp, Artificial Sequence
  chemically synthesized
atgtatttggattgccatgcac

SEQ ID NO: 160772 - DNA, 22 bp, Artificial Sequence
  chemically synthesized
ggattgccatgcacataacatc

SEQ ID NO: 160773 - DNA, 22 bp, Artificial Sequence
  chemically synthesized
gattgccatgcacataacatcc

SEQ ID NO: 160774 - DNA, 22 bp, Artificial Sequence
  chemically synthesized
ccatgcacataacatcctatta

SEQ ID NO: 160775 - DNA, 22 bp, Artificial Sequence
  chemically synthesized
ttatggcacagtgcctgtgaat

SEQ ID NO: 160776 - DNA, 22 bp, Artificial Sequence
  chemically synthesized
tggcacagtgcctgtgaatgcc

SEQ ID NO: 160777 - DNA, 22 bp, Artificial Sequence
  chemically synthesized
tgaatgccccacctgaaaacag

SEQ ID NO: 160778 - DNA, 22 bp, Artificial Sequence
  chemically synthesized
aaaacagtgatgtatctccatg

SEQ ID NO: 160779 - DNA, 22 bp, Artificial Sequence
  chemically synthesized
catgaatccatcttttcctttc

SEQ ID NO: 160780 - DNA, 22 bp, Artificial Sequence
  chemically synthesized
ttcctttcaaaactgtgaataa

SEQ ID NO: 160781 - DNA, 22 bp, Artificial Sequence
  chemically synthesized
tcctttcaaaactgtgaataag

SEQ ID NO: 160782 - DNA, 22 bp, Artificial Sequence
  chemically synthesized
cctttcaaaactgtgaataaga

SEQ ID NO: 160783 - DNA, 22 bp, Artificial Sequence
  chemically synthesized
ctttcaaaactgtgaataagat

SEQ ID NO: 160784 - DNA, 22 bp, Artificial Sequence
  chemically synthesized
tcaaaactgtgaataagatgga

SEQ ID NO: 160785 - DNA, 22 bp, Artificial Sequence
  chemically synthesized
caaaactgtgaataagatggat

SEQ ID NO: 160786 - DNA, 22 bp, Artificial Sequence
  chemically synthesized
aaaactgtgaataagatggatg

SEQ ID NO: 160787 - DNA, 22 bp, Artificial Sequence
  chemically synthesized
tgaataagatggatgattttag

SEQ ID NO: 160788 - DNA, 22 bp, Artificial Sequence
  chemically synthesized
tagagttatacccaaatcagac

SEQ ID NO: 160789 - DNA, 22 bp, Artificial Sequence
  chemically synthesized
agagttatacccaaatcagaca

SEQ ID NO: 160790 - DNA, 22 bp, Artificial Sequence
  chemically synthesized
gagttatacccaaatcagacag

SEQ ID NO: 160791 - DNA, 22 bp, Artificial Sequence
  chemically synthesized
tacccaaatcagacagactcaa

SEQ ID NO: 160792 - DNA, 22 bp, Artificial Sequence
  chemically synthesized
aatataatgagtttggagaaaa

SEQ ID NO: 160793 - DNA, 22 bp, Artificial Sequence
  chemically synthesized
ggagaaaatcagaaagcagaag

SEQ ID NO: 160794 - DNA, 22 bp, Artificial Sequence
  chemically synthesized
gagaaaatcagaaagcagaaga

SEQ ID NO: 160795 - DNA, 22 bp, Artificial Sequence
  chemically synthesized
actgagaaacttcttttgtttg

SEQ ID NO: 160796 - DNA, 22 bp, Artificial Sequence
  chemically synthesized
agaaacttcttttgtttgcatc

SEQ ID NO: 160797 - DNA, 22 bp, Artificial Sequence
  chemically synthesized
cttttgtttgcatcaggagacc

SEQ ID NO: 160798 - DNA, 22 bp, Artificial Sequence
  chemically synthesized
ttttgtttgcatcaggagaccc

SEQ ID NO: 160799 - DNA, 22 bp, Artificial Sequence
  chemically synthesized
ttgtttgcatcaggagacccaa

SEQ ID NO: 160800 - DNA, 22 bp, Artificial Sequence
  chemically synthesized
tgtttgcatcaggagacccaac

SEQ ID NO: 160801 - DNA, 22 bp, Artificial Sequence
  chemically synthesized
gtttgcatcaggagacccaacg

SEQ ID NO: 160802 - DNA, 22 bp, Artificial Sequence
  chemically synthesized
tttgcatcaggagacccaacga

SEQ ID NO: 160803 - DNA, 22 bp, Artificial Sequence
  chemically synthesized
gcatcaggagacccaacgacac

SEQ ID NO: 160804 - DNA, 22 bp, Artificial Sequence
  chemically synthesized
catcaggagacccaacgacact

SEQ ID NO: 160805 - DNA, 22 bp, Artificial Sequence
  chemically synthesized
tgtccatttccaacatcacagt

SEQ ID NO: 160806 - DNA, 22 bp, Artificial Sequence
  chemically synthesized
ccaacatcacagtctacatgcc

SEQ ID NO: 160807 - DNA, 22 bp, Artificial Sequence
  chemically synthesized
caacatcacagtctacatgccc

SEQ ID NO: 160808 - DNA, 22 bp, Artificial Sequence
  chemically synthesized
catgccctctgtgttgacacta

SEQ ID NO: 160809 - DNA, 22 bp, Artificial Sequence
  chemically synthesized
tgtgttgacactagtagggatc

SEQ ID NO: 160810 - DNA, 22 bp, Artificial Sequence
  chemically synthesized
tgttgacactagtagggatccc

SEQ ID NO: 160811 - DNA, 22 bp, Artificial Sequence
  chemically synthesized
acactagtagggatcccaggcc

SEQ ID NO: 160812 - DNA, 22 bp, Artificial Sequence
  chemically synthesized
gtagggatcccaggcctagaat

SEQ ID NO: 160813 - DNA, 22 bp, Artificial Sequence
  chemically synthesized
gaatctgtgcagtgctggattg

SEQ ID NO: 160814 - DNA, 22 bp, Artificial Sequence
  chemically synthesized
tgcagtgctggattgggattcc

SEQ ID NO: 160815 - DNA, 22 bp, Artificial Sequence
  chemically synthesized
gattgggattccattctgtgcc

SEQ ID NO: 160816 - DNA, 22 bp, Artificial Sequence
  chemically synthesized
ggattccattctgtgccattta

SEQ ID NO: 160817 - DNA, 22 bp, Artificial Sequence
  chemically synthesized
cattctgtgccatttatctcat

SEQ ID NO: 160818 - DNA, 22 bp, Artificial Sequence
  chemically synthesized
tgtgccatttatctcattgcta

SEQ ID NO: 160819 - DNA, 22 bp, Artificial Sequence
  chemically synthesized
tgccatttatctcattgctatg

SEQ ID NO: 160820 - DNA, 22 bp, Artificial Sequence
  chemically synthesized
atctcattgctatgattggaaa

SEQ ID NO: 160821 - DNA, 22 bp, Artificial Sequence
  chemically synthesized
tctcattgctatgattggaaat

SEQ ID NO: 160822 - DNA, 22 bp, Artificial Sequence
  chemically synthesized
attgctatgattggaaattcct

SEQ ID NO: 160823 - DNA, 22 bp, Artificial Sequence
  chemically synthesized
ctatgattggaaattccttgct

SEQ ID NO: 160824 - DNA, 22 bp, Artificial Sequence
  chemically synthesized
tgattggaaattccttgcttct

SEQ ID NO: 160825 - DNA, 22 bp, Artificial Sequence
  chemically synthesized
gaaattccttgcttctgagcat

SEQ ID NO: 160826 - DNA, 22 bp, Artificial Sequence
  chemically synthesized
cttgcttctgagcatcatcaaa

SEQ ID NO: 160827 - DNA, 22 bp, Artificial Sequence
  chemically synthesized
gcttctgagcatcatcaaatct

SEQ ID NO: 160828 - DNA, 22 bp, Artificial Sequence
  chemically synthesized
cttctgagcatcatcaaatctg

SEQ ID NO: 160829 - DNA, 22 bp, Artificial Sequence
  chemically synthesized
ctgagcatcatcaaatctgagc

SEQ ID NO: 160830 - DNA, 22 bp, Artificial Sequence
  chemically synthesized
tgagcatcatcaaatctgagcg

SEQ ID NO: 160831 - DNA, 22 bp, Artificial Sequence
  chemically synthesized
agcatcatcaaatctgagcgca

SEQ ID NO: 160832 - DNA, 22 bp, Artificial Sequence
  chemically synthesized
agcgcagtctccatgagccctt

SEQ ID NO: 160833 - DNA, 22 bp, Artificial Sequence
  chemically synthesized
catgagcccttgtacattttct

SEQ ID NO: 160834 - DNA, 22 bp, Artificial Sequence
  chemically synthesized
gtacattttcttaggcatgcta

SEQ ID NO: 160835 - DNA, 22 bp, Artificial Sequence
  chemically synthesized
tacattttcttaggcatgctag

SEQ ID NO: 160836 - DNA, 22 bp, Artificial Sequence
  chemically synthesized
tcttaggcatgctaggagccac

SEQ ID NO: 160837 - DNA, 22 bp, Artificial Sequence
  chemically synthesized
cttaggcatgctaggagccaca

SEQ ID NO: 160838 - DNA, 22 bp, Artificial Sequence
  chemically synthesized
ttaggcatgctaggagccacag

SEQ ID NO: 160839 - DNA, 22 bp, Artificial Sequence
  chemically synthesized
aggcatgctaggagccacagac

SEQ ID NO: 160840 - DNA, 22 bp, Artificial Sequence
  chemically synthesized
ggcatgctaggagccacagaca

SEQ ID NO: 160841 - DNA, 22 bp, Artificial Sequence
  chemically synthesized
ggagccacagacattgcacttg

SEQ ID NO: 160842 - DNA, 22 bp, Artificial Sequence
  chemically synthesized
cacttgctagcagcattatgcc

SEQ ID NO: 160843 - DNA, 22 bp, Artificial Sequence
  chemically synthesized
gctagcagcattatgccaaaga

SEQ ID NO: 160844 - DNA, 22 bp, Artificial Sequence
  chemically synthesized
ctagcagcattatgccaaagat

SEQ ID NO: 160845 - DNA, 22 bp, Artificial Sequence
  chemically synthesized
gcagcattatgccaaagatgct

SEQ ID NO: 160846 - DNA, 22 bp, Artificial Sequence
  chemically synthesized
tgccaaagatgcttggaatatt

SEQ ID NO: 160847 - DNA, 22 bp, Artificial Sequence
  chemically synthesized
ggaatattctggtttaatgtgc

SEQ ID NO: 160848 - DNA, 22 bp, Artificial Sequence
  chemically synthesized
gaatattctggtttaatgtgcc

SEQ ID NO: 160849 - DNA, 22 bp, Artificial Sequence
  chemically synthesized
tggtttaatgtgcctgaaatct

SEQ ID NO: 160850 - DNA, 22 bp, Artificial Sequence
  chemically synthesized
gtttaatgtgcctgaaatctat

SEQ ID NO: 160851 - DNA, 22 bp, Artificial Sequence
  chemically synthesized
aatgtgcctgaaatctattttg

SEQ ID NO: 160852 - DNA, 22 bp, Artificial Sequence
  chemically synthesized
atgtgcctgaaatctattttga

SEQ ID NO: 160853 - DNA, 22 bp, Artificial Sequence
  chemically synthesized
aaatctattttgattcctgctt

SEQ ID NO: 160854 - DNA, 22 bp, Artificial Sequence
  chemically synthesized
ttttgattcctgcttgcttcaa

SEQ ID NO: 160855 - DNA, 22 bp, Artificial Sequence
  chemically synthesized
tgattcctgcttgcttcaaatg

SEQ ID NO: 160856 - DNA, 22 bp, Artificial Sequence
  chemically synthesized
gattcctgcttgcttcaaatgt

SEQ ID NO: 160857 - DNA, 22 bp, Artificial Sequence
  chemically synthesized
attcctgcttgcttcaaatgtg

SEQ ID NO: 160858 - DNA, 22 bp, Artificial Sequence
  chemically synthesized
ctgcttgcttcaaatgtggttc

SEQ ID NO: 160859 - DNA, 22 bp, Artificial Sequence
  chemically synthesized
cttgcttcaaatgtggttcatc

SEQ ID NO: 160860 - DNA, 22 bp, Artificial Sequence
  chemically synthesized
gcttcaaatgtggttcatccac

SEQ ID NO: 160861 - DNA, 22 bp, Artificial Sequence
  chemically synthesized
cttcaaatgtggttcatccaca

SEQ ID NO: 160862 - DNA, 22 bp, Artificial Sequence
  chemically synthesized
caaatgtggttcatccacacat

SEQ ID NO: 160863 - DNA, 22 bp, Artificial Sequence
  chemically synthesized
aaatgtggttcatccacacatt

SEQ ID NO: 160864 - DNA, 22 bp, Artificial Sequence
  chemically synthesized
atccacacattgcagggtatag

SEQ ID NO: 160865 - DNA, 22 bp, Artificial Sequence
  chemically synthesized
cagggtatagagtcaggcatcc

SEQ ID NO: 160866 - DNA, 22 bp, Artificial Sequence
  chemically synthesized
gtggccatggccctggaccgtt

SEQ ID NO: 160867 - DNA, 22 bp, Artificial Sequence
  chemically synthesized
tggccatggccctggaccgtta

SEQ ID NO: 160868 - DNA, 22 bp, Artificial Sequence
  chemically synthesized
gaccgttatgtggccatctgtt

SEQ ID NO: 160869 - DNA, 22 bp, Artificial Sequence
  chemically synthesized
tgtggccatctgttatccacta

SEQ ID NO: 160870 - DNA, 22 bp, Artificial Sequence
  chemically synthesized
ttatccactaagacatgccaac

SEQ ID NO: 160871 - DNA, 22 bp, Artificial Sequence
  chemically synthesized
tccactaagacatgccaacatc

SEQ ID NO: 160872 - DNA, 22 bp, Artificial Sequence
  chemically synthesized
agacatgccaacatcttcaccc

SEQ ID NO: 160873 - DNA, 22 bp, Artificial Sequence
  chemically synthesized
cacccaccagcttgtcattcag

SEQ ID NO: 160874 - DNA, 22 bp, Artificial Sequence
  chemically synthesized
acccaccagcttgtcattcaga

SEQ ID NO: 160875 - DNA, 22 bp, Artificial Sequence
  chemically synthesized
gtcattcagataggaactatgg

SEQ ID NO: 160876 - DNA, 22 bp, Artificial Sequence
  chemically synthesized
tcattcagataggaactatggt

SEQ ID NO: 160877 - DNA, 22 bp, Artificial Sequence
  chemically synthesized
agataggaactatggtcgtact

SEQ ID NO: 160878 - DNA, 22 bp, Artificial Sequence
  chemically synthesized
tggtcgtactcagggctgctat

SEQ ID NO: 160879 - DNA, 22 bp, Artificial Sequence
  chemically synthesized
agggctgctattcttgtagccc

SEQ ID NO: 160880 - DNA, 22 bp, Artificial Sequence
  chemically synthesized
ctattcttgtagccccatgcct

SEQ ID NO: 160881 - DNA, 22 bp, Artificial Sequence
  chemically synthesized
ttcttgtagccccatgcctagt

SEQ ID NO: 160882 - DNA, 22 bp, Artificial Sequence
  chemically synthesized
ttgtagccccatgcctagtact

SEQ ID NO: 160883 - DNA, 22 bp, Artificial Sequence
  chemically synthesized
gtagccccatgcctagtactga

SEQ ID NO: 160884 - DNA, 22 bp, Artificial Sequence
  chemically synthesized
tagccccatgcctagtactgat

SEQ ID NO: 160885 - DNA, 22 bp, Artificial Sequence
  chemically synthesized
gtactgataaagtgccggtttc

SEQ ID NO: 160886 - DNA, 22 bp, Artificial Sequence
  chemically synthesized
ataaagtgccggtttcaatttt

SEQ ID NO: 160887 - DNA, 22 bp, Artificial Sequence
  chemically synthesized
caattttatcacacaacagtca

SEQ ID NO: 160888 - DNA, 22 bp, Artificial Sequence
  chemically synthesized
aattttatcacacaacagtcat

SEQ ID NO: 160889 - DNA, 22 bp, Artificial Sequence
  chemically synthesized
tatcacacaacagtcatctccc

SEQ ID NO: 160890 - DNA, 22 bp, Artificial Sequence
  chemically synthesized
atcacacaacagtcatctccca

SEQ ID NO: 160891 - DNA, 22 bp, Artificial Sequence
  chemically synthesized
tcacacaacagtcatctcccac

SEQ ID NO: 160892 - DNA, 22 bp, Artificial Sequence
  chemically synthesized
ccactcctactgtgagcatatg

SEQ ID NO: 160893 - DNA, 22 bp, Artificial Sequence
  chemically synthesized
ctactgtgagcatatggccatt

SEQ ID NO: 160894 - DNA, 22 bp, Artificial Sequence
  chemically synthesized
ctgtgagcatatggccattgtg

SEQ ID NO: 160895 - DNA, 22 bp, Artificial Sequence
  chemically synthesized
tgagcatatggccattgtgaaa

SEQ ID NO: 160896 - DNA, 22 bp, Artificial Sequence
  chemically synthesized
tgaaactagcagcagcaaatgt

SEQ ID NO: 160897 - DNA, 22 bp, Artificial Sequence
  chemically synthesized
gcagcagcaaatgttcaagtca

SEQ ID NO: 160898 - DNA, 22 bp, Artificial Sequence
  chemically synthesized
aagtcaacaaaatctatggttt

SEQ ID NO: 160899 - DNA, 22 bp, Artificial Sequence
  chemically synthesized
tggtttgtttgtggccttcact

SEQ ID NO: 160900 - DNA, 22 bp, Artificial Sequence
  chemically synthesized
gtttgtggccttcactgtagca

SEQ ID NO: 160901 - DNA, 22 bp, Artificial Sequence
  chemically synthesized
tttgtggccttcactgtagcag

SEQ ID NO: 160902 - DNA, 22 bp, Artificial Sequence
  chemically synthesized
gtggccttcactgtagcaggat

SEQ ID NO: 160903 - DNA, 22 bp, Artificial Sequence
  chemically synthesized
tggccttcactgtagcaggatt

SEQ ID NO: 160904 - DNA, 22 bp, Artificial Sequence
  chemically synthesized
cactgtagcaggatttgacctc

SEQ ID NO: 160905 - DNA, 22 bp, Artificial Sequence
  chemically synthesized
actgtagcaggatttgacctca

SEQ ID NO: 160906 - DNA, 22 bp, Artificial Sequence
  chemically synthesized
tagcaggatttgacctcacatt

SEQ ID NO: 160907 - DNA, 22 bp, Artificial Sequence
  chemically synthesized
gacctcacattcatcacattgt

SEQ ID NO: 160908 - DNA, 22 bp, Artificial Sequence
  chemically synthesized
acctcacattcatcacattgtc

SEQ ID NO: 160909 - DNA, 22 bp, Artificial Sequence
  chemically synthesized
acattcatcacattgtcctaca

SEQ ID NO: 160910 - DNA, 22 bp, Artificial Sequence
  chemically synthesized
atcacattgtcctacatccaga

SEQ ID NO: 160911 - DNA, 22 bp, Artificial Sequence
  chemically synthesized
tcctacatccagatatttatca

SEQ ID NO: 160912 - DNA, 22 bp, Artificial Sequence
  chemically synthesized
catccagatatttatcacagtt

SEQ ID NO: 160913 - DNA, 22 bp, Artificial Sequence
  chemically synthesized
atcacagtttttcgtttgcccc

SEQ ID NO: 160914 - DNA, 22 bp, Artificial Sequence
  chemically synthesized
tcacagtttttcgtttgcccca

SEQ ID NO: 160915 - DNA, 22 bp, Artificial Sequence
  chemically synthesized
ttcgtttgccccagaaggaggc

SEQ ID NO: 160916 - DNA, 22 bp, Artificial Sequence
  chemically synthesized
tcgtttgccccagaaggaggct

SEQ ID NO: 160917 - DNA, 22 bp, Artificial Sequence
  chemically synthesized
cgtttgccccagaaggaggcta

SEQ ID NO: 160918 - DNA, 22 bp, Artificial Sequence
  chemically synthesized
gtttgccccagaaggaggctag

SEQ ID NO: 160919 - DNA, 22 bp, Artificial Sequence
  chemically synthesized
gccccagaaggaggctaggttt

SEQ ID NO: 160920 - DNA, 22 bp, Artificial Sequence
  chemically synthesized
ccccagaaggaggctaggttta

SEQ ID NO: 160921 - DNA, 22 bp, Artificial Sequence
  chemically synthesized
ggtttaaagcattcaatacctg

SEQ ID NO: 160922 - DNA, 22 bp, Artificial Sequence
  chemically synthesized
aaagcattcaatacctgcattg

SEQ ID NO: 160923 - DNA, 22 bp, Artificial Sequence
  chemically synthesized
aagcattcaatacctgcattgc

SEQ ID NO: 160924 - DNA, 22 bp, Artificial Sequence
  chemically synthesized
aatacctgcattgctcacatct

SEQ ID NO: 160925 - DNA, 22 bp, Artificial Sequence
  chemically synthesized
cattgctcacatctgtgtcttc

SEQ ID NO: 160926 - DNA, 22 bp, Artificial Sequence
  chemically synthesized
ctcacatctgtgtcttcctcca

SEQ ID NO: 160927 - DNA, 22 bp, Artificial Sequence
  chemically synthesized
acatctgtgtcttcctccagtt

SEQ ID NO: 160928 - DNA, 22 bp, Artificial Sequence
  chemically synthesized
tgtcttcctccagttctacctc

SEQ ID NO: 160929 - DNA, 22 bp, Artificial Sequence
  chemically synthesized
cctccagttctacctccttgcc

SEQ ID NO: 160930 - DNA, 22 bp, Artificial Sequence
  chemically synthesized
ctccagttctacctccttgcct

SEQ ID NO: 160931 - DNA, 22 bp, Artificial Sequence
  chemically synthesized
cagttctacctccttgccttct

SEQ ID NO: 160932 - DNA, 22 bp, Artificial Sequence
  chemically synthesized
tacctccttgccttcttctcct

SEQ ID NO: 160933 - DNA, 22 bp, Artificial Sequence
  chemically synthesized
cctccttgccttcttctccttc

SEQ ID NO: 160934 - DNA, 22 bp, Artificial Sequence
  chemically synthesized
cttgccttcttctccttcttca

SEQ ID NO: 160935 - DNA, 22 bp, Artificial Sequence
  chemically synthesized
gccttcttctccttcttcacac

SEQ ID NO: 160936 - DNA, 22 bp, Artificial Sequence
  chemically synthesized
ccttcttctccttcttcacaca

SEQ ID NO: 160937 - DNA, 22 bp, Artificial Sequence
  chemically synthesized
cttctccttcttcacacatagg

SEQ ID NO: 160938 - DNA, 22 bp, Artificial Sequence
  chemically synthesized
ttctccttcttcacacataggt

SEQ ID NO: 160939 - DNA, 22 bp, Artificial Sequence
  chemically synthesized
ctccttcttcacacataggttt

SEQ ID NO: 160940 - DNA, 22 bp, Artificial Sequence
  chemically synthesized
tccttcttcacacataggtttg

SEQ ID NO: 160941 - DNA, 22 bp, Artificial Sequence
  chemically synthesized
cttcttcacacataggtttggg

SEQ ID NO: 160942 - DNA, 22 bp, Artificial Sequence
  chemically synthesized
cttcacacataggtttgggtct

SEQ ID NO: 160943 - DNA, 22 bp, Artificial Sequence
  chemically synthesized
ttcacacataggtttgggtctc

SEQ ID NO: 160944 - DNA, 22 bp, Artificial Sequence
  chemically synthesized
cacacataggtttgggtctcac

SEQ ID NO: 160945 - DNA, 22 bp, Artificial Sequence
  chemically synthesized
acacataggtttgggtctcaca

SEQ ID NO: 160946 - DNA, 22 bp, Artificial Sequence
  chemically synthesized
gggtctcacatctccccttata

SEQ ID NO: 160947 - DNA, 22 bp, Artificial Sequence
  chemically synthesized
ggtctcacatctccccttatat

SEQ ID NO: 160948 - DNA, 22 bp, Artificial Sequence
  chemically synthesized
acatctccccttatatccatat

SEQ ID NO: 160949 - DNA, 22 bp, Artificial Sequence
  chemically synthesized
cccttatatccatattctcttt

SEQ ID NO: 160950 - DNA, 22 bp, Artificial Sequence
  chemically synthesized
atatccatattctcttttctag

SEQ ID NO: 160951 - DNA, 22 bp, Artificial Sequence
  chemically synthesized
tatccatattctcttttctagc

SEQ ID NO: 160952 - DNA, 22 bp, Artificial Sequence
  chemically synthesized
tcttttctagcatttacttgct

SEQ ID NO: 160953 - DNA, 22 bp, Artificial Sequence
  chemically synthesized
ttttctagcatttacttgctgg

SEQ ID NO: 160954 - DNA, 22 bp, Artificial Sequence
  chemically synthesized
ttctagcatttacttgctggtc

SEQ ID NO: 160955 - DNA, 22 bp, Artificial Sequence
  chemically synthesized
tctagcatttacttgctggtcc

SEQ ID NO: 160956 - DNA, 22 bp, Artificial Sequence
  chemically synthesized
ctagcatttacttgctggtccc

SEQ ID NO: 160957 - DNA, 22 bp, Artificial Sequence
  chemically synthesized
tagcatttacttgctggtccct

SEQ ID NO: 160958 - DNA, 22 bp, Artificial Sequence
  chemically synthesized
gcatttacttgctggtccctcc

SEQ ID NO: 160959 - DNA, 22 bp, Artificial Sequence
  chemically synthesized
acttgctggtccctccatttct

SEQ ID NO: 160960 - DNA, 22 bp, Artificial Sequence
  chemically synthesized
cttgctggtccctccatttctc

SEQ ID NO: 160961 - DNA, 22 bp, Artificial Sequence
  chemically synthesized
gctggtccctccatttctcaat

SEQ ID NO: 160962 - DNA, 22 bp, Artificial Sequence
  chemically synthesized
ctggtccctccatttctcaatc

SEQ ID NO: 160963 - DNA, 22 bp, Artificial Sequence
  chemically synthesized
gtccctccatttctcaatccac

SEQ ID NO: 160964 - DNA, 22 bp, Artificial Sequence
  chemically synthesized
catttctcaatccacttgtcta

SEQ ID NO: 160965 - DNA, 22 bp, Artificial Sequence
  chemically synthesized
ctcaatccacttgtctatggtg

SEQ ID NO: 160966 - DNA, 22 bp, Artificial Sequence
  chemically synthesized
tcaatccacttgtctatggtgc

SEQ ID NO: 160967 - DNA, 22 bp, Artificial Sequence
  chemically synthesized
aatccacttgtctatggtgcaa

SEQ ID NO: 160968 - DNA, 22 bp, Artificial Sequence
  chemically synthesized
gtctatggtgcaaagaccacac

SEQ ID NO: 160969 - DNA, 22 bp, Artificial Sequence
  chemically synthesized
tctatggtgcaaagaccacaca

SEQ ID NO: 160970 - DNA, 22 bp, Artificial Sequence
  chemically synthesized
tggtgcaaagaccacacagatt

SEQ ID NO: 160971 - DNA, 22 bp, Artificial Sequence
  chemically synthesized
gcattcatgtggtaaaaatgtt

SEQ ID NO: 160972 - DNA, 22 bp, Artificial Sequence
  chemically synthesized
atgtggtaaaaatgttctgttc

SEQ ID NO: 160973 - DNA, 22 bp, Artificial Sequence
  chemically synthesized
tgttcataaaatccaccttaat

SEQ ID NO: 160974 - DNA, 22 bp, Artificial Sequence
  chemically synthesized
ttcataaaatccaccttaatta

SEQ ID NO: 160975 - DNA, 22 bp, Artificial Sequence
  chemically synthesized
ataaaatccaccttaattaatg

SEQ ID NO: 160976 - DNA, 22 bp, Artificial Sequence
  chemically synthesized
aattaatgcctacatgcttttt

SEQ ID NO: 160977 - DNA, 22 bp, Artificial Sequence
  chemically synthesized
attaatgcctacatgctttttt

SEQ ID NO: 160978 - DNA, 22 bp, Artificial Sequence
  chemically synthesized
atgcctacatgcttttttcttt

SEQ ID NO: 160979 - DNA, 22 bp, Artificial Sequence
  chemically synthesized
catgcttttttcttttgcagta

SEQ ID NO: 160980 - DNA, 22 bp, Artificial Sequence
  chemically synthesized
ttttcttttgcagtagtaacca

SEQ ID NO: 160981 - DNA, 22 bp, Artificial Sequence
  chemically synthesized
tttcttttgcagtagtaaccat

SEQ ID NO: 160982 - DNA, 22 bp, Artificial Sequence
  chemically synthesized
ttcttttgcagtagtaaccata

SEQ ID NO: 160983 - DNA, 22 bp, Artificial Sequence
  chemically synthesized
tcttttgcagtagtaaccatat

SEQ ID NO: 160984 - DNA, 22 bp, Artificial Sequence
  chemically synthesized
cttttgcagtagtaaccatatc

SEQ ID NO: 160985 - DNA, 22 bp, Artificial Sequence
  chemically synthesized
ttttgcagtagtaaccatatca

SEQ ID NO: 160986 - DNA, 22 bp, Artificial Sequence
  chemically synthesized
ttgcagtagtaaccatatcaaa

SEQ ID NO: 160987 - DNA, 22 bp, Artificial Sequence
  chemically synthesized
tgcagtagtaaccatatcaaaa

SEQ ID NO: 160988 - DNA, 22 bp, Artificial Sequence
  chemically synthesized
gcagtagtaaccatatcaaaac

SEQ ID NO: 160989 - DNA, 22 bp, Artificial Sequence
  chemically synthesized
cagtagtaaccatatcaaaaca

SEQ ID NO: 160990 - DNA, 22 bp, Artificial Sequence
  chemically synthesized
tttgagatgctgggtttgtgaa

SEQ ID NO: 160991 - DNA, 22 bp, Artificial Sequence
  chemically synthesized
gagatgctgggtttgtgaaatc

SEQ ID NO: 160992 - DNA, 22 bp, Artificial Sequence
  chemically synthesized
agatgctgggtttgtgaaatct

SEQ ID NO: 160993 - DNA, 22 bp, Artificial Sequence
  chemically synthesized
ggtttgtgaaatctgccagcac

SEQ ID NO: 160994 - DNA, 22 bp, Artificial Sequence
  chemically synthesized
gtgaaatctgccagcacaatag

SEQ ID NO: 160995 - DNA, 22 bp, Artificial Sequence
  chemically synthesized
tgaaatctgccagcacaatagc

SEQ ID NO: 160996 - DNA, 22 bp, Artificial Sequence
  chemically synthesized
ccagcacaatagctggttttag

SEQ ID NO: 160997 - DNA, 22 bp, Artificial Sequence
  chemically synthesized
gttttagatcatcatggctcat

SEQ ID NO: 160998 - DNA, 22 bp, Artificial Sequence
  chemically synthesized
tagatcatcatggctcatatca

SEQ ID NO: 160999 - DNA, 22 bp, Artificial Sequence
  chemically synthesized
agatcatcatggctcatatcaa

SEQ ID NO: 161000 - DNA, 22 bp, Artificial Sequence
  chemically synthesized
gatcatcatggctcatatcaat

SEQ ID NO: 161001 - DNA, 22 bp, Artificial Sequence
  chemically synthesized
atatcaatcagtgggattgtga

SEQ ID NO: 161002 - DNA, 22 bp, Artificial Sequence
  chemically synthesized
tgaattctacgtgactaatgaa

SEQ ID NO: 161003 - DNA, 22 bp, Artificial Sequence
  chemically synthesized
tacgtgactaatgaaagtgaga

SEQ ID NO: 161004 - DNA, 22 bp, Artificial Sequence
  chemically synthesized
cgtgactaatgaaagtgagaag

SEQ ID NO: 161005 - DNA, 22 bp, Artificial Sequence
  chemically synthesized
atgaaagtgagaagtgtgaaat

SEQ ID NO: 161006 - DNA, 22 bp, Artificial Sequence
  chemically synthesized
ttttttctcttttattctttag

SEQ ID NO: 161007 - DNA, 22 bp, Artificial Sequence
  chemically synthesized
tttctcttttattctttagccc

SEQ ID NO: 161008 - DNA, 22 bp, Artificial Sequence
  chemically synthesized
ttctcttttattctttagcccc

SEQ ID NO: 161009 - DNA, 22 bp, Artificial Sequence
  chemically synthesized
tctcttttattctttagcccct

SEQ ID NO: 161010 - DNA, 22 bp, Artificial Sequence
  chemically synthesized
ctcttttattctttagcccctg

SEQ ID NO: 161011 - DNA, 22 bp, Artificial Sequence
  chemically synthesized
tcttttattctttagcccctgg

SEQ ID NO: 161012 - DNA, 22 bp, Artificial Sequence
  chemically synthesized
ttttattctttagcccctggtt

SEQ ID NO: 161013 - DNA, 22 bp, Artificial Sequence
  chemically synthesized
ttattctttagcccctggttga

SEQ ID NO: 161014 - DNA, 22 bp, Artificial Sequence
  chemically synthesized
tattctttagcccctggttgag

SEQ ID NO: 161015 - DNA, 22 bp, Artificial Sequence
  chemically synthesized
attctttagcccctggttgagt

SEQ ID NO: 161016 - DNA, 22 bp, Artificial Sequence
  chemically synthesized
ttctttagcccctggttgagtt

SEQ ID NO: 161017 - DNA, 22 bp, Artificial Sequence
  chemically synthesized
tttagcccctggttgagttatt

SEQ ID NO: 161018 - DNA, 22 bp, Artificial Sequence
  chemically synthesized
tagcccctggttgagttattct

SEQ ID NO: 161019 - DNA, 22 bp, Artificial Sequence
  chemically synthesized
agcccctggttgagttattctt

SEQ ID NO: 161020 - DNA, 22 bp, Artificial Sequence
  chemically synthesized
gcccctggttgagttattcttc

SEQ ID NO: 161021 - DNA, 22 bp, Artificial Sequence
  chemically synthesized
gttgagttattcttctaagaat

SEQ ID NO: 161022 - DNA, 22 bp, Artificial Sequence
  chemically synthesized
agttattcttctaagaatattt

SEQ ID NO: 161023 - DNA, 22 bp, Artificial Sequence
  chemically synthesized
ttcttctaagaatatttctcca

SEQ ID NO: 161024 - DNA, 22 bp, Artificial Sequence
  chemically synthesized
ttctaagaatatttctccagga

SEQ ID NO: 161025 - DNA, 22 bp, Artificial Sequence
  chemically synthesized
ctaagaatatttctccaggagg

SEQ ID NO: 161026 - DNA, 22 bp, Artificial Sequence
  chemically synthesized
taagaatatttctccaggagga

SEQ ID NO: 161027 - DNA, 22 bp, Artificial Sequence
  chemically synthesized
agaatatttctccaggaggatt

SEQ ID NO: 161028 - DNA, 22 bp, Artificial Sequence
  chemically synthesized
ctccaggaggatttataaatta

SEQ ID NO: 161029 - DNA, 22 bp, Artificial Sequence
  chemically synthesized
tccaggaggatttataaattat

SEQ ID NO: 161030 - DNA, 22 bp, Artificial Sequence
  chemically synthesized
caggaggatttataaattatgc

SEQ ID NO: 161031 - DNA, 22 bp, Artificial Sequence
  chemically synthesized
ataaattatgcctttgtcactg

SEQ ID NO: 161032 - DNA, 22 bp, Artificial Sequence
  chemically synthesized
taaattatgcctttgtcactga

SEQ ID NO: 161033 - DNA, 22 bp, Artificial Sequence
  chemically synthesized
tgcctttgtcactgaatttaaa

SEQ ID NO: 161034 - DNA, 22 bp, Artificial Sequence
  chemically synthesized
tgtcactgaatttaaatgcacc

SEQ ID NO: 161035 - DNA, 22 bp, Artificial Sequence
  chemically synthesized
gtcactgaatttaaatgcacct

SEQ ID NO: 161036 - DNA, 22 bp, Artificial Sequence
  chemically synthesized
tcactgaatttaaatgcaccta

SEQ ID NO: 161037 - DNA, 22 bp, Artificial Sequence
  chemically synthesized
aatttaaatgcacctaaggctc

SEQ ID NO: 161038 - DNA, 22 bp, Artificial Sequence
  chemically synthesized
aaatgcacctaaggctcgttgt

SEQ ID NO: 161039 - DNA, 22 bp, Artificial Sequence
  chemically synthesized
aatgcacctaaggctcgttgtt

SEQ ID NO: 161040 - DNA, 22 bp, Artificial Sequence
  chemically synthesized
aggctcgttgttctgaaacatc

SEQ ID NO: 161041 - DNA, 22 bp, Artificial Sequence
  chemically synthesized
gttgttctgaaacatccaggga

SEQ ID NO: 161042 - DNA, 22 bp, Artificial Sequence
  chemically synthesized
ttctgaaacatccagggactca

SEQ ID NO: 161043 - DNA, 22 bp, Artificial Sequence
  chemically synthesized
tgaaacatccagggactcaatg

SEQ ID NO: 161044 - DNA, 22 bp, Artificial Sequence
  chemically synthesized
aaacatccagggactcaatgaa

SEQ ID NO: 161045 - DNA, 22 bp, Artificial Sequence
  chemically synthesized
aatgaaaacaagttgttgactc

SEQ ID NO: 161046 - DNA, 22 bp, Artificial Sequence
  chemically synthesized
ttgactctcattttcttgatca

SEQ ID NO: 161047 - DNA, 22 bp, Artificial Sequence
  chemically synthesized
actctcattttcttgatcatcc

SEQ ID NO: 161048 - DNA, 22 bp, Artificial Sequence
  chemically synthesized
tcattttcttgatcatccctgc

SEQ ID NO: 161049 - DNA, 22 bp, Artificial Sequence
  chemically synthesized
attttcttgatcatccctgcct

SEQ ID NO: 161050 - DNA, 22 bp, Artificial Sequence
  chemically synthesized
tcttgatcatccctgccttaaa

SEQ ID NO: 161051 - DNA, 22 bp, Artificial Sequence
  chemically synthesized
cttgatcatccctgccttaaaa

SEQ ID NO: 161052 - DNA, 22 bp, Artificial Sequence
  chemically synthesized
ttgatcatccctgccttaaaaa

SEQ ID NO: 161053 - DNA, 22 bp, Artificial Sequence
  chemically synthesized
gatcatccctgccttaaaaaaa

SEQ ID NO: 161054 - DNA, 22 bp, Artificial Sequence
  chemically synthesized
atcatccctgccttaaaaaaaa

SEQ ID NO: 161055 - DNA, 22 bp, Artificial Sequence
  chemically synthesized
ccttaaaaaaaaaaatcaaagg

SEQ ID NO: 161056 - DNA, 22 bp, Artificial Sequence
  chemically synthesized
aaaaaaaaaaatcaaaggaagt

SEQ ID NO: 161057 - DNA, 22 bp, Artificial Sequence
  chemically synthesized
aaaaaaaaaatcaaaggaagta

SEQ ID NO: 161058 - DNA, 22 bp, Artificial Sequence
  chemically synthesized
actgtgttcttgtcaaagaaaa

SEQ ID NO: 161059 - DNA, 22 bp, Artificial Sequence
  chemically synthesized
tgttcttgtcaaagaaaatctt

SEQ ID NO: 161060 - DNA, 22 bp, Artificial Sequence
  chemically synthesized
ttgtcaaagaaaatcttatgaa

SEQ ID NO: 161061 - DNA, 22 bp, Artificial Sequence
  chemically synthesized
gtcaaagaaaatcttatgaata

SEQ ID NO: 161062 - DNA, 22 bp, Artificial Sequence
  chemically synthesized
tcaaagaaaatcttatgaatat

SEQ ID NO: 161063 - DNA, 22 bp, Artificial Sequence
  chemically synthesized
atgaatatcaagagacaataaa

SEQ ID NO: 161064 - DNA, 22 bp, Artificial Sequence
  chemically synthesized
tgaatatcaagagacaataaag

SEQ ID NO: 161065 - DNA, 22 bp, Artificial Sequence
  chemically synthesized
aaaatttaaatacattttcaga

SEQ ID NO: 161066 - DNA, 22 bp, Artificial Sequence
  chemically synthesized
aaatacattttcagagtcatac

SEQ ID NO: 161067 - DNA, 22 bp, Artificial Sequence
  chemically synthesized
aatacattttcagagtcataca

SEQ ID NO: 161068 - DNA, 22 bp, Artificial Sequence
  chemically synthesized
tcagagtcatacaaggaattac

SEQ ID NO: 161069 - DNA, 22 bp, Artificial Sequence
  chemically synthesized
cagagtcatacaaggaattaca

SEQ ID NO: 161070 - DNA, 22 bp, Artificial Sequence
  chemically synthesized
agagtcatacaaggaattacag

SEQ ID NO: 161071 - DNA, 22 bp, Artificial Sequence
  chemically synthesized
caggcacaaaaattagaaccag

SEQ ID NO: 161072 - DNA, 22 bp, Artificial Sequence
  chemically synthesized
gaaccaggtgttgcatttgaca

SEQ ID NO: 161073 - DNA, 22 bp, Artificial Sequence
  chemically synthesized
catttgacacatcaatgttgtt

SEQ ID NO: 161074 - DNA, 22 bp, Artificial Sequence
  chemically synthesized
gacacatcaatgttgttgtttt

SEQ ID NO: 161075 - DNA, 22 bp, Artificial Sequence
  chemically synthesized
acacatcaatgttgttgttttt

SEQ ID NO: 161076 - DNA, 22 bp, Artificial Sequence
  chemically synthesized
ttgtttttttttttgctaacct

SEQ ID NO: 161077 - DNA, 22 bp, Artificial Sequence
  chemically synthesized
tttttttttttgctaacctcaa

SEQ ID NO: 161078 - DNA, 22 bp, Artificial Sequence
  chemically synthesized
ttttttttgctaacctcaaaat

SEQ ID NO: 161079 - DNA, 22 bp, Artificial Sequence
  chemically synthesized
tttttttgctaacctcaaaatt

SEQ ID NO: 161080 - DNA, 22 bp, Artificial Sequence
  chemically synthesized
ttttttgctaacctcaaaattt

SEQ ID NO: 161081 - DNA, 22 bp, Artificial Sequence
  chemically synthesized
tttttgctaacctcaaaattta

SEQ ID NO: 161082 - DNA, 22 bp, Artificial Sequence
  chemically synthesized
ttttgctaacctcaaaatttac

SEQ ID NO: 161083 - DNA, 22 bp, Artificial Sequence
  chemically synthesized
tttgctaacctcaaaatttact

SEQ ID NO: 161084 - DNA, 22 bp, Artificial Sequence
  chemically synthesized
ttgctaacctcaaaatttactt

SEQ ID NO: 161085 - DNA, 22 bp, Artificial Sequence
  chemically synthesized
tgctaacctcaaaatttacttc

SEQ ID NO: 161086 - DNA, 22 bp, Artificial Sequence
  chemically synthesized
gctaacctcaaaatttacttct

SEQ ID NO: 161087 - DNA, 22 bp, Artificial Sequence
  chemically synthesized
ctaacctcaaaatttacttctt

SEQ ID NO: 161088 - DNA, 22 bp, Artificial Sequence
  chemically synthesized
acctcaaaatttacttctttat

SEQ ID NO: 161089 - DNA, 22 bp, Artificial Sequence
  chemically synthesized
aaaatttacttctttattaatt

SEQ ID NO: 161090 - DNA, 22 bp, Artificial Sequence
  chemically synthesized
acttctttattaattcatcatt

SEQ ID NO: 161091 - DNA, 22 bp, Artificial Sequence
  chemically synthesized
cttctttattaattcatcattt

SEQ ID NO: 161092 - DNA, 22 bp, Artificial Sequence
  chemically synthesized
ctttattaattcatcattttat

SEQ ID NO: 161093 - DNA, 22 bp, Artificial Sequence
  chemically synthesized
tttattaattcatcattttatc

SEQ ID NO: 161094 - DNA, 22 bp, Artificial Sequence
  chemically synthesized
tattaattcatcattttatcaa

SEQ ID NO: 161095 - DNA, 22 bp, Artificial Sequence
  chemically synthesized
attaattcatcattttatcaaa

SEQ ID NO: 161096 - DNA, 22 bp, Artificial Sequence
  chemically synthesized
ttaattcatcattttatcaaaa

SEQ ID NO: 161097 - DNA, 22 bp, Artificial Sequence
  chemically synthesized
attcatcattttatcaaaaacc

SEQ ID NO: 161098 - DNA, 22 bp, Artificial Sequence
  chemically synthesized
atcattttatcaaaaacctgca

SEQ ID NO: 161099 - DNA, 22 bp, Artificial Sequence
  chemically synthesized
tatcaaaaacctgcaatattaa

SEQ ID NO: 161100 - DNA, 22 bp, Artificial Sequence
  chemically synthesized
atcaaaaacctgcaatattaaa

SEQ ID NO: 161101 - DNA, 22 bp, Artificial Sequence
  chemically synthesized
tcaaaaacctgcaatattaaaa

SEQ ID NO: 161102 - DNA, 22 bp, Artificial Sequence
  chemically synthesized
caatattaaaaatactatacta

SEQ ID NO: 161103 - DNA, 22 bp, Artificial Sequence
  chemically synthesized
aaaatactatactacagaatcg

SEQ ID NO: 161104 - DNA, 22 bp, Artificial Sequence
  chemically synthesized
tactacagaatcgtgacataat

SEQ ID NO: 161105 - DNA, 22 bp, Artificial Sequence
  chemically synthesized
cagaatcgtgacataatagtaa

SEQ ID NO: 161106 - DNA, 22 bp, Artificial Sequence
  chemically synthesized
gcacagtgaataattctcatga

SEQ ID NO: 161107 - DNA, 22 bp, Artificial Sequence
  chemically synthesized
tcatgagtttgtacctatgtaa

SEQ ID NO: 161108 - DNA, 22 bp, Artificial Sequence
  chemically synthesized
atgagtttgtacctatgtaatt

SEQ ID NO: 161109 - DNA, 22 bp, Artificial Sequence
  chemically synthesized
gtacctatgtaattctggaaaa

SEQ ID NO: 161110 - DNA, 22 bp, Artificial Sequence
  chemically synthesized
tacctatgtaattctggaaaag

SEQ ID NO: 161111 - DNA, 22 bp, Artificial Sequence
  chemically synthesized
tgtaattctggaaaagagagac

SEQ ID NO: 161112 - DNA, 22 bp, Artificial Sequence
  chemically synthesized
tggaaaagagagactgaaagga

SEQ ID NO: 161113 - DNA, 22 bp, Artificial Sequence
  chemically synthesized
gaaaagagagactgaaaggaag

SEQ ID NO: 161114 - DNA, 22 bp, Artificial Sequence
  chemically synthesized
aaaggaagagaggtggggaatg

SEQ ID NO: 161115 - DNA, 22 bp, Artificial Sequence
  chemically synthesized
agagagaatgaagcattgaaat

SEQ ID NO: 161116 - DNA, 22 bp, Artificial Sequence
  chemically synthesized
aaatctaaccaaagcaggggag

SEQ ID NO: 161117 - DNA, 22 bp, Artificial Sequence
  chemically synthesized
accaaagcaggggagttgcatt

SEQ ID NO: 161118 - DNA, 22 bp, Artificial Sequence
  chemically synthesized
catttattgtattttgtttttt

SEQ ID NO: 161119 - DNA, 22 bp, Artificial Sequence
  chemically synthesized
attgtattttgttttttggtta

SEQ ID NO: 161120 - DNA, 22 bp, Artificial Sequence
  chemically synthesized
ttgtattttgttttttggttag

SEQ ID NO: 161121 - DNA, 22 bp, Artificial Sequence
  chemically synthesized
tattttgttttttggttaggta

SEQ ID NO: 161122 - DNA, 22 bp, Artificial Sequence
  chemically synthesized
tgttttttggttaggtagttac

SEQ ID NO: 161123 - DNA, 22 bp, Artificial Sequence
  chemically synthesized
gttttttggttaggtagttacc

SEQ ID NO: 161124 - DNA, 22 bp, Artificial Sequence
  chemically synthesized
ttttttggttaggtagttacct

SEQ ID NO: 161125 - DNA, 22 bp, Artificial Sequence
  chemically synthesized
tttggttaggtagttacctctg

SEQ ID NO: 161126 - DNA, 22 bp, Artificial Sequence
  chemically synthesized
ttggttaggtagttacctctga

SEQ ID NO: 161127 - DNA, 22 bp, Artificial Sequence
  chemically synthesized
tggttaggtagttacctctgat

SEQ ID NO: 161128 - DNA, 22 bp, Artificial Sequence
  chemically synthesized
ggttaggtagttacctctgatt

SEQ ID NO: 161129 - DNA, 22 bp, Artificial Sequence
  chemically synthesized
gttaggtagttacctctgattc

SEQ ID NO: 161130 - DNA, 22 bp, Artificial Sequence
  chemically synthesized
ggtagttacctctgattcttga

SEQ ID NO: 161131 - DNA, 22 bp, Artificial Sequence
  chemically synthesized
cctctgattcttgaggaatgat

SEQ ID NO: 161132 - DNA, 22 bp, Artificial Sequence
  chemically synthesized
tgattcttgaggaatgatggat

SEQ ID NO: 161133 - DNA, 22 bp, Artificial Sequence
  chemically synthesized
attcttgaggaatgatggatga

SEQ ID NO: 161134 - DNA, 22 bp, Artificial Sequence
  chemically synthesized
ttgaggaatgatggatgagtag

SEQ ID NO: 161135 - DNA, 22 bp, Artificial Sequence
  chemically synthesized
gaggaatgatggatgagtagcc

SEQ ID NO: 161136 - DNA, 22 bp, Artificial Sequence
  chemically synthesized
aggaatgatggatgagtagcca

SEQ ID NO: 161137 - DNA, 22 bp, Artificial Sequence
  chemically synthesized
aaactagataatgtagtttaag

SEQ ID NO: 161138 - DNA, 22 bp, Artificial Sequence
  chemically synthesized
aactagataatgtagtttaagg

SEQ ID NO: 161139 - DNA, 22 bp, Artificial Sequence
  chemically synthesized
gataatgtagtttaaggtaact

SEQ ID NO: 161140 - DNA, 22 bp, Artificial Sequence
  chemically synthesized
aaggtaactctagttttttcaa

SEQ ID NO: 161141 - DNA, 22 bp, Artificial Sequence
  chemically synthesized
aggtaactctagttttttcaat

SEQ ID NO: 161142 - DNA, 22 bp, Artificial Sequence
  chemically synthesized
tagttttttcaatatggtatga

SEQ ID NO: 161143 - DNA, 22 bp, Artificial Sequence
  chemically synthesized
gttttttcaatatggtatgagt

SEQ ID NO: 161144 - DNA, 22 bp, Artificial Sequence
  chemically synthesized
tttcaatatggtatgagtgcaa

SEQ ID NO: 161145 - DNA, 22 bp, Artificial Sequence
  chemically synthesized
ttcaatatggtatgagtgcaag

SEQ ID NO: 161146 - DNA, 22 bp, Artificial Sequence
  chemically synthesized
tcaatatggtatgagtgcaagg

SEQ ID NO: 161147 - DNA, 22 bp, Artificial Sequence
  chemically synthesized
caatatggtatgagtgcaaggt

SEQ ID NO: 161148 - DNA, 22 bp, Artificial Sequence
  chemically synthesized
aatatggtatgagtgcaaggta

SEQ ID NO: 161149 - DNA, 22 bp, Artificial Sequence
  chemically synthesized
ggggagacaaggaaaatatgaa

SEQ ID NO: 161150 - DNA, 22 bp, Artificial Sequence
  chemically synthesized
gggagacaaggaaaatatgaat

SEQ ID NO: 161151 - DNA, 22 bp, Artificial Sequence
  chemically synthesized
ttaatgttgtgcagagttgctg

SEQ ID NO: 161152 - DNA, 22 bp, Artificial Sequence
  chemically synthesized
atgttgtgcagagttgctggac

SEQ ID NO: 161153 - DNA, 22 bp, Artificial Sequence
  chemically synthesized
tgcagagttgctggactttatt

SEQ ID NO: 161154 - DNA, 22 bp, Artificial Sequence
  chemically synthesized
ctggactttattccaaaagcta

SEQ ID NO: 161155 - DNA, 22 bp, Artificial Sequence
  chemically synthesized
gactttattccaaaagctataa

SEQ ID NO: 161156 - DNA, 22 bp, Artificial Sequence
  chemically synthesized
tattccaaaagctataatgtgc

SEQ ID NO: 161157 - DNA, 22 bp, Artificial Sequence
  chemically synthesized
attccaaaagctataatgtgcc

SEQ ID NO: 161158 - DNA, 22 bp, Artificial Sequence
  chemically synthesized
ttccaaaagctataatgtgcca

SEQ ID NO: 161159 - DNA, 22 bp, Artificial Sequence
  chemically synthesized
caaaagctataatgtgccattg

SEQ ID NO: 161160 - DNA, 22 bp, Artificial Sequence
  chemically synthesized
taatgtgccattggagagtatt

SEQ ID NO: 161161 - DNA, 22 bp, Artificial Sequence
  chemically synthesized
gagagtattcatttgtttgctt

SEQ ID NO: 161162 - DNA, 22 bp, Artificial Sequence
  chemically synthesized
atttgtttgcttgtgttctaca

SEQ ID NO: 161163 - DNA, 22 bp, Artificial Sequence
  chemically synthesized
gtttgcttgtgttctacaagta

SEQ ID NO: 161164 - DNA, 22 bp, Artificial Sequence
  chemically synthesized
tttgcttgtgttctacaagtaa

SEQ ID NO: 161165 - DNA, 22 bp, Artificial Sequence
  chemically synthesized
gcttgtgttctacaagtaagac

SEQ ID NO: 161166 - DNA, 22 bp, Artificial Sequence
  chemically synthesized
cttgtgttctacaagtaagacg

SEQ ID NO: 161167 - DNA, 22 bp, Artificial Sequence
  chemically synthesized
gtgttctacaagtaagacgtgt

SEQ ID NO: 161168 - DNA, 22 bp, Artificial Sequence
  chemically synthesized
tgttctacaagtaagacgtgtg

SEQ ID NO: 161169 - DNA, 22 bp, Artificial Sequence
  chemically synthesized
tacaagtaagacgtgtgtgtgt

SEQ ID NO: 161170 - DNA, 22 bp, Artificial Sequence
  chemically synthesized
caagtaagacgtgtgtgtgtgt

SEQ ID NO: 161171 - DNA, 22 bp, Artificial Sequence
  chemically synthesized
cttgggcatgtggcagcatacc

SEQ ID NO: 161172 - DNA, 22 bp, Artificial Sequence
  chemically synthesized
gggcatgtggcagcataccaca

SEQ ID NO: 161173 - DNA, 22 bp, Artificial Sequence
  chemically synthesized
ggcatgtggcagcataccacac

SEQ ID NO: 161174 - DNA, 22 bp, Artificial Sequence
  chemically synthesized
gggctattgtgttagtgaagag

SEQ ID NO: 161175 - DNA, 22 bp, Artificial Sequence
  chemically synthesized
ttgtgttagtgaagaggaggac

SEQ ID NO: 161176 - DNA, 22 bp, Artificial Sequence
  chemically synthesized
tgttagtgaagaggaggactat

SEQ ID NO: 161177 - DNA, 22 bp, Artificial Sequence
  chemically synthesized
gtgaagaggaggactatattgt

SEQ ID NO: 161178 - DNA, 22 bp, Artificial Sequence
  chemically synthesized
tattgtctaaaattagtggcat

SEQ ID NO: 161179 - DNA, 22 bp, Artificial Sequence
  chemically synthesized
tctaaaattagtggcataagaa

SEQ ID NO: 161180 - DNA, 22 bp, Artificial Sequence
  chemically synthesized
aaattagtggcataagaattta

SEQ ID NO: 161181 - DNA, 22 bp, Artificial Sequence
  chemically synthesized
gtggcataagaatttacggcta

SEQ ID NO: 161182 - DNA, 22 bp, Artificial Sequence
  chemically synthesized
acggctagtcaattgttcttga

SEQ ID NO: 161183 - DNA, 22 bp, Artificial Sequence
  chemically synthesized
cggctagtcaattgttcttgaa

SEQ ID NO: 161184 - DNA, 22 bp, Artificial Sequence
  chemically synthesized
gtcaattgttcttgaaaaacct

SEQ ID NO: 161185 - DNA, 22 bp, Artificial Sequence
  chemically synthesized
ttcttgaaaaacctcaggtcat

SEQ ID NO: 161186 - DNA, 22 bp, Artificial Sequence
  chemically synthesized
ttgaaaaacctcaggtcataga

SEQ ID NO: 161187 - DNA, 22 bp, Artificial Sequence
  chemically synthesized
gaaaaacctcaggtcatagatc

SEQ ID NO: 161188 - DNA, 22 bp, Artificial Sequence
  chemically synthesized
aaaaacctcaggtcatagatca

SEQ ID NO: 161189 - DNA, 22 bp, Artificial Sequence
  chemically synthesized
aggtcatagatcatttttttca

SEQ ID NO: 161190 - DNA, 22 bp, Artificial Sequence
  chemically synthesized
ttttcaaggttatggaaaatat

SEQ ID NO: 161191 - DNA, 22 bp, Artificial Sequence
  chemically synthesized
tttcaaggttatggaaaatatt

SEQ ID NO: 161192 - DNA, 22 bp, Artificial Sequence
  chemically synthesized
ttcaaggttatggaaaatattc

SEQ ID NO: 161193 - DNA, 22 bp, Artificial Sequence
  chemically synthesized
tcaaggttatggaaaatattca

SEQ ID NO: 161194 - DNA, 22 bp, Artificial Sequence
  chemically synthesized
caaggttatggaaaatattcac

SEQ ID NO: 161195 - DNA, 22 bp, Artificial Sequence
  chemically synthesized
aaggttatggaaaatattcaca

SEQ ID NO: 161196 - DNA, 22 bp, Artificial Sequence
  chemically synthesized
tggaaaatattcacatatgggc

SEQ ID NO: 161197 - DNA, 22 bp, Artificial Sequence
  chemically synthesized
acatatgggcagatgtccatac

SEQ ID NO: 161198 - DNA, 23 bp, Artificial Sequence
  chemically synthesized
  misc_feature (1)..(21): n is a, c, g, or t
nnnnnnnnnnnnnnnnnnnnnrg

SEQ ID NO: 161199 - protein, 9 aa, Artificial Sequence
  chemically synthesized
LAGLIDADG

SEQ ID NO: 161200 - DNA, 19 bp, Artificial Sequence
  guide
cagaaatagtgcgtccttt

SEQ ID NO: 161201 - DNA, 19 bp, Artificial Sequence
  Guide
aaggacgcactatttctga

SEQ ID NO: 161202 - DNA, 19 bp, Artificial Sequence
  Guide
caagaaaagagagaactcg

SEQ ID NO: 161203 - DNA, 19 bp, Artificial Sequence
  Guide
aaaagagagaactcgtggg

SEQ ID NO: 161204 - DNA, 19 bp, Artificial Sequence
  Guide
aactcgtgggtggatttag

SEQ ID NO: 161205 - DNA, 19 bp, Artificial Sequence
  Guide
ctcgtgggtggatttagtg

SEQ ID NO: 161206 - DNA, 19 bp, Artificial Sequence
  Guide
tagtggggtagttactcct

SEQ ID NO: 161207 - DNA, 19 bp, Artificial Sequence
  Guide
ggtcaatggaggtactctt

SEQ ID NO: 161208 - DNA, 19 bp, Artificial Sequence
  Guide
actcaggatatagctcatt

SEQ ID NO: 161209 - DNA, 19 bp, Artificial Sequence
  Guide
tttctcttaacgtcttcaa

SEQ ID NO: 161210 - DNA, 19 bp, Artificial Sequence
  Guide
ctaacttgggtatagtcag

SEQ ID NO: 161211 - DNA, 19 bp, Artificial Sequence
  Guide
caagccccctgtttggatc

SEQ ID NO: 161212 - DNA, 19 bp, Artificial Sequence
  Guide
attgccagatccaaacagg

SEQ ID NO: 161213 - DNA, 19 bp, Artificial Sequence
  Guide
cattgccagatccaaacag

SEQ ID NO: 161214 - DNA, 19 bp, Artificial Sequence
  Guide
tcattgccagatccaaaca

SEQ ID NO: 161215 - DNA, 19 bp, Artificial Sequence
  Guide
ttcattgccagatccaaac

SEQ ID NO: 161216 - DNA, 19 bp, Artificial Sequence
  Guide
tcctaagggtcttgggtac

SEQ ID NO: 161217 - DNA, 19 bp, Artificial Sequence
  Guide
ggtgctacatacttcctaa

SEQ ID NO: 161218 - DNA, 19 bp, Artificial Sequence
  Guide
tatggtgaggtgagctctt

SEQ ID NO: 161219 - DNA, 19 bp, Artificial Sequence
  Guide
ctcaccatatctcttgagt

SEQ ID NO: 161220 - DNA, 19 bp, Artificial Sequence
  Guide
gtgggagcacatagatagg

SEQ ID NO: 161221 - DNA, 19 bp, Artificial Sequence
  Guide
gctttgtgggttattagtg

SEQ ID NO: 161222 - DNA, 19 bp, Artificial Sequence
  Guide
ctgctttgtgggttattag

SEQ ID NO: 161223 - DNA, 19 bp, Artificial Sequence
  Guide
attattgtacatgagcaac

SEQ ID NO: 161224 - DNA, 19 bp, Artificial Sequence
  Guide
acataagtacacatcttac

SEQ ID NO: 161225 - DNA, 19 bp, Artificial Sequence
  Guide
ccagtcaatctagagaatt

SEQ ID NO: 161226 - DNA, 19 bp, Artificial Sequence
  Guide
aaattctctagattgactg

SEQ ID NO: 161227 - DNA, 19 bp, Artificial Sequence
  Guide
caaattctctagattgact

SEQ ID NO: 161228 - DNA, 19 bp, Artificial Sequence
  Guide
ccaaattctctagattgac

SEQ ID NO: 161229 - DNA, 19 bp, Artificial Sequence
  Guide
acatgctgttcatttactc

SEQ ID NO: 161230 - DNA, 19 bp, Artificial Sequence
  Guide
acctaaactgaggaacctt

SEQ ID NO: 161231 - DNA, 19 bp, Artificial Sequence
  Guide
tatcagttagggtccatca

SEQ ID NO: 161232 - DNA, 19 bp, Artificial Sequence
  Guide
gttagggtccatcaaggaa

SEQ ID NO: 161233 - DNA, 19 bp, Artificial Sequence
  chemically synthesized
actgctgtcaatgccctgt

SEQ ID NO: 161234 - DNA, 19 bp, Artificial Sequence
  chemically synthesized
aagtgaacgtggatgcagt

SEQ ID NO: 161235 - DNA, 19 bp, Artificial Sequence
  chemically synthesized
tttcctaccctcagattac

SEQ ID NO: 161236 - DNA, 19 bp, Artificial Sequence
  chemically synthesized
ccaccagtaatctgagggt

SEQ ID NO: 161237 - DNA, 19 bp, Artificial Sequence
  chemically synthesized
tagaccaccagtaatctga

SEQ ID NO: 161238 - DNA, 19 bp, Artificial Sequence
  chemically synthesized
ttaaaatagcaagattgtg

SEQ ID NO: 161239 - DNA, 19 bp, Artificial Sequence
  chemically synthesized
ttgtctctccacatgggta

SEQ ID NO: 161240 - DNA, 19 bp, Artificial Sequence
  chemically synthesized
tgtctctccacatgggtat

SEQ ID NO: 161241 - DNA, 19 bp, Artificial Sequence
  chemically synthesized
agcctctcccatacccatg

SEQ ID NO: 161242 - DNA, 19 bp, Artificial Sequence
  chemically synthesized
tggggcagaagtcgttgct

SEQ ID NO: 161243 - DNA, 19 bp, Artificial Sequence
  chemically synthesized
atgctgatgggaataacct

SEQ ID NO: 161244 - DNA, 19 bp, Artificial Sequence
  chemically synthesized
ctggcccgcaactttggca

SEQ ID NO: 161245 - DNA, 19 bp, Artificial Sequence
  chemically synthesized
aattccttgccaaagttgc

SEQ ID NO: 161246 - DNA, 19 bp, Artificial Sequence
  chemically synthesized
gaattccttgccaaagttg

SEQ ID NO: 161247 - DNA, 19 bp, Artificial Sequence
  chemically synthesized
caatggtacttgtgagcca

SEQ ID NO: 161248 - DNA, 19 bp, Artificial Sequence
  Artificial Sequence
ggttatcaggaaacagtcc

SEQ ID NO: 161249 - DNA, 19 bp, Artificial Sequence
  chemically synthesized
gggtcttcttatggttatc

SEQ ID NO: 161250 - DNA, 19 bp, Artificial Sequence
  chemically synthesized
gggaaatagggtcttctta

SEQ ID NO: 161251 - DNA, 19 bp, Artificial Sequence
  Artificial Sequence
aggaaccttcttacacacc

SEQ ID NO: 161252 - DNA, 19 bp, Artificial Sequence
  chemically synthesized
ttcctgaggctctacagat

SEQ ID NO: 161253 - DNA, 19 bp, Artificial Sequence
  Artificial Sequence
tccctatctgtagagcctc

SEQ ID NO: 161254 - DNA, 19 bp, Artificial Sequence
  Artificial Sequence
aaagcaagggaaccgtaca

SEQ ID NO: 161255 - DNA, 19 bp, Artificial Sequence
  chemically synthesized
cacccattaatgccttgta

SEQ ID NO: 161256 - DNA, 19 bp, Artificial Sequence
  chemically synthesized
aatcgtagcattacccttg

SEQ ID NO: 161257 - DNA, 19 bp, Artificial Sequence
  chemically synthesized
ttgatggggtatagtatta

SEQ ID NO: 161258 - DNA, 19 bp, Artificial Sequence
  chemically synthesized
ggagcaggaacacttgatg

SEQ ID NO: 161259 - DNA, 19 bp, Artificial Sequence
  chemically synthesized
tggagcaggaacacttgat

SEQ ID NO: 161260 - DNA, 19 bp, Artificial Sequence
  chemically synthesized
tagagaagtttattgtggc

SEQ ID NO: 161261 - DNA, 19 bp, Artificial Sequence
  chemically synthesized
acaaagaaacactgtgcga

SEQ ID NO: 161262 - DNA, 19 bp, Artificial Sequence
  chemically synthesized
acacattgtcagtatattc

SEQ ID NO: 161263 - DNA, 19 bp, Artificial Sequence
  chemically synthesized
gaaaacctcttccgccatt

SEQ ID NO: 161264 - DNA, 19 bp, Artificial Sequence
  chemically synthesized
ctaggcctaatggcggaag

SEQ ID NO: 161265 - DNA, 19 bp, Artificial Sequence
  Chemically synthesized
ttccgccattaggcctaga

SEQ ID NO: 161266 - DNA, 19 bp, Artificial Sequence
  Chemically synthesized
tccgccattaggcctagaa

SEQ ID NO: 161267 - DNA, 19 bp, Artificial Sequence
  Chemically synthesized
gcccttctaggcctaatgg

SEQ ID NO: 161268 - DNA, 19 bp, Artificial Sequence
  Chemically synthesized
gacctctggttatgggctc

SEQ ID NO: 161269 - DNA, 19 bp, Artificial Sequence
  Chemically synthesized
ccagtggacctctggttat

SEQ ID NO: 161270 - DNA, 19 bp, Artificial Sequence
  Chemically synthesized
actgaatccagtggacctc

SEQ ID NO: 161271 - DNA, 19 bp, Artificial Sequence
  Chemically synthesized
ctggattcagtgagctagt

SEQ ID NO: 161272 - DNA, 19 bp, Artificial Sequence
  Chemically synthesized
gagagccagaactgtctaa

SEQ ID NO: 161273 - DNA, 19 bp, Artificial Sequence
  Chemically synthesized
gagccagaactgtctaatg

SEQ ID NO: 161274 - DNA, 19 bp, Artificial Sequence
  Chemically synthesized
tgcccccattagacagttc

SEQ ID NO: 161275 - DNA, 19 bp, Artificial Sequence
  Chemically synthesized
tcgcatgtacattctgcaa

SEQ ID NO: 161276 - DNA, 19 bp, Artificial Sequence
  Chemically synthesized
gaatgtacatgcgactgaa

SEQ ID NO: 161277 - DNA, 19 bp, Artificial Sequence
  Chemically synthesized
aatgtacatgcgactgaaa

SEQ ID NO: 161278 - DNA, 19 bp, Artificial Sequence
  Chemically synthesized
acatgcgactgaaagggtg

SEQ ID NO: 161279 - DNA, 19 bp, Artificial Sequence
  Chemically synthesized
tggtatgggaggtatacta

SEQ ID NO: 161280 - DNA, 19 bp, Artificial Sequence
  Chemically synthesized
atgagccacatggtatggg

SEQ ID NO: 161281 - DNA, 19 bp, Artificial Sequence
  Chemically synthesized
aggatgagccacatggtat

SEQ ID NO: 161282 - DNA, 19 bp, Artificial Sequence
  Chemically synthesized
atggaagtcaacttgctgt

SEQ ID NO: 161283 - DNA, 19 bp, Artificial Sequence
  Chemically synthesized
cttccattctaacccacat

SEQ ID NO: 161284 - DNA, 19 bp, Artificial Sequence
  Chemically synthesized
ctgagttctaaaatcatcg

SEQ ID NO: 161285 - DNA, 19 bp, Artificial Sequence
  Chemically synthesized
ctaaaatcatcggggattt

SEQ ID NO: 161286 - DNA, 19 bp, Artificial Sequence
  Chemically synthesized
taaaatcatcggggatttt

SEQ ID NO: 161287 - DNA, 19 bp, Artificial Sequence
  Chemically synthesized
gctacttgcccattcacca

SEQ ID NO: 161288 - DNA, 19 bp, Artificial Sequence
  Chemically synthesized
cgaactgttgattagaggt

SEQ ID NO: 161289 - DNA, 19 bp, Artificial Sequence
  Chemically synthesized
gaaacaatgaggacctgac

SEQ ID NO: 161290 - DNA, 19 bp, Artificial Sequence
  Chemically synthesized
atagcatctactcttgttc

SEQ ID NO: 161291 - DNA, 19 bp, Artificial Sequence
  Chemically synthesized
ccacttttagaccttatcc

SEQ ID NO: 161292 - DNA, 19 bp, Artificial Sequence
  Chemically synthesized
ttttagaccttatcctggc

SEQ ID NO: 161293 - DNA, 19 bp, Artificial Sequence
  Chemically synthesized
ttaagtggctaccggtttg

SEQ ID NO: 161294 - DNA, 19 bp, Artificial Sequence
  Chemically synthesized
tctgtactagcatattccc

SEQ ID NO: 161295 - DNA, 19 bp, Artificial Sequence
  Chemically synthesized
taaatttaacgaagttcct

SEQ ID NO: 161296 - DNA, 19 bp, Artificial Sequence
  Chemically synthesized
ttaaatttaacgaagttcc

SEQ ID NO: 161297 - DNA, 19 bp, Artificial Sequence
  Chemically synthesized
gtgttttaggctaatatag

SEQ ID NO: 161298 - DNA, 19 bp, Artificial Sequence
  Chemically synthesized
actgctgaaagagatgcgg

SEQ ID NO: 161299 - DNA, 19 bp, Artificial Sequence
  Chemically synthesized
tgctgaaagagatgcggtg

SEQ ID NO: 161300 - DNA, 19 bp, Artificial Sequence
  Chemically synthesized
ccaatctcagggcaagtta

SEQ ID NO: 161301 - DNA, 19 bp, Artificial Sequence
  Chemically synthesized
tctgccctgccttttatgc

SEQ ID NO: 161302 - DNA, 19 bp, Artificial Sequence
  Chemically synthesized
actgctgtcaatgccctgt

SEQ ID NO: 161303 - DNA, 19 bp, Artificial Sequence
  Chemically synthesized
ctgtggggcaaagtgaacg

SEQ ID NO: 161304 - DNA, 19 bp, Artificial Sequence
  Chemically synthesized
cacgttcactttgccccac

SEQ ID NO: 161305 - DNA, 19 bp, Artificial Sequence
  Chemically synthesized
aagtgaacgtggatgcagt

SEQ ID NO: 161306 - DNA, 19 bp, Artificial Sequence
  Chemically synthesized
tttcctaccctcagattac

SEQ ID NO: 161307 - DNA, 19 bp, Artificial Sequence
  Chemically synthesized
ccaccagtaatctgagggt

SEQ ID NO: 161308 - DNA, 19 bp, Artificial Sequence
  Chemically synthesized
attactggtggtctaccct

SEQ ID NO: 161309 - DNA, 19 bp, Artificial Sequence
  Chemically synthesized
ccactcaagagatatggtg

SEQ ID NO: 161310 - DNA, 19 bp, Artificial Sequence
  Chemically synthesized
gtgtgctggcccgcaactt

SEQ ID NO: 161311 - DNA, 19 bp, Artificial Sequence
  Chemically synthesized
gtatacctcccataccatg

SEQ ID NO: 161312 - DNA, 19 bp, Artificial Sequence
  Chemically synthesized
tagaccaccagtaatctga

SEQ ID NO: 161313 - DNA, 30 bp, Artificial Sequence
  Chemically synthesized
ccttgccttgacaaggcaaacttgaccaat

SEQ ID NO: 161314 - DNA, 43 bp, Artificial Sequence
  Chemically synthesized
ccttgccttgaccaatagccttgacaaggcaaacttgaccaat

SEQ ID NO: 161315 - DNA, 78 bp, Artificial Sequence
  Chemically synthesized
gggggccccttccccacactatctcaatgcaaatatctgtctgaaacggtccctggctaaactccacccatgggttgg
